United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 77

SEQ ID NO: 147594 - DNA, 894 bp, Artificial Sequence
  Description of Artificial Sequence: Synthetic coding sequence
atggctgtgttcaaccagaagtctgtgtctgacatgatcaaggagttcaggaagaactggagggccctgtgcaacagcgagaggaccaccctgtgtggggctgacagcatgctgctggccctgcagctgtccatggccgagaacaacaagcagcacagcggggagttcaccgtgtccctgagtgatgtgctgctgacctggaagtacctgctgcacgagaagctgaacctgcctgtggagaacatggatgtgacagaccactatgaagatgtgaggaagatctatgatgacttcctgaagaacagcaacatgctggacctgattgatgtgtaccagaagtgccgggccctgaccagcaactgtgagaactacaacacagtgagccccagccagctgctggacttcctgagcggcaagcagtatgctgtgggagatgaaacagacctgagcatccccaccagccccaccagcaagtacaacagagacaatgagaaggtgcagctgctggccaggaagatcatcttctcctacctgaacctgctggtgaacagcaagaatgacctggccgtggcctacatcctgaacatcccagaccggggcctgggccgggaggccttcacagacctgaagcacgccgcccgggagaagcagatgagcatcttcctggtggccaccagcttcatccgcaccatcgagctgggcggcaagggctacgcccctcctccaagtgaccccctgcggacccacgtgaagggcctgagcaacttcatcaacttcatcgacaagctggatgagatcctgggggagatccccaacccccggggctgcaagagcatctgctggaagatcaacaactggaatgagttctggaagtgcagcagcggccagaagtag

SEQ ID NO: 147595 - DNA, 1497 bp, Artificial Sequence; identical to SEQ ID NO: 147592
  Description of Artificial Sequence: Synthetic coding sequence

SEQ ID NO: 147596 - DNA, 813 bp, Artificial Sequence
  Description of Artificial Sequence: Synthetic coding sequence
atggccaggtttgccctgactgtggtgagacatggagagacccgcttcaacaaggagaagatcatccagggccagggcgtggatgagcccctgtctgagaccggcttcaagcaggccgctgctgctggcatcttcctgaacaacgtgaagttcacccacgccttcagcagtgacctgatgaggaccaagcagaccatgcacggcatcctggagaggagcaagttctgcaaggacatgacagtgaagtatgacagccggctgcgggagaggaaatatggagtggtggagggcaaggccctgtctgagctgcgggccatggccaaggccgcccgggaggagtgccctgtgttcaccccacctggaggagagaccctggaccaggtgaagatgaggggcatcgacttctttgagttcctgtgccagctgatcctgaaggaggccgaccagaaggagcagttcagccagggcagccccagcaactgcctggagaccagcctggccgagatcttccccctgggcaagaaccacagcagcaaggtgaacagcgacagcggcatccctggcctggccgcctctgtgctggtggtgagccacggggcctacatgaggagcctgtttgactacttcctgacagacctgaagtgcagcctgcctgccaccctgagccgctctgagctgatgtctgtgacccccaacacaggcatgagcctcttcatcatcaactttgaggagggccgggaggtgaagcccaccgtgcagtgcatctgcatgaacctgcaggaccacctgaatggcctgacagagaccaggtag

SEQ ID NO: 147597 - DNA, 501 bp, Artificial Sequence
  Description of Artificial Sequence: Synthetic coding sequence
atgagcacagtgggcctcttccacttccccacccccctgacccgcatctgcccagccccctggggcctgcggctgtgggagaagctgaccctgctgagccctggcattgctgtgacccctgtgcagatggccggcaagaaggactacccagccctgctgagcctggatgaaaatgagctggaggagcagtttgtgaagggccacggccctgggggccaggccaccaacaagaccagcaactgtgtggtgctgaagcacatccccagcggcatcgtggtgaagtgccaccagaccaggtctgtggaccagaacaggaagctggccaggaagatcctgcaggagaaggtggatgtgttctacaatggagagaacagccctgtgcacaaggagaagcgggaggccgccaagaagaagcaggagaggaagaagagggccaaggagaccctggagaagaagaagctgctgaaggagctgtgggagagcagcaagaaggtgcactag

SEQ ID NO: 147598 - DNA, 501 bp, Artificial Sequence; identical to SEQ ID NO: 147597
  Description of Artificial Sequence: Synthetic coding sequence

SEQ ID NO: 147599 - DNA, 501 bp, Artificial Sequence; identical to SEQ ID NO: 147597
  Description of Artificial Sequence: Synthetic coding sequence

SEQ ID NO: 147600 - DNA, 111 bp, Artificial Sequence
  Description of Artificial Sequence: Synthetic coding sequence
atgagcacagtgggcctcttccacttccccacccccctgacccgcatctgcccagccccctggggcctgcggctgtgggagaagctgaccctgctgagccctggcatctag

SEQ ID NO: 147601 - DNA, 417 bp, Artificial Sequence
  Description of Artificial Sequence: Synthetic coding sequence
atgagcacagtgggcctcttccacttccccacccccctgacccgcatctgcccagccccctggggcctgcggctgtgggagaagctgaccctgctgagccctggcattgctgtgacccctgtgcagatggccggcaagaaggactacccagccctgctgagcctggatgaaaatgagctggaggagcagtttgtgaagggccacggccctgggggccaggccaccaacaagaccagcaactgtgtggtgctgaagcacatccccagcggcatcgtggtgaagtgccaccagaccaggtctgtggaccagaacaggaagctggccaggaagatcctgcaggagaaggtggatgtgttctacaatggagagaacagccctgtgcacaaggagaagcgggaggccgccaagaagaagtag

SEQ ID NO: 147602 - DNA, 291 bp, Artificial Sequence
  Description of Artificial Sequence: Synthetic coding sequence
atgagcacagtgggcctcttccacttccccacccccctgacccgcatctgcccagccccctggggcctgcggctgtgggagaagctgaccctgctgagccctggcattgctgtgacccctgtgcagatggccggcaagaaggactacccagccctgctgagcctggatgaaaatgagctggaggagcagtttgtgaagggccacggccctgggggccaggccaccaacaagaccagcaactgtgtggtgctgaagcacatccccagcggcatcgtggtgaaggtggactag

SEQ ID NO: 147603 - DNA, 423 bp, Artificial Sequence
  Description of Artificial Sequence: Synthetic coding sequence
atgagccgcttcctgaatgtgctgcgctcctggctggtgatggtgtccatcatcgccatgggcaacaccctgcagagcttccgggaccacaccttcctgtatgagaagctgtacacaggcaagcccaacctggtgaatggcctgcaggcccggaccttcggcatctggaccctgctgagcagcgtcatccgctgcctgtgtgccatcgacatccacaacaagaccctgtaccacatcaccctgtggaccttcctgctggccctgggccacttcctgtctgagctgtttgtgtatggaacagctgcccccaccatcggcgtgctggcccccctgatggtggccagcttcagcatcctgggcatgctggtgggcctgcgctacctggaggtggagcctgtgtcccggcagaagaagagaaattag

SEQ ID NO: 147604 - DNA, 1443 bp, Artificial Sequence
  Description of Artificial Sequence: Synthetic coding sequence
atgaacagaaccaagggagatgaggaggagtactggaacagcagcaagttcaaggccttcacctttgatgatgaagatgatgagctgagccagctgaaggagagcaagagagctgtgaacagcctgcgggactttgtggatgatgatgatgatgatgacctggagcgggtgtcctggagcggggagcctgtgggcagcatctcctggagcatccgggagacagctggcaacagcggcagcacccatgagggccgggagcagctgaagagcagaaattccttcagcagctatgcccagctgcccaagcccaccagcacctacagcctgagcagcttcttccgggccctgagtgacaccccagccaagagctatgcccctgagctgggccggcccaagggggagtacagagactacagcaatgactggagccccagcgacacagtgcggcggctgaggaagggcaaggtgtgcagcctggagcgcttccgcagcctgcaggacaagctgcagctgctggaggaggccgtgtccatgcatgatggaaatgtcatcacagctgtgctgatcttcctgaagaggaccctgagcaaggagatcctcttccgggagctggaggtgcggcaggtggccctgcggcacctgatccacttcctgaaggagattggagaccagaagctgctgctggacctcttccgcttcctggacagaacagaggagctggccctgagccactaccgggagcacctgaacatccaggaccctgacaagaggaaggagttcctgaagacctgtgtgggcctgcccttctctgctgaggacagcgcccacatccaggaccactacaccctgctggagcggcagatcatcatcgaggccaatgacagacacctggagagcgctggccagacagagatcttcaggaagcaccccaggaaggccagcatcctgaacatgcccctggtgaccaccctcttctacagctgcttctaccactacacagaagctgagggcaccttcagcagccctgtgaacctgaagaagaccttcaagatcccagacaagcagtatgtgctgacagccctggccgcccgggccaagctgcgggcctggaatgatgtggatgccctcttcaccaccaagaactggctgggctacaccaagaagagggcccccatcggcttccaccgggtggtggagatcctgcacaagaacaatgcccctgtgcagatcctgcaggagtatgtgaacctggtggaggatgtggacaccaagctgaacctggccaccaagttcaagtgccatgatgtggtgattgacacctacagagacctgaaggaccggcagcagctgctggcctaccgcagcaaggtggacaagggcagcgctgaggaggagaagattgatgccctgctgagcagcagccagatccgctggaagaactag

SEQ ID NO: 147605 - DNA, 1482 bp, Artificial Sequence
  Description of Artificial Sequence: Synthetic coding sequence
atgaacagaaccaagggagatgaggaggagtactggaacagcagcaagttcaaggccttcacctttgatgatgaagatgatgagctgagccagctgaaggagagcaagagagctgtgaacagcctgcgggactttgtggatgatgatgatgatgatgacctggagcgggtgtcctggagcggggagcctgtgggcagcatctcctggagcatccgggagacagctggcaacagcggcagcacccatgagggccgggagcagctgaagagcagaaattccttcagcagctatgcccagctgcccaagcccaccagcacctacagcctgagcagcttcttccggggccgcaccaggcctggcagcttccagagcctgagtgatgccctgagtgacaccccagccaagagctatgcccctgagctgggccggcccaagggggagtacagagactacagcaatgactggagccccagcgacacagtgcggcggctgaggaagggcaaggtgtgcagcctggagcgcttccgcagcctgcaggacaagctgcagctgctggaggaggccgtgtccatgcatgatggaaatgtcatcacagctgtgctgatcttcctgaagaggaccctgagcaaggagatcctcttccgggagctggaggtgcggcaggtggccctgcggcacctgatccacttcctgaaggagatcggggaccagaagctgctgctggacctcttccgcttcctggacagaacagaggagctggccctgagccactaccgggagcacctgaacatccaggaccctgacaagaggaaggagttcctgaagacctgtgtgggcctgcccttcagcgcagaagattctgcccacatccaggaccactacaccctgctggagcggcagatcatcatcgaggccaatgacagacacctggagagcgctggccagacagagatcttcaggaagcaccccaggaaggccagcatcctgaacatgcccctggtgaccaccctcttctacagctgcttctaccactacacagaggccgagggcaccttcagcagccctgtgaacctgaagaagaccttcaagatcccagacaagcagtatgtgctgacagccctggccgcccgggccaagctgcgggcctggaatgatgtggatgccctcttcaccaccaagaactggctgggctacaccaagaagagggcccccatcggcttccaccgggtggtggagatcctgcacaagaacaatgcccctgtgcagatcctgcaggagtatgtgaacctggtggaggatgtggacaccaagctgaacctggccaccaagttcaagtgccatgatgtggtgattgacacctacagagacctgaaggaccggcagcagctgctggcctaccgcagcaaggtggacaagggcagcgctgaggaggagaagattgatgccctgctgagcagcagccagatccgctggaagaactag

SEQ ID NO: 147606 - DNA, 1335 bp, Artificial Sequence
  Description of Artificial Sequence: Synthetic coding sequence
atgaacagaaccaagggagatgaggaggagtactggaacagcagcaagttcaaggccttcacctttgatgatgaagatgatgagctgagccagctgaaggagagcaagagagctgtgaacagcctgcgggactttgtggatgatgatgatgatgatgacctggagcgggtgtcctggagcggggagcctgtgggcagcaggacccggcccggcagcttccagagcctgagtgatgccctgagtgacaccccagccaagagctatgcccctgagctgggccggcccaagggggagtacagagactacagcaatgactggagccccagcgacacagtgcggcggctgaggaagggcaaggtgtgcagcctggagcgcttccgcagcctgcaggacaagctgcagctgctggaggaggccgtgtccatgcatgatggaaatgtcatcacagctgtgctgatcttcctgaagaggaccctgagcaaggagatcctcttccgggagctggaggtgcggcaggtggccctgcggcacctgatccacttcctgaaggagattggagaccagaagctgctgctggacctcttccgcttcctggacagaacagaggagctggccctgagccactaccgggagcacctgaacatccaggaccctgacaagaggaaggagttcctgaagacctgtgtgggcctgcccttctctgctgaggacagcgcccacatccaggaccactacaccctgctggagcggcagatcatcatcgaggccaatgacagacacctggagagcgctggccagacagagatcttcaggaagcaccccaggaaggccagcatcctgaacatgcccctggtgaccaccctcttctacagctgcttctaccactacacagaagctgagggcaccttcagcagccctgtgaacctgaagaagaccttcaagatcccagacaagcagtatgtgctgacagccctggccgcccgggccaagctgcgggcctggaatgatgtggatgccctcttcaccaccaagaactggctgggctacaccaagaagagggcccccatcggcttccaccgggtggtggagatcctgcacaagaacaatgcccctgtgcagatcctgcaggagtatgtgaacctggtggaggatgtggacaccaagctgaacctggccaccaagttcaagtgccatgatgtggtgattgacacctacagagacctgaaggaccggcagcagctgctggcctaccgcagcaaggtggacaagggcagcgctgaggaggagaagattgatgccctgctgagcagcagccagatccgctggaagaactag

SEQ ID NO: 147607 - DNA, 1482 bp, Artificial Sequence; identical to SEQ ID NO: 147605
  Description of Artificial Sequence: Synthetic coding sequence

SEQ ID NO: 147608 - DNA, 1560 bp, Artificial Sequence
  Description of Artificial Sequence: Synthetic coding sequence
atgaccaccggcctcatcctcttcttccagagcggccggcccctgggcgccggcgtgcggctgggcctgggcctgaggatgaacagaaccaagggagatgaggaggagtactggaacagcagcaagttcaaggccttcacctttgatgatgaagatgatgagctgagccagctgaaggagagcaagagagctgtgaacagcctgcgggactttgtggatgatgatgatgatgatgacctggagcgggtgtcctggagcggggagcctgtgggcagcatctcctggagcatccgggagacagctggcaacagcggcagcacccatgagggccgggagcagctgaagagcagaaattccttcagcagctatgcccagctgcccaagcccaccagcacctacagcctgagcagcttcttccggggccgcaccaggcctggcagcttccagagcctgagtgatgccctgagtgacaccccagccaagagctatgcccctgagctgggccggcccaagggggagtacagagactacagcaatgactggagccccagcgacacagtgcggcggctgaggaagggcaaggtgtgcagcctggagcgcttccgcagcctgcaggacaagctgcagctgctggaggaggccgtgtccatgcatgatggaaatgtcatcacagctgtgctgatcttcctgaagaggaccctgagcaaggagatcctcttccgggagctggaggtgcggcaggtggccctgcggcacctgatccacttcctgaaggagatcggggaccagaagctgctgctggacctcttccgcttcctggacagaacagaggagctggccctgagccactaccgggagcacctgaacatccaggaccctgacaagaggaaggagttcctgaagacctgtgtgggcctgcccttcagcgcagaagattctgcccacatccaggaccactacaccctgctggagcggcagatcatcatcgaggccaatgacagacacctggagagcgctggccagacagagatcttcaggaagcaccccaggaaggccagcatcctgaacatgcccctggtgaccaccctcttctacagctgcttctaccactacacagaggccgagggcaccttcagcagccctgtgaacctgaagaagaccttcaagatcccagacaagcagtatgtgctgacagccctggccgcccgggccaagctgcgggcctggaatgatgtggatgccctcttcaccaccaagaactggctgggctacaccaagaagagggcccccatcggcttccaccgggtggtggagatcctgcacaagaacaatgcccctgtgcagatcctgcaggagtatgtgaacctggtggaggatgtggacaccaagctgaacctggccaccaagttcaagtgccatgatgtggtgattgacacctacagagacctgaaggaccggcagcagctgctggcctaccgcagcaaggtggacaagggcagcgctgaggaggagaagattgatgccctgctgagcagcagccagatccgctggaagaactag

SEQ ID NO: 147609 - DNA, 138 bp, Artificial Sequence
  Description of Artificial Sequence: Synthetic coding sequence
atgaacagaaccaagggagatgaggaggagtactggaacagcagcaagttcaaggccttcacctttgatgatgaagatgatgagctgagccagctgaaggagagcaagagagctgtgaacagcctgcgggacttctag

SEQ ID NO: 147610 - DNA, 1482 bp, Artificial Sequence; identical to SEQ ID NO: 147605
  Description of Artificial Sequence: Synthetic coding sequence

SEQ ID NO: 147611 - DNA, 735 bp, Artificial Sequence
  Description of Artificial Sequence: Synthetic coding sequence
atgttccggaggaagctgacagccctggactaccacaacccagctggcttcaactgcaaggatgaaacagagttcaggaacttcatcgtgtggctggaggaccagaagatccgccactacaagattgaagatcggggcaacctgaggaacatccacagcagtgactggcccaagttctttgagaagtacctgagagatgtgaactgccccttcaagatccaggaccggcaggaggccatcgactggctgctgggcctggccgtgcggctggagtatggagacaatgctgagaagtacaaggacctggtgcctgacaacagcaagacagctgacaatgccaccaagaatgctgagcccctcatcaacctggatgtgaacaacccagacttcaaggccggcgtgatggccctggccaacctgctgcagatccagagacatgatgactacctggtgatgctgaaggccatccgcatcctggtgcaggagcggctgacccaggatgctgtggccaaggccaaccagaccaaggagggcctgcctgtggccctggacaagcacatcctgggctttgacacaggagatgctgtgctgaatgaggccgcccagatcctgcggctgctgcacatcgaggagctgcgggagctgcagaccaagatcaatgaggccatcgtggccgtgcaggccatcatcgctgaccccaagacagaccaccggctgggcaaggtgggccgctag

SEQ ID NO: 147612 - DNA, 177 bp, Artificial Sequence
  Description of Artificial Sequence: Synthetic coding sequence
atgctgcagagcatcatcaagaacatctggatccccatgaagccctactacaccaaggtgtaccaggagatctggattggcatgggcctgatgggcttcatcgtgtacaagatccgggctgctgacaagaggagcaaggccctgaaggccagcgccccagcccctggccaccactag

SEQ ID NO: 147613 - DNA, 228 bp, Artificial Sequence
  Description of Artificial Sequence: Synthetic coding sequence
atgaagctgtatggcacccggggcagtgacatcagccacttccagtgccagatgctgcagagcatcatcaagaacatctggatccccatgaagccctactacaccaaggtgtaccaggagatctggattggcatgggcctgatgggcttcatcgtgtacaagatccgggctgctgacaagaggagcaaggccctgaaggccagcgccccagcccctggccaccactag

SEQ ID NO: 147614 - DNA, 177 bp, Artificial Sequence; identical to SEQ ID NO: 147612
  Description of Artificial Sequence: Synthetic coding sequence

SEQ ID NO: 147615 - DNA, 177 bp, Artificial Sequence; identical to SEQ ID NO: 147612
  Description of Artificial Sequence: Synthetic coding sequence

SEQ ID NO: 147616 - DNA, 2928 bp, Artificial Sequence
  Description of Artificial Sequence: Synthetic coding sequence
atgacccagcagccccaggatgactttgacagatctgtggaggatgcccaggcctggatgaaggctgtgcaggaccagctgcaggtgaatgacaacacccagggcccccgggccgccctggaggcccggctgtgggagacagagaagatctgccagctggagcctgagggccgggtgcgggtggacctggtgctgaggatggccgaggccctgctggcctgctgccctggggaccagaagccaggcatcctggcccggctgaaggacatcaaggcccagtgggaggagaccgtgacctacatgacccactgccacagccgcatcgagtgggtgtggctgcactggagcgagtacctgctggccagagatgagttctaccgctggttccagaagatgatggtgaccctggagccccacatcgagctgcagctgggcctgaaggagaagcagtggcagctgagccacgcccaggtgctgctgcacaacgtggacaaccaggccgtgctgctggaccggctgctggaggaggccgccagcctcttcaaccgcatcggggaccccagcgtggatgaagatgcccagaagaggatgaaggccgagtatgatgctgtgaaggccaaggcccagaagagggtggacctgctggagcaggtggcccgggagcacgaggagtaccaggccggcgtggatgagttccagctgtggctgaaggctgtggtggagaaggtgaatggctgcctgggcaggaactgcaagctgcccatcacccagaggctgagcaccctgcaggacatcgccaaggacttccccagaggagaggagagcctggagaccctggaggagcagagcgctggggtcatccggaacaccagccccctgggcgctgagaagatcactggagagctggaggagatgaggaaggtgctggagaagctgcgggccctgtgggaggaggaggaggagcggctgcggggcctgctgcggagcagaggagcctgggagcagcagatcaagcagctggaggccgagctgtctgagttcaggatggtgctgcagaggctggcccaggagggcctgcagcctgctgccaaggccggcacagaagatgagctggtggcccactggaggcgctacagcgccaccagggctgccctggccagcgaggagccccgggtggaccggctgcaggcccagctgaaggagctgattgtgttcccccacaacctgaagcccctgagtgacagcgtgattgccaccatccaggagtaccagagcctgaaggtgaagagcgcccggctgagaaatgctgctgctgtggagctgtggcagcacttccagaggcccctgcaggacctgcagctgtggaaggccctggcccagaggctgctggaggtgacagccagcctgcctgacctgcccagcctgcacaccttcctgccccagatcgaggccgccctgatggagagcagccggctgaaggagctgctgaccatgctgcagctgaagaaggacctgctgattggcatcttcggccaggagcgggccacagccctgctggagcaggtggccggctccatgagggaccgggacctgctgcacaacagcctgctgcagaggaagagcaagctgcagagcctgctggcccagcacaaggactttggagctgcctttgagcccctgcagaggaagctgctggacctgcaggtgcgggtgcaggccgagaagggcctgcagagggacctgcccgggaagcaggcccagctgagccggctgcagggcctgcaggaggagggcctggacctgggcgcccagatggaggccgcccggcccctggtgcaggagaaccccaaccaccagcacaagatggaccagctgagcagtgacttccaggccctgcagaggagcctggaggacctggtggaccgctgccggcagagcgtgcaggagcactgcaccttcagccaccagctgctggagctgcggcagtggatcgtggtgaccacccagaagctggaggcccacagaggagaggccggccctggagatgctgagagccaggaggccgagtttgagcggctggtggccgagttccctgagaaggaggcccagctgagcctggtggaggcccagggctggctggtgatggagaagagcagccctgagggcgctgctgtggtgcaggaggagctgcgggagctggccgagagctggagggccctgcggctgctggaggagagcctgctgagcctcatccggaactggcacctgcagaggatggaggtggacagcggcaagaagatggtgttcaccaacaacatccccaagagcggcttcctgatcaaccccatggaccccatccccaggcacagaagaagagccaacctgctgcaggaggaggagggcagccatgaggacttcagccagctgctgaggaactttggccagtggctgcaggtggagaacagcaagctggtgcgcatcatcgccatgaggaccagcacagctgaggacctgcggaccaggaagagcaagctgcaggagctggaggcccgggtgcctgagggccagcacctgtttgagaacctgctgcggctgggccctgcccggggcaccagtgatgagctggaggacctgcgctaccagtggatgctgtacaagagcaagctgaaggacagcggccacctgctgacccagagcagccctggagagcccaccggcttccagaagacccggcgctggaggggcctgggcagcctcttcagaagagcctgctgcgtggccctgcccctgcagctgctgctgctgctcttcctgctgctgctcttcctgctgcccatccgggaggaggacaggagctgcaccctggccaacaactttgcccggagcttcaccctgatgctgcgctacaacggccccccacccacctag

SEQ ID NO: 147617 - DNA, 1791 bp, Artificial Sequence
  Description of Artificial Sequence: Synthetic coding sequence
atgacccagcagccccaggatgactttgacagatctgtggaggatgcccaggcctggatgaaggctgtgcaggaccagctgcaggtgaatgacaacacccagggcccccgggccgccctggaggcccggctgtgggagacagagaagatctgccagctggagcctgagggccgggtgcgggtggacctggtgctgaggatggccgaggccctgctggcctgctgccctggggaccagaagccaggcatcctggcccggctgaaggacatcaaggcccagtgggaggagaccgtgacctacatgacccactgccacagccgcatcgagtgggtgtggctgcactggagcgagtacctgctggccagagatgagttctaccgctggttccagaagatgatggtgaccctggagccccacatcgagctgcagctgggcctgaaggagaagcagtggcagctgagccacgcccaggtgctgctgcacaacgtggacaaccaggccgtgctgctggaccggctgctggaggaggccgccagcctcttcaaccgcatcggggaccccagcgtggatgaagatgcccagaagaggatgaaggccgagtatgatgctgtgaaggccaaggcccagaagagggtggacctgctggagcaggtggcccgggagcacgaggagtaccaggccggcgtggatgagttccagctgtggctgaaggctgtggtggagaaggtgaatggctgcctgggcaggaactgcaagctgcccatcacccagaggctgagcaccctgcaggacatcgccaaggacttccccagaggagaggagagcctggagaccctggaggagcagagcgctggggtcatccggaacaccagccccctgggcgctgagaagatcactggagagctggaggagatgaggaaggtgctggagaagctgcgggccctgtgggaggaggaggaggagcggctgcggggcctgctgcggagcagaggagcctgggagcagcagatcaagcagctggaggccgagctgtctgagttcaggatggtgctgcagaggctggcccaggagggcctgcagcctgctgccaaggccggcacagaagatgagctggtggcccactggaggcgctacagcgccaccagggctgccctggccagcgaggagccccgggtggaccggctgcaggcccagctgaaggagctgattgtgttcccccacaacctgaagcccctgagtgacagcgtgattgccaccatccaggagtaccagagcctgaaggtgaagagcgcccggctgagaaatgctgctgctgtggagctgtggcagcacttccagaggcccctgcaggacctgcagctgtggaaggccctggcccagaggctgctggaggtgacagccagcctgcctgacctgcccagcctgcacaccttcctgccccagatcgaggccgccctgatggagagcagccggctgaaggagctgctgaccatgctgcagctgaagaaggacctgctgattggcatcttcggccaggagcgggccacagccctgctggagcaggtggccggctccatgagggaccgggacctgctgcacaacagcctgctgcagaggaagagcaagctgcagagcctgctggcccagcacaaggactttggagctgcctttgagcccctgcagaggaagctgctggacctgcaggtgcgggtgcaggccgagaagggcctgcagagggacctgcccgggaagcaggcccagctgagccggctgcaggtgcggggcctgtag

SEQ ID NO: 147618 - DNA, 2913 bp, Artificial Sequence
  Description of Artificial Sequence: Synthetic coding sequence
atgacccagcagccccaggatgactttgacagatctgtggaggatgcccaggcctggatgaaggctgtgcaggaccagctgcaggtgaatgacaacacccagggcccccgggccgccctggaggcccggctgtgggagacagagaagatctgccagctggagcctgagggccgggtgcgggtggacctggtgctgaggatggccgaggccctgctggcctgctgccctggggaccagaagccaggcatcctggcccggctgaaggacatcaaggcccagtgggaggagaccgtgacctacatgacccactgccacagccgcatcgagtgggtgtggctgcactggagcgagtacctgctggccagagatgagttctaccgctggttccagaagatgatggtgaccctggagccccacatcgagctgcagctgggcctgaaggagaagcagtggcagctgagccacgcccaggtgctgctgcacaacgtggacaaccaggccgtgctgctggaccggctgctggaggaggccgccagcctcttcaaccgcatcggggaccccagcgtggatgaagatgcccagaagaggatgaaggccgagtatgatgctgtgaaggccaaggcccagaagagggtggacctgctggagcaggtggcccgggagcacgaggagtaccaggccggcgtggatgagttccagctgtggctgaaggctgtggtggagaaggtgaatggctgcctgggcaggaactgcaagctgcccatcacccagaggctgagcaccctgcaggacatcgccaaggacttccccagaggagaggagagcctggagaccctggaggagcagagcgctggggtcatccggaacaccagccccctgggcgctgagaagatcactggagagctggaggagatgaggaaggtgctggagaagctgcgggccctgtgggaggaggaggaggagcggctgcggggcctgctgcggagcagaggagcctgggagcagcagatcaagcagctggaggccgagctgtctgagttcaggatggtgctgcagaggctggcccaggagggcctgcagcctgctgccaaggccggcacagaagatgagctggtggcccactggaggcgctacagcgccaccagggctgccctggccagcgaggagccccgggtggaccggctgcaggcccagctgaaggagctgattgtgttcccccacaacctgaagcccctgagtgacagcgtgattgccaccatccaggagtaccagagcctgaaggtgaagagcgcccggctgagaaatgctgctgctgtggagctgtggcagcacttccagaggcccctgcaggacctgcagctgtggaaggccctggcccagaggctgctggaggtgacagccagcctgcctgacctgcccagcctgcacaccttcctgccccagatcgaggccgccctgatggagagcagccggctgaaggagctgctgaccatgctgcagctgaagaaggacctgctgattggcatcttcggccaggagcgggccacagccctgctggagcaggtggccggctccatgagggaccgggacctgctgcacaacagcctgctgcagaggaagagcaagctgcagagcctgctggcccagcacaaggactttggagctgcctttgagcccctgcagaggaagctgctggacctgcaggtgcgggtgcaggccgagaagggcctgcagagggacctgcccgggaagcaggcccagctgagccggctgcagggcctgcaggaggagggcctggacctgggcgcccagatggaggccgcccggcccctggtgcaggagaaccccaaccaccagcacaagatggaccagctgagcagtgacttccaggccctgcagaggagcctggaggacctggtggaccgctgccggcagagcgtgcaggagcactgcaccttcagccaccagctgctggagctgcggcagtggatcgtggtgaccacccagaagctggaggcccacagaggagaggccggccctggagatgctgagagccaggaggccgagtttgagcggctggtggccgagttccctgagaaggaggcccagctgagcctggtggaggcccagggctggctggtgatggagaagagcagccctgagggcgctgctgtggtgcaggaggagctgcgggagctggccgagagctggagggccctgcggctgctggaggagagcctgctgagcctcatccggaactggcacctgcagaggatggaggtggacagcggcaagaagatggtgttcaccaacaacatccccaagagcggcttcctgatcaaccccatggaccccatccccaggcacagaagaagagaggaggagggcagccatgaggacttcagccagctgctgaggaactttggccagtggctgcaggtggagaacagcaagctggtgcgcatcatcgccatgaggaccagcacagctgaggacctgcggaccaggaagagcaagctgcaggagctggaggcccgggtgcctgagggccagcacctgtttgagaacctgctgcggctgggccctgcccggggcaccagtgatgagctggaggacctgcgctaccagtggatgctgtacaagagcaagctgaaggacagcggccacctgctgacccagagcagccctggagagcccaccggcttccagaagacccggcgctggaggggcctgggcagcctcttccggcgggcctgctgcgtggccctgcccctgcagctgctgctgctgctcttcctgctgctgctcttcctgctgcccatccgggaggaggacaggagctgcaccctggccaacaactttgcccgctccttcaccctgatgctgcgctacaatggacctccacccacctag

SEQ ID NO: 147619 - DNA, 3471 bp, Artificial Sequence
  Description of Artificial Sequence: Synthetic coding sequence
atgggcaacctgctgagcaagttccggcccggctgcagaagaagacccctgcccggccctggccgcggggccccagcccccctgagcagagatgccagccccccaggccgggcccacagcgtgcccaccccccggcccttccggggcctcttcagaagaaatgccaggagaagacccagcgctgccagcatctttgtggcccccaagaggccctgccccctgcccagggctgctgctgcccccctgggcgtgctgcctgctgtgggctggggcctggccatcaggaagacccccatgctgcctgccagaaatccaccccgcttcggccaccccagctctgtgcgcatccccccacccagcaggatgttcaccctgctgctgcccagcccccgggagcctgctgtgaaggccaggaagcccatcccagccaccctgctggaggagacagaggtgtgggcccaggagggcccccggcgggtgaagaaggatgaggaccctgtgcagattgaaggagaagatgatgagaagaggacccccctgagcagcggggaggccagcagcaccagccgcagccagggcacccagggagatgtggccagcttccgctgcagccctggccccctggagggcaatgtgtaccacaagttcagcgagaacagcatgtctgagaaggcccaggccagccctgccagcagctgcctggagggccctgccatgcccagcacccacagccaggccggctgtgcccggcacctgggcaagccagaccctgatgccacagcccctcctgagcctgctgtgggctgcagcctgctgcagcagaagctggccgctgaggtgctgaatgaggagcccccacccagcagcctgggcctgcccatccccctgatgtctgggaagaggatgccagatgagaagcccttctgcatccccccaagatctgctgccccaccccgggccgccaggaaccggccctgcaagaggaagatgagcatccccctgctgctgcccctgccccccagcctgcccctgctgtgggacagaggagagctgcccccaccagccaagctgccctgcctgtctgtggagggggacctgcacaccctggagaagagccctgagtacaagaggaacagccgcatcctggaggacaagacagagaccatgaccaacagcagcatcacccagcctgcccccagcttcagccagcctgtgcagaccacagacagcctgcccctgaccacctacaccagccaggtgtctgcccccctgcccatcccagacctggccgacctggccaccggccccctcatcctgcccatcccccccctgagcaccacccccaagatggatgagaagatcgccttcaccatccccaacagccccctggccctgcctgctgacctggtgcccatcctgggggaccagagcaatgagaagggcggcagctacaacagcgtggtgggcgccgcccccctgaccagtgacccccccaccccacccagcagcacccccagcttcaagccccctgtgacccgggagagccccatctccatgtgtgtggacagccccccacccctgtccttcctgaccctgctgcctgtgcccagcacaggcaccagcgtcatcaccagcaagcccatgaacagcaccagcgtcatcagcacagtgaccaccaatgccagcgcccacctgaccagccagacagctgtggaccctgaggtggtgaacatggacaccacagcccccagccaggtggtgatcttcaccagcagcctgagcagccgggtgagcagcctgcccaacagccagatccactgcagcgctgagcagaggcaccctgggaagacctctgtgtacaccagccccctgcccttcatcttccacaacaccacccccagcttcaaccagctgtttgggaaggaggccaccccccagcccaagtttgaggccccagatggccagccccagaaggccagcctgcccagcgcctgtgtgttcctgagcctgcccatcatccccccaccagacaccagcaccctggtgaacagcgccagcacagccagcagcagcaagccacccatcgagaccaatgccatgcacaccaccccacccagcaaggccgtcatcctgcagagcgcctctgtgtccaagaagtacctgcccttctacctgggcctgcccggcagcggcaacacccagcccagcggcaacacagcctctgtgcagggcagcaccagcctgcctgcccagagcgtgcgggccccagccacagccagcaaccaccccctgaaccctggggccaccccccagcccaagtttggagccccagatggcccccagcagaagaccagcctgcccagcgcccatgacttcctgagcctgcccatcatggtgcccccagacaccagcaccctggtgtcctctgccagcgctgccagcctgagcaagccagccatcgacaccagtgacatgaacaccaccccacccagcaagacagtcatcctgcagagcacctttgtgtccaggaaggaggagtacatccgcttctacatgggcctgcccggcagcggcaacaccctgcacagcgacagcatcgccagcgcccaggtgtccaccagcttccctgcccaggccgacagaagacccaccaccaccagcagccaccccctgaacacaggcagcatcagccacagcaccctgggcgccacagatggccagcagaagagtgacagcagcttcatcctgggcaacccagccaccccagcccctgtgattggcctgaccagccccagcgtgcagcccctgagcggcagcatcatccccccaggctttgctgagctgaccagcccctacacagccctgggcacccctgtgaatgctgagcctgtggagggccacaatgccagcgccttccccaacggcacagccaagaccagcggcttccgcatcgccaccggcatgcctggcactggagacagcaccctgctggtgggcaacaccatccctggcccccaggtgatcatgggccctggcacccccatggatggcggcagcatcggcttctccatgtctgcccctggccccagcagcaccagcggggagctgaacatcggccagggccagagcggcacccccagcaccaccagcgtcttccccttcggccaggccgcctgggaccccaccggccacagcatggccgccgccccccagggcgccagcaacatccctgtgtttggctacaccagcgctgctgcctacatccctggcctggacccccccacccagaacagctgcagcggcatgggaggagatggcaccaggagcatcgtgggcggcccctgtgtgcctgccttccagcagtgcatcctgcagcacacctggacagagaggaagttctacaccagcagcacccactactacggccaggagacctacgtgcggcggcacgtgtgcttccagctgccctag

SEQ ID NO: 147620 - DNA, 5733 bp, Artificial Sequence
  Description of Artificial Sequence: Synthetic coding sequence
atggcctgctgccacaaggtgatgctgctgctggacacagctgggggcgccgcccggcacagccgggtgcggcgggccgccctgcggctgctgacctacctgagctgccgcttcggcctggcccgggtgcactgggccttcaagttctttgacagccagggcgcccggagccggcccagccgggtgtctgacttccgggagctgggcagccgctcctgggaggactttgaggaggagctggaggcccggctggaggaccgggcccacctgcccggccctgccccccgggccacccacacccatggagccctgatggagaccctgctggactaccagtgggacaggcctgagatcaccagccccaccaagcccatcctgcggagcagtggaagaaggctgctggatgtggagagcgaggccaaggaggccgaggccgccctgggcggcctggtgaatgctgtgttcctgctggccccctgcccccacagccagcgggagctgctgcagtttgtgtctggctgtgaggcccaggcccagaggctgccccccacccccaagcaggtgatggagaagctgctgcccaagagggtgcgggaggtgatggtggccaggaagatcaccttctactgggtggacaccacagagtggagcaagctgtgggagagcccagaccacctgggctactggacagtgtgtgagctgctgcaccacggcggcggcaccgtgctgcccagcgagagcttctcctgggactttgcccaggccggggagatgctgctgcggagcggcatcaagctgagcagcgagccccacctgagcccctggatctccatgctgcccacagatgccaccctgaaccggctgctgtacaacagcccagaatatgaggccagcttccccaggatggagggcatgctgttcctgcctgtggaggccggcaaggagatccaggagacctggacagtgaccctggagcccctggccatgcaccagaggcacttccagaagcctgtgcgcatcttcctgaagggctctgtggcccagtggagcctgcccaccagcagcaccctgggcacagacagctggatgctgggcagccctgaggagagcacagccacccagaggctgctcttccagcagctggtgtcccggctgacagctgaggagctgcacctggtggctgatgtggaccccggggagggccggccccccatcaccggggtcatcagccccctgagcgccagcgccatgatcctgactgtgtgcaggaccaaggaggccgagttccagagacatgtgctgcagacagctgtggccgacagcccccgggacacagccagcctcttcagtgatgtggtggacagcatcctgaaccagacccatgacagcctggccgacacagccagcgctgccagccctgtgcctgagtgggcccagcaggagctgggccacaccaccccctggagccctgctgtggtggagaagtggttccccttctgcaacatcagcggggccagcagtgacctgatggagagctttggcctgctgcaggccgccagcgccaacaaggaggagagcagcaagacagaaggagagctgatccactgcctggccgagctgtaccagaggaagagccgggaggagagcaccatcgcccaccaggaggacagcaagaagaagaggggcgtgcccaggacccctgtgcggcagaagatgaacaccatgtgccgcagcctgaagatgctgaatgtggcccggctgaatgtgaaggcccagaagctgcacccagatggcagcccagatgtggccggggagaagggcatccagaagatccccagcggccgcacagtggacaagctggaggaccggggccgcaccctgcggagcagcaagcccaaggacttcaagacagaggaggagctgctgagctacatccgggagaactaccagaagacagtggccactggagagatcatgctgtatgcctgtgccaggaacatgatcagcacagtgaagatgttcctgaagagcaagggcaccaaggagctggaggtgaactgcctgaaccaggtgaagagcagcctgctgaagaccagcaagagcctgcggcagaacctgggcaagaagctggacaaggaggacaaggtgcgggagtgccagctgcaggtgttcctgcggctggagatgtgcctgcagtgccccagcatcaatgaaagcacagatgacatggagcaggtggtggaggaggtgacagacctgctgaggatggtgtgcctgacagaagattctgcctacctggccgagttcctggaggagatcctgcggctgtacatcgacagcatccccaagaccctgggcaacctgtacaacagcctgggcttcgtcatcccccagaagctggccggcgtgctgcccacagacttcttcagtgatgacagcatgacccaggagaacaagagccccctgctgtctgtgcccttcctgagcagcgcccggcgctctgtgtctggcagccctgagagtgatgagctgcaggagctgcggaccaggtctgccaagaagaggaggaagaatgccctgatccgccacaagagcattgctgaggtgtcccagaacctgcggcagatcgagatccccaaggtgtccaagagggccaccaagaaggagaacagccacccagccccccagcagcccagccagcctgtgaaggacacagtgcaggaggtgaccaaggtgagaagaaacctcttcaaccaggagctgctgagccccagcaagaggagcctgaagaggggcctgcccaggagccacagcgtgtctgctgtggatggcctggaggacaagctggacaacttcaagaagaacaagggctaccacaagctgctgaccaagtctgtggccgagacccctgtgcacaagcagatcagcaagaggctgctgcaccggcagatcaagggccgcagcagtgaccccggccctgacattggagtggtggaggagagccctgagaagggagatgagatcagcctgcggcgcagcccccgcatcaagcagctgtccttcagcaggacccacagcgccagcttctacagcgtgtcccagcccaagagccgctctgtgcagagggtgcacagcttccagcaggacaagagtgaccagcgggagaacagccctgtgcagagcatccgcagccccaagagcctgctgtttggagccatgtctgagatgatcagccccagcgagaagggcagcgccaggatgaagaagaggagcaggaacaccctggacagcgaggtgcctgctgcctaccagacccccaagaagagccaccagaagagcctgtccttcagcaagaccaccccccggcgcatcagccacaccccccagacccccctgtacaccccagagcggctgcagaagagccctgccaagatgacccccaccaagcaggccgccttcaaggagagcctgaaggacagcagcagccctggccatgacagccccctggacagcaagatcaccccccagaagaggcacacccaggccggggagggcaccagcctggagaccaagacccccaggacccccaagaggcagggcacccagcccccaggcttcctgcccaactgcacctggccccacagcgtgaacagcagccctgagagccccagctgcccagccccacccaccagcagcacagcccagcccaggagagaatgtctgacccccatccgggaccccctgcggaccccacccagggctgctgccttcatgggcaccccccagaaccagacccaccagcagccccacgtgctgcgggccgcccgggcagaggagcccgcccagaagctgaaggacaaggccatcaagacccccaagaggcctggcaacagcacagtgaccagcagcccccctgtgacccccaagaagctgttcaccagccccctgtgtgatgtgtccaagaagagccccttcaggaagagcaagattgaatgtcccagccctggagagctggaccagaaggagccccagatgagccccagcgtggccgccagcctgagctgccctgtgcccagcaccccacctgagctgagccagagggccaccctggacacagtgcccccacctccacccagcaaggtgggcaagcgctgcaggaagaccagtgacccccggcgcagcatcgtggagtgccagccagatgccagcgccaccccaggagtgggcacagctgacagccctgctgcccccacagacagcagagatgaccagaagggcctgagcctgagcccccagagccccccagagcggcggggctacccaggccctggcctgcggagtgactggcacgccagcagccccctgctgatcaccagtgacacagaacatgtgaccctgctgtctgaggccgagcaccacggcattggagacctgaagagcaatgtgctgtctgtggaggagggggagggcctgaggacagcagatgctgagaagagcagcctgagccaccctggcatcccccccagcccccccagctgtggccctggcagccccctgatgcccagcagagatgtgcactgcaccacagatggccggcagtgccaggccagcgcccagctggacaacctgcctgccagcgcctggcacagcacagattctgccagcccccagacctatgaggtggagctggagatgcaggccagcggcctgcccaagctgcgcatcaagaagattgaccccagcagcagcctggaggccgagcccctgagcaaggaggagagcagcctgggggaggagagcttcctgcctgccctgtccatgccccgggccagccgcagcctgagcaagccagagcccacctacgtgagccccccctgcccccggctgagccacagcacccctgggaagagccggggccagacctacatctgccaggcctgcacccccacccacggccccagcagcacccccagccccttccagacagatggagtgccctggacccccagccccaagcacagcggcaagaccaccccagacatcatcaaggactggcccaggaggaagagagctgtgggctgtggggccggcagcagcagcggccgcggggaggtgggcgctgacctgcccggcagcctgagcctgctggagagcgagggcaaggaccacggcctggagctgagcatccacaggacccccatcctggaggactttgagctggagggcgtgtgccagctgcctgaccagagccccccaagaaattccatgcccaaggccgaggaggccagctcctggggccagtttggcctgagcagcaggaagagggtgctgctggccaaggaggaggccgacagaggagccaagaggatctgtgacctgagagaagattctgaggtgtccaagagcaaggagggcagccccagctggagcgcctggcagctgcccagcactggagatgaggaggtgtttgtgtctggcagcaccccaccacccagctgtgctgtgcgcagctgcctgagcgccagcgccctgcaggccctgacccagagccccctgctcttccagggcaagacccccagcagccagagcaaggaccccagagatgaagatgtggatgtgctgcccagcacagtggaggacagccccttcagccgggccttcagcagaagaagacccatcagcaggacctacaccaggaagaagctgatgggcacctggctggaggacctgtag

SEQ ID NO: 147621 - DNA, 354 bp, Artificial Sequence
  Description of Artificial Sequence: Synthetic coding sequence
atgaagctgagcagcgctgctggccaggagagccctggccacccccaccccagccccccagcctggaccctgaagaagcccagcgagagcgtggcccagagggccatgtgcagcgcccgggcctgccctgtggcctgccctgtgggctgccccatcgcctgccctgtgtcctgccctgtggcctgccctgtgggctgccctgtgggctccatggccacagccccccagggcctgagcccccaggagtgggaggccgaccgggagaccggcagcagcagccatgctggcaccacccagtgcagcatccacagccccagcagcagcagccgccacctgagcaggacccagacctag

SEQ ID NO: 147622 - DNA, 627 bp, Artificial Sequence; identical to SEQ ID NO: 146959
  Description of Artificial Sequence: Synthetic coding sequence

SEQ ID NO: 147623 - DNA, 765 bp, Artificial Sequence
  Description of Artificial Sequence: Synthetic coding sequence
atgagcctggcccggggccatggagacacagctgccagcacagctgcccccctgtctgaggagggggaggtgaccagcggcctgcaggccctggccgtggaggacaccggcggccccagcgccagcgctgggaaggcagaagatgaaggagagggcggccgggaggagacagagcgggagggcagcggcggggaggaggcccagggcgaggtgcccagcgctggaggagaggagcctgctgaggaggacagcgaggactggtgtgtgccctgcagtgatgaggaggtggagctgcctgcagatggccagccctggatgcccccacccagcgagatccagaggctgtatgagctgctggccgcccacggcaccctggagctgcaggccgagatcctgccccggcggccccccaccccagaggcccagagcgaggaggagaggagtgatgaggagcctgaggccaaggaggaggaggaggagaagccccacatgcccacagaatttgattttgatgatgagcctgtgacccccaaggacagcctgattgacagaagaaggaccccaggcagcagcgcccggagccagaagcgggaggcccggctggacaaggtgctgagtgacatgaagaggcacaagaagctggaggagcagatcctgaggacaggccgggacctcttcagcctggacagcgaggaccccagccctgccagcccccccctgcggagcagcggcagcagcctcttcccccggcagaggaagtactag

SEQ ID NO: 147624 - DNA, 2010 bp, Artificial Sequence
  Description of Artificial Sequence: Synthetic coding sequence
atgggcagtgaccccagcgcccctggccggcccggctggacaggcagcctgctgggggaccgggaggaggccgcccggccccggctgctgcccctgctgctggtgctgctgggctgcctgggcctgggcgtggccgcagaagatgctgaggtgcatgctgagaactggctgcggctgtatggctacctgccccagcccagccgccacatgagcaccatgaggtctgcccagatcctggccagcgccctggccgagatgcagcgcttctacggcatccctgtgactggagtgctggatgaggagaccaaggagtggatgaagaggccccgctgtggggtgcctgaccagtttggagtgcgggtgaaggccaacctgcggcggcggaggaagagatatgccctgactggaaggaagtggaacaaccaccacctgaccttcagcatccagaactacacagagaagctgggctggtaccacagcatggaggccgtgagaagagccttccgggtgtgggagcaggccacccccctggtgttccaggaggtgccctatgaggacatccggctgcggcggcagaaggaggccgacatcatggtgctgtttgccagcggcttccacggggacagcagcccctttgatggcactggaggcttcctggcccacgcctacttccctggccctggcctgggcggggacacccactttgatgctgatgagccctggaccttcagcagcacagacctgcacggcaacaacctcttcctggtggccgtgcatgagctgggccacgccctgggcctggagcacagcagcaaccccaatgccatcatggcccccttctaccagtggaaggatgtggacaacttcaagctgcctgaagatgacctgcggggcatccagcagctgtatggcaccccagatggccagccccagcccacccagcccctgcccaccgtgaccccccggcggcccggccgcccagaccacaggcctccccggcccccccagcccccacctcctgggggcaagccagagaggcctcccaagccaggcccccctgtgcagccccgggccacagagaggccagaccagtatggccccaacatctgtgatggagactttgacacagtggccatgctgcggggggagatgtttgtgttcaagggccgctggttctggagggtgcgccacaacagagtgctggacaactaccccatgcccatcggccacttctggaggggcctgcccggggacatctctgctgcctatgagcggcaggacggccgctttgtgttcttcaagggggaccgctactggctgttccgggaggccaacctggagcccggctacccccagcccctgaccagctatggcctgggcatcccctatgacagaattgacacagccatctggtgggagcccaccggccacaccttcttcttccaggaggaccgctactggaggttcaatgaggagacccagagaggagaccccggctaccccaagcccatctctgtgtggcagggcatcccagccagccccaagggggccttcctgagcaatgatgctgcctacacctacttctacaagggcaccaagtactggaagtttgacaatgaaaggctgaggatggagcccggctaccccaagagcatcctgcgggacttcatgggctgccaggagcacgtggagcccggcccccgctggccagatgtggcccggccccccttcaacccccacggcggcgctgagcctggagctgacagcgcagaaggagatgtgggagatggagatggagactttggagctggggtgaacaaggatggcggcagccgggtggtggtgcagatggaggaggtggccaggacagtgaatgtggtgatggtgctggtgcccctgctgctgctgctgtgtgtgctgggcctgacctacgccctggtgcagatgcagaggaagggggccccccgggtgctgctgtactgcaagaggagcctgcaggagtgggtgtag

SEQ ID NO: 147625 - DNA, 561 bp, Artificial Sequence
  Description of Artificial Sequence: Synthetic coding sequence
atgtctgctgcccccctggtgggctacagcagcagcggctctgaagatgaaagtgaagatggcatgaggaccaggcctggagatggcagccaccggcggggccagagccccctgccccggcagcgcttccctgtgcctgacagcgtgctgaacatgtttcctggaacagaggagggcccagaagatgacagcaccaagcatggaggccgggtgaggaccttcccccatgagcggggcaactgggccacccacgtgtatgtgccctatgaggccaaggaggagttcctggacctgctggatgtgctgctgccccacgcccagacctacgtgccccggctggtgaggatgaaggtgttccacctgagcctgagccagagcgtggtgctgcggcaccactggatcctgccctttgtgcaggccctgaaggccaggatgaccagcttccacagcccccaccctggcccccactgcctgattggcaccaaggatgcccctgtgacccaggagatccccaaggacctgggcgccctgcggcaggagcccggcagccagaccaggtag

SEQ ID NO: 147626 - DNA, 744 bp, Artificial Sequence
  Description of Artificial Sequence: Synthetic coding sequence
atgtctgctgcccccctggtgggctacagcagcagcggctctgaagatgaaagtgaagatggcatgaggaccaggcctggagatggcagccaccggcggggccagagccccctgccccggcagcgcttccctgtgcctgacagcgtgctgaacatgtttcctggaacagaggagggcccagaagatgacagcaccaagcatggaggccgggtgaggaccttcccccatgagcggggcaactgggccacccacgtgtatgtgccctatgaggccaaggaggagttcctggacctgctggatgtgctgctgccccacgcccagacctacgtgccccggctggtgaggatgaaggtgttccacctgagcctgagccagagcgtggtgctgcggcaccactggatcctgccctttgtgcaggccctgaaggccaggatgaccagcttccacaggaccttcatcggcctggaggtgaccagcggccacgcccagttcctggacctggtgtctgaggtggacagagtgatggaggagttcaacctgaccaccttctaccaggaccccagcttccacctgagcctggcctggtgtgtgggagatgcccggctgcagctggagggccagtgcctgcaggagctgcaggccatcgtggatggctttgaagatgctgaggtgctgctgcgggtgcacacagagcaggtgcgctgcaagagcggcaacaagttcttctccatgcccctgaagtag

SEQ ID NO: 147627 - DNA, 642 bp, Artificial Sequence
  Description of Artificial Sequence: Synthetic coding sequence
atgagccccctgccccggcagcgcttccctgtgcctgacagcgtgctgaacatgtttcctggaacagaggagggcccagaagatgacagcaccaagcatggaggccgggtgaggaccttcccccatgagcggggcaactgggccacccacgtgtatgtgccctatgaggccaaggaggagttcctggacctgctggatgtgctgctgccccacgcccagagcgtggtgctgcggcaccactggatcctgccctttgtgcaggccctgaaggccaggatgaccagcttccaccgcttcttcttcaccgccaaccaggtgaagatctacaccaaccaggagaagaccaggaccttcatcggcctggaggtgaccagcggccacgcccagttcctggacctggtgtctgaggtggacagagtgatggaggagttcaacctgaccaccttctaccaggaccccagcttccacctgagcctggcctggtgtgtgggagatgcccggctgcagctggagggccagtgcctgcaggagctgcaggccatcgtggatggctttgaagatgctgaggtgctgctgcgggtgcacacagagcaggtgcgctgcaagagcggcaacaagttcttctccatgcccctgaagtag

SEQ ID NO: 147628 - DNA, 1683 bp, Artificial Sequence
  Description of Artificial Sequence: Synthetic coding sequence
atgggcagcacagacagcaagctgaacttcaggaaggctgtgatccagctgaccaccaagacccagcctgtggaggccacagatgatgcctatgaccctgtgggctacggcatcccctacaaccacctgctcttcagtgactaccgggagcccctggtggaggaggccgcccaggtgctgattgtgaccctggaccatgacagcgccagcagcgccagccccaccgtggatggcaccaccactggaacagccatggatgatgctgaccccccaggccctgagaacctgtttgtgaactacctgagccgcatccaccgggaggaggacttccagttcatcctgaagggcatcgcccggctgctgagcaaccccctgctgcagacctacctgcccaacagcaccaagaagatccagttccaccaggagctgctggtgctcttctggaagctgtgtgacttcaacaagaagttcctgttctttgtgctgaagagcagtgatgtgctggacatcctggtgcccatcctcttcttcctgaatgatgcccgggctgaccagagccgggtgggcctgatgcacatcggggtcttcatcctgctgctgctgagcggggagaggaactttggagtgcggctgaacaagccctacagcatccgggtgcccatggacatccctgtgttcaccggcacccatgctgacctgctgattgtggtgttccacaagatcatcaccagcggccaccagaggctgcagcccctgtttgactgcctgctgaccatcgtggtgaatgtgagcccctacctgaagagcctgtccatggtgacagccaacaagctgctgcacctgctggaggccttcagcaccacctggttcctgttctctgctgcccagaaccaccacctggtgttcttcctgctggaggtgttcaacaacatcatccagtaccagtttgatggcaacagcaacctggtgtatgccatcatcaggaagaggagcatcttccaccagctggccaacctgcccacagatcctcccaccatccacaaggccctgcagaggagaagaaggaccccagagcccctgagcaggacaggcagccaggagggcacctccatggagggcagcaggcctgctgccccagctgagcccggcaccctgaagaccagcctggtggccaccccaggcatcgacaagctgacagagaagagccaggtgtctgaagatggcaccctgcggagcctggagcctgagccccagcagagcctggaggatggcagccctgccaagggggagcccagccaggcctggagggagcagaggcggcccagcaccagcagcgccagcggccagtggagccccaccccagagtgggtgctgtcctggaagagcaagctgcccctgcagaccatcatgaggctgctgcaggtgctggtgccccaggtggagaagatctgcatcgacaagggcctgacagatgaaagtgagatcctgcgcttcctgcagcacggcaccctggtgggcctgctgcctgtgccccaccccatcctgatcaggaagtaccaggccaacagcggcacagccatgtggttccgcacctacatgtggggcgtcatctacctgagaaatgtggacccccctgtgtggtatgacacagatgtgaagctgtttgagatccagagggtgtag

SEQ ID NO: 147629 - DNA, 2367 bp, Artificial Sequence
  Description of Artificial Sequence: Synthetic coding sequence
atgggcagcacagacagcaagctgaacttcaggaaggctgtgatccagctgaccaccaagacccagcctgtggaggccacagatgatgccttctgggaccagttctgggccgacacagccacctctgtgcaggatgtgtttgccctggtgcctgctgctgagatccgggctgtgcgggaggagagccccagcaacctggccaccctgtgctacaaggctgtggagaagctggtgcagggcgctgagagcggctgccacagcgagaaggagaagcagatcgtgctgaactgcagccggctgctgaccagggtgctgccctacatctttgaggaccctgactggaggggcttcttctggagcacagtgcctggagctggccggggcggccagggcgaggaggatgatgaacatgcccggcccctggccgagagcctgctgctggccatcgctgacctgctcttctgcccagacttcaccgtgcagagccaccggcgcagcacagtggacagcgcagaagatgtgcacagcctggacagctgtgagtacatctgggaggccggcgtgggctttgcccacagcccccagcccaactacatccatgacatgaacaggatggagctgctgaagctgctgctgacctgcttcagcgaggccatgtacctgcccccagcccctgagagcggcagcaccaacccctgggtgcagttcttctgcagcacagaaaatagacatgccctgcccctcttcaccagcctgctgaacacagtgtgtgcctatgaccctgtgggctacggcatcccctacaaccacctgctcttcagtgactaccgggagcccctggtggaggaggccgcccaggtgctgattgtgaccctggaccatgacagcgccagcagcgccagccccaccgtggatggcaccaccactggaacagccatggatgatgctgaccccccaggccctgagaacctgtttgtgaactacctgagccgcatccaccgggaggaggacttccagttcatcctgaagggcatcgcccggctgctgagcaaccccctgctgcagacctacctgcccaacagcaccaagaagatccagttccaccaggagctgctggtgctcttctggaagctgtgtgacttcaacaagaagttcctgttctttgtgctgaagagcagtgatgtgctggacatcctggtgcccatcctcttcttcctgaatgatgcccgggctgaccagagccgggtgggcctgatgcacatcggggtcttcatcctgctgctgctgagcggggagaggaactttggagtgcggctgaacaagccctacagcatccgggtgcccatggacatccctgtgttcaccggcacccatgctgacctgctgattgtggtgttccacaagatcatcaccagcggccaccagaggctgcagcccctgtttgactgcctgctgaccatcgtggtgaatgtgagcccctacctgaagagcctgtccatggtgacagccaacaagctgctgcacctgctggaggccttcagcaccacctggttcctgttctctgctgcccagaaccaccacctggtgttcttcctgctggaggtgttcaacaacatcatccagtaccagtttgatggcaacagcaacctggtgtatgccatcatcaggaagaggagcatcttccaccagctggccaacctgcccacagatcctcccaccatccacaaggccctgcagaggagaagaaggaccccagagcccctgagcaggacaggcagccaggagggcacctccatggagggcagcaggcctgctgccccagctgagcccggcaccctgaagaccagcctggtggccaccccaggcatcgacaagctgacagagaagagccaggtgtctgaagatggcaccctgcggagcctggagcctgagccccagcagagcctggaggatggcagccctgccaagggggagcccagccaggcctggagggagcagaggcggcccagcaccagcagcgccagcggccagtggagccccaccccagagtgggtgctgtcctggaagagcaagctgcccctgcagaccatcatgaggctgctgcaggtgctggtgccccaggtggagaagatctgcatcgacaagggcctgacagatgaaagtgagatcctgcgcttcctgcagcacggcaccctggtgggcctgctgcctgtgccccaccccatcctgatcaggaagtaccaggccaacagcggcacagccatgtggttccgcacctacatgtggggcgtcatctacctgagaaatgtggacccccctgtgtggtatgacacagatgtgaagctgtttgagatccagagggtgtag

SEQ ID NO: 147630 - DNA, 810 bp, Artificial Sequence
  Description of Artificial Sequence: Synthetic coding sequence
atgagcagtgaccacctgaacaacagcaccctgaaggaggcccagttcaaggacctcttcctgaagaaggccgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccaggagggctgcctgtggcccagcgacagcgctgccccccggctgggcgccagcgagatcatgcacgcccccaggagccgggaccgcttcaccgcccccagcttcatccagagggaccgcttcagccgcttccagcccacctacccctacgtgcagcatgaaattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgacatcgccatgtacagcggcggcccctgcccccccagcagcaacagcggcatcagcgccagcacctgcagcagcaatggccgcatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147631 - DNA, 921 bp, Artificial Sequence
  Description of Artificial Sequence: Synthetic coding sequence
atgcctgaggccggcttccaggccaccaatgccttcacagagtgcaagttcacctgcaccagcggcaagtgcctgtacctgggcagcctggtgtgcaaccagcagaatgactgtggggacaacagtgatgaggagaactgcctgctggtgacagagcaccccccacctggcatcttcaacagcgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccaggagggctgcctgtggcccagcgacagcgctgccccccggctgggcgccagcgagatcatgcacgcccccaggagccgggaccgcttcaccgcccccagcttcatccagagggaccgcttcagccgcttccagcccacctacccctacgtgcagcacgagattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgatattgccatgtacagcggcggcccctgcccccccagcagcaacagcggcatcagcgccagcacctgcagcagcaatggaaggatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147632 - DNA, 747 bp, Artificial Sequence
  Description of Artificial Sequence: Synthetic coding sequence
atggctgctgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccaggagggctgcctgtggcccagcgacagcgctgccccccggctgggcgccagcgagatcatgcacgcccccaggagccgggaccgcttcaccgcccccagcttcatccagagggaccgcttcagccgcttccagcccacctacccctacgtgcagcacgagattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgatattgccatgtacagcggcggcccctgcccccccagcagcaacagcggcatcagcgccagcacctgcagcagcaatggaaggatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147633 - DNA, 756 bp, Artificial Sequence
  Description of Artificial Sequence: Synthetic coding sequence
atgagcagtgaccacctgaacaacagcaccctgaaggaggcccagttcaaggacctcttcctgaagaaggccgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccagatcatgcacgcccccaggagccgggaccgcttcaccgcccccagcttcatccagagggaccgcttcagccgcttccagcccacctacccctacgtgcagcatgaaattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgacatcgccatgtacagcggcggcccctgcccccccagcagcaacagcggcatcagcgccagcacctgcagcagcaatggccgcatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147634 - DNA, 867 bp, Artificial Sequence
  Description of Artificial Sequence: Synthetic coding sequence
atgcctgaggccggcttccaggccaccaatgccttcacagagtgcaagttcacctgcaccagcggcaagtgcctgtacctgggcagcctggtgtgcaaccagcagaatgactgtggggacaacagtgatgaggagaactgcctgctggtgacagagcaccccccacctggcatcttcaacagcgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccagatcatgcacgcccccaggagccgggaccgcttcaccgcccccagcttcatccagagggaccgcttcagccgcttccagcccacctacccctacgtgcagcacgagattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgatattgccatgtacagcggcggcccctgcccccccagcagcaacagcggcatcagcgccagcacctgcagcagcaatggaaggatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147635 - DNA, 693 bp, Artificial Sequence
  Description of Artificial Sequence: Synthetic coding sequence
atggctgctgagctggagtttgcccagatcatcatcatcgtggtggtggtgacagtgatggtggtggtgattgtgtgcctgctgaaccactacaaggtgtccaccaggagcttcatcaaccggcccaaccagagcagaagaagagaagatggcctgccccagatcatgcacgcccccaggagccgggaccgcttcaccgcccccagcttcatccagagggaccgcttcagccgcttccagcccacctacccctacgtgcagcacgagattgacctgccccccaccatcagcctgagtgatggagaggagcccccaccctaccagggcccctgcaccctgcagctgcgggaccctgagcagcagatggagctgaaccgggagagcgtgcgggccccacccaacagaaccatctttgacagcgacctgattgatattgccatgtacagcggcggcccctgcccccccagcagcaacagcggcatcagcgccagcacctgcagcagcaatggaaggatggagggccccccacccacctacagcgaggtgatgggccaccaccctggggccagcttcctgcaccaccagaggagcaatgcccaccggggcagccggctgcagttccagcagaacaatgctgagagcaccatcgtgcccatcaagggcaaggacaggaagccaggcaacctggtgtag

SEQ ID NO: 147636 - DNA, 1119 bp, Artificial Sequence
  Description of Artificial Sequence: Synthetic coding sequence
atggccaagagcaagaccaagcaccggctgtgcagccaggagagctctgtgtctgccctgctggccagctgcaccctgagcggcagcaacagcagcaacagtgatggcagcttccactacaaggacaagctgtacagaagtgccagccaggccctgcaggcctacattgatgactttgacctgggccagatctacccaggggccagcacaggcaagatcaacattgatgaggacttcaccaacatgagccagttctgcaactacatctacaagcccaacaatgcctttgagaacctggaccacaagaagcacagcaacttcatcagctgcagaagacacacagtgaatgacatcgacagcatgagcctgaccacagatgacctgctgcggctgcctgcagatggcagcttctcctacacctacgtgggccccagccacaggaccagcaagaagaacaagaagtgccggggccgcctgggcagcctggacatcgagaagaacccccacttccagggcccctacacctccatgggcaaggacaactttgtgacccctgtgatccgcagcaacatcaacgggaagcagtgtggggacaagattgagctgctgatcctgaaggccaagaggaacctggagcagtgcacagaggagctgcccaagtccatgaagaaggatgacagcccctgcagcctggacaagctggaggccgaccgctcctgggagaacatccctgtgaccttcaagagccctgtgcctgtgaacagtgatgacagcccccagcagaccagccgggccaagagcgccaagggcgtgctggaggacttcctgaacaatgacaaccagagctgcaccctgagcggcggcaagcaccacggccctgtggaggccctgaagcagatgctgttcaacctgcaggccgtgcaggagcgcttcaaccagaacaagaccacagaccccaaggaggagatcaagcaggtgtctgaagatgacttcagcaagctgcagctgaaggagagcatgatccccatcaccaggagcctgcagaaggccctgcaccacctgagccggctgcgggacctggtggatgacaccaatggagagaggagccccaagatgtag

SEQ ID NO: 147637 - DNA, 1602 bp, Artificial Sequence
  Description of Artificial Sequence: Synthetic coding sequence
atggccaagagcaagaccaagcaccggctgtgcagccaggagagctctgtgtctgccctgctggccagctgcaccctgagcggcagcaacagcagcaacagtgatggcagcttccactacaaggacaagctgtacagaagtgccagccaggccctgcaggcctacattgatgactttgacctgggccagatctacccaggggccagcacaggcaagatcaacattgatgaggacttcaccaacatgagccagttctgcaactacatctacaagcccaacaatgcctttgagaacctggaccacaagaagcacagcaacttcatcagctgcagaagacacacagtgaatgacatcgacagcatgagcctgaccacagatgacctgctgcggctgcctgcagatggcagcttctcctacacctacgtgggccccagccacaggaccagcaagaagaacaagaagtgccggggccgcctgggcagcctggacatcgagaagaacccccacttccagggcccctacacctccatgggcaaggacaactttgtgacccctgtgatccgcagcaacatcaacgggaagcagtgtggccgcctgaagaaccccaagctgatgaacagaaccaacaactgcatcagcgagagcagcctgtccttccccaagaagagcagcttcaaggacagcagcgagcacagcctggagaagaactacccccgctggctgaccagccagaagagtgacctgaatgtgtctggcatcaccagcatcccagacttcaagtaccctgtgtggctgcacaaccaggacctgctgcctgatgccaacagccagagggtgtaccagatcttcaaggatgaccagtgcagccccaggcacagccaccaggcccagggcaccagccgcctcatcaacaagctggactgctttgaatatgcctttgagcccagcaacttcagcaacagcctgagtgatgacaaggagctggtgaatgagtacaagtgtgactttgagcacagccagtgccagtgtgagaaccccctgctgcccggccagagcaccaagcccttcagcggggacaagattgagctgctgatcctgaaggccaagaggaacctggagcagtgcacagaggagctgcccaagtccatgaagaaggatgacagcccctgcagcctggacaagctggaggccgaccgctcctgggagaacatccctgtgaccttcaagagccctgtgcctgtgaacagtgatgacagcccccagcagaccagccgggccaagagcgccaagggcgtgctggaggacttcctgaacaatgacaaccagagctgcaccctgagcggcggcaagcaccacggccctgtggaggccctgaagcagatgctgttcaacctgcaggccgtgcaggagcgcttcaaccagaacaagaccacagaccccaaggaggagatcaagcaggtgtctgaagatgacttcagcaagctgcagctgaaggagagcatgatccccatcaccaggagcctgcagaaggccctgcaccacctgagccggctgcgggacctggtggatgacaccaacggggagaggagccccaagatgtag

SEQ ID NO: 147638 - DNA, 522 bp, Artificial Sequence
  Description of Artificial Sequence: Synthetic coding sequence
atggccgcccccagcggcggctggaatggagtgggcgccagcctgtgggccgccctgctgctgggcgctgtggccctgcggcctgctgaggccgtgtctgagcccaccaccgtggcctttgatgtgcggcctgggggcgtggtgcacagcttcagccacaacgtgggccctggggacaagtacacctgcatgttcacctacgccagccagggcggcaccaatgagcagtggcagatgagcctgggcaccagcgaggaccaccagcacttcacctgcaccatctggaggccccagggcaagagctacctgtacttcacccagttcaaggccgaggtgagaggagctgagattgaatatgccatggcctacagcaaggccgcctttgagcgggagagtgatgtgcccctgaagacagaggagtttgaggtgaccaagacagctgtggcccacaggcctggggccttcaaggccgagctgagcaagctggtgattgtggccaaggccagcaggacagagctgtag

SEQ ID NO: 147639 - DNA, 426 bp, Artificial Sequence
  Description of Artificial Sequence: Synthetic coding sequence
atgaccatcatggtggaggacatcatgaagctgctgtgcagcctgagcggggagaggaagatgaaggctgctgtgaagcacagcggcaagggggccctggtgactggagccatggcctttgtgggcggcctggtgggcggccccccaggcctggccgtgggcggcgctgtgggcggcctgctgggcgcctggatgaccagcggccagttcaagcctgtgccccagatcctgatggagctgcccccagctgagcagcagaggctcttcaatgaggccgccgccatcatccgccacctggagtggacagatgctgtgcagctgacagccctggtgatgggcagcgaggccctgcagcagcagctgctggccatgctggtgaactacgtgaccaaggagctgcgggcagagatccagtatgatgactag

SEQ ID NO: 147640 - DNA, 324 bp, Artificial Sequence
  Description of Artificial Sequence: Synthetic coding sequence
atgaccatcatggtggaggacatcatgaagctgctgtgcagcctgagcggggagaggaagatgaaggctgctgtgaagcacagcggcaagggggccctggtgactggagccatggcctttgtgggcggcctggtgggcggccccccaggcctggccgtgggcggcgctgtgggcggcctgctgggcgcctggatgaccagcggccagttcaagcctgtgccccagatcctgatggagctgcccccagctgagcagcagaggctcttcaatgaggccgccgccatcacccggccctgcagcagcagctgctggccctgctggtag

SEQ ID NO: 147641 - DNA, 459 bp, Artificial Sequence
  Description of Artificial Sequence: Synthetic coding sequence
atggagcggctgaagagccacaagccagccaccatgaccatcatggtggaggacatcatgaagctgctgtgcagcctgtctggagagaggaagatgaaggctgctgtgaagcacagcgggaaaggagccctggtgactggagccatggcctttgtgggcggcctggtgggcggccccccaggcctggccgtgggcggcgctgtgggcggcctgctgggcgcctggatgaccagcggccagttcaagcctgtgccccagatcctgatggagctgcccccagctgagcagcagaggctcttcaatgaagctgctgccatcatccgccacctggagtggacagatgctgtgcagctgacagccctggtgatgggcagcgaggccctgcagcagcagctgctggccatgctggtgaactacgtgaccaaggagctgcgggcagagatccagtatgatgactag

SEQ ID NO: 147642 - DNA, 648 bp, Artificial Sequence
  Description of Artificial Sequence: Synthetic coding sequence
atggagaagaaccccccagatgacaccggccctgtgcacgtgcccctgggccacatcgtggccaatgagaagtggaggggcagccagctggcccaggagatgcagggcaagatcaagctgatctttgaagatggcctgaccccagacttctacctgagcaaccgctgctgcatcctgtatgtgacagaggccgacctggtggccggaaatggctacaggaagaggctggtgcgggtgaggaacagcaacaacctgaagggcatcgtggtggtggagaagaccaggatgtctgagcagtacttccctgccctgcagaagttcaccgtgctggacctgggcatggtgctgctgcctgtggccagccagatggaggccagctgcctggtgatccagctggtgcaggagcagaccaaggagcccagcaagaaccccctgctgggcaagaagagggccctgctgctgtctgagcccagcctgctgaggacagtgcagcagatccctggggtgggcaaggtgaaggcccccctgctgctgcagaagttccccagcatccagcagctgagcaatgccagcatcggggagctggagcaggtggtgggccaggccgtggcccagcagatccacgccttcttcacccagcccaggtag

SEQ ID NO: 147643 - DNA, 648 bp, Artificial Sequence; identical to SEQ ID NO: 147642
  Description of Artificial Sequence: Synthetic coding sequence

SEQ ID NO: 147644 - DNA, 1227 bp, Artificial Sequence
  Description of Artificial Sequence: Synthetic coding sequence
atgtctgagcacgtggagcctgctgcccctggccctggccccaatggaggcggcggcggccctgccccagcccggggccccaggacccccaacctgaaccccaaccccctcatcaacgtgcgggacaggctcttccacgccctcttcttcaagatggctgtgacctacagccgcctcttccccccagccttcagaagactctttgagttctttgtgctgctgaaggccctgtttgtgctgtttgtgctggcctacatccacatcgtgttcagccgcagccccatcaactgcctggagcacgtgcgggacaagtggccccgggagggcatcctgcgggtggaggtgcgccacaacagcagccgggcccctgtgttcctgcagttctgtgacagcggcggccggggcagcttccctggcctggccgtggagcccggcagcaacctggacatggaggatgaggaggaggaggagctgaccatggagatgtttggaaacagcagcatcaagtttgagctggacatcgagcccaaggtgttcaagccacccagcagcacagaggccctgaatgacagccaggagttccccttccctgagacccccaccaaggtgtggccccaggatgagtacatcgtggagtacagcctggagtatggcttcctgcggctgagccaggccacccggcagaggctgagcatccctgtgatggtggtgaccctggaccccacccgggaccagtgctttggagaccgcttcagccggctgctgctggatgagttcctgggctatgatgacatcctgatgagctctgtgaagggcctggctgaaaatgaggagaacaagggcttcctgagaaatgtggtgtctggagagcactacagatttgtgtccatgtggatggcccggaccagctacctggccgcctttgccatcatggtgatcttcaccctgtctgtgtccatgctgctgcgctacagccaccaccagatctttgtgttcatcgtggacctgctgcagatgctggagatgaacatggccatcgccttccctgctgcccccctgctgaccgtcatcctggccctggtgggcatggaggccatcatgtctgagttcttcaatgacaccaccacagccttctacatcatcctgattgtgtggctggccgaccagtatgatgccatctgctgccacaccagcaccagcaagaggcactggctgcgcatcccctag

SEQ ID NO: 147645 - DNA, 1863 bp, Artificial Sequence
  Description of Artificial Sequence: Synthetic coding sequence
atgtctgagcacgtggagcctgctgcccctggccctggccccaatggaggcggcggcggccctgccccagcccggggccccaggacccccaacctgaaccccaaccccctcatcaacgtgcgggacaggctcttccacgccctcttcttcaagatggctgtgacctacagccgcctcttccccccagccttcagaagactctttgagttctttgtgctgctgaaggccctgtttgtgctgtttgtgctggcctacatccacatcgtgttcagccgcagccccatcaactgcctggagcacgtgcgggacaagtggccccgggagggcatcctgcgggtggaggtgcgccacaacagcagccgggcccctgtgttcctgcagttctgtgacagcggcggccggggcagcttccctggcctggccgtggagcccggcagcaacctggacatggaggatgaggaggaggaggagctgaccatggagatgtttggaaacagcagcatcaagtttgagctggacatcgagcccaaggtgttcaagccacccagcagcacagaggccctgaatgacagccaggagttccccttccctgagacccccaccaaggtgtggccccaggatgagtacatcgtggagtacagcctggagtatggcttcctgcggctgagccaggccacccggcagaggctgagcatccctgtgatggtggtgaccctggaccccacccgggaccagtgctttggagaccgcttcagccggctgctgctggatgagttcctgggctatgatgacatcctgatgagctctgtgaagggcctggctgaaaatgaggagaacaagggcttcctgagaaatgtggtgtctggagagcactacagatttgtgtccatgtggatggcccggaccagctacctggccgcctttgccatcatggtgatcttcaccctgtctgtgtccatgctgctgcgctacagccaccaccagatctttgtgttcatcgtggacctgctgcagatgctggagatgaacatggccatcgccttccctgctgcccccctgctgaccgtcatcctggccctggtgggcatggaggccatcatgtctgagttcttcaatgacaccaccacagccttctacatcatcctgattgtgtggctggccgaccagtatgatgccatctgctgccacaccagcaccagcaagaggcactggctgcgcttcttctacctgtaccactttgccttctacgcctaccactaccgcttcaacggccagtacagcagcctggccctggtgacctcctggctgttcatccagcacagcatgatctacttcttccaccactatgagctgcctgccatcctgcagcaggtgcgcatccaggagatgctgctgcaggccccacccctgggccctggcacccccacagccctgcctgatgacatgaacaacaacagcggggccccagccacagccccagattctgctggccagcccccagccctgggccctgtgtcccctggggccagcggcagccctggccctgtggccgccgcccccagcagcctggtggccgctgctgcctctgtggccgctgctgctggaggagacctgggctggatggccgagacagctgccatcatcacagatgccagcttcctgagcggcctgagcgccagcctgctggagcggcggcctgccagccccctgggccctgctgggggcctgccccacgccccccaggacagcgtgcccccaagtgacagcgctgccagtgacaccacccccctgggcgctgctgtgggcggccccagccctgcctccatggcccccacagaggcccccagcgaggtgggcagctag

SEQ ID NO: 147646 - DNA, 447 bp, Artificial Sequence
  Description of Artificial Sequence: Synthetic coding sequence
atggccgccagccctgcccggcctgctgtgctggccctgaccggcctggccctgctgctgctgctgtgctggggccctgggggcatcagcggcaacaagctgaagctgatgctgcagaagcgggaggcccctgtgcccaccaagaccaaggtggccgtggatgagaacaaggccaaggagttcctgggcagcctgaagaggcagaagaggcagctgtgggacaggaccaggcctgaggtgcagcagtggtaccagcagttcctgtacatgggctttgatgaggccaagtttgaagatgacatcacctactggctgaacagagacagaaatggccacgagtactatggagactactaccagaggcactatgatgaagattctgccatcggccccaggagcccctacggcttcagacatggagcctctgtgaactatgatgactactag

SEQ ID NO: 147647 - DNA, 2964 bp, Artificial Sequence
  Description of Artificial Sequence: Synthetic coding sequence
atgaccccagccctgcgggaggccacagccaagggcatctccttcagcagcctgcccagcaccatggagagtgacaagatgctgtacatggagagccccaggacagtggatgagaagctgaagggggacaccttcagccagatgctgggcttccccaccccagagcccaccctgaacaccaactttgtgaacctgaagcacttcggcagcccccagagcagcaagcactaccagacagtgttcctgatgaggagcaacagcaccctgaacaagcacaatgaaaactacaagcagaagaagctgggggagcccagctgcaacaagctgaagaacatcctgtacaacggcagcaacatccagctgagcaagatctgcctgagccacagcgaggagttcatcaagaaggagcccctgagtgacaccaccagccagtgcatgaaggatgtgcagatcatcctggacagcaacatcaccaaggacaccaacgtggacaaggtgcagctgcagaactgcaagtggtaccaggagaatgccctgctggacaaggtgacagatgctgagatcaagaagggcctgctgcactgcacccagaagaagatcgtgcccggccacagcaatgtgcctgtgagcagcagcgctgctgagaaggaggaggaggtgcacgcccggctgctgcactgtgtgtccaagcagaagatcctgctgagccaggcccggaggacccagaagcacctgcagatgctgctggccaagcacgtggtgaagcactacggccagcagatgaagctgtccatgaagcaccagctgcccaagatgaagaccttccacgagcccaccaccatcctgggcaacagcctgcccaagtgcacagagatcaagccagaggtgaacaccctgacagctgagaacaagctgtgggatgatgccaagaatggatttgcccgctgcacagctgctgagatccagagatttgccttcagcgccaccggcctgctgagccacgtggaggagggcctggacagtgatgccacagacagcagcagtgatgatgacctggatgagtacaccctgaggaagaatgtggccgtgaactgcagcacagagtggaagtggctggtggaccgggcccgggtgggcagccgctggacctggctgcaggcccagatcagtgacctggagtgcaagatccagcagctgacagacatccaccggcagatccgggccagcaagggcatcgtggtgctggaggagtgccagctgcccaaggacatcctgaagaagcagatgcagtttgctgaccaggccgccagcctgaacatcctgggcaacccccaggtgccccaggagtgccaggaccctgtgcctgagcaggactttgagatgagccccagcagccccaccctgctgctgagaaatattgagaagcagagcgcccagctgacagagatcatcaacagcctcatcgcccccctgaacctgagccccaccagcagccccctgagcagcaagagctgcagccacaagtgcctggccaacggcatctacagaagtgccagcgagaacctggatgagctgagcagcagcagctcctggctgctgaaccagaagcacagcaagaagaagaggaaggacaggacccggctgaagagcagcagcctgaccttcatgagcaccagcgcccggacccggcccctgcagagcttccacaagaggaagctgtaccgcctgagccccaccttctactggaccccccagaccctgcccagcaaggagacagccttcctgaacaccacccagatgccctgcctgcagagcgccagcacctggagcagctatgagcacaacagcgagagctacctgctgcgggagcacgtgtctgagctggacagcagcttccacagcgtgctgagcctgcccagtgatgtgcccctgcacttccactttgagaccctgctgaagaagacagagatcaagggcaacctggccgagaacaagtttgtggatgagtacatcatcagccccagccctgtgcacagcaccctgaaccagtggagaaatggctacagccccatctgcaagccccagatccgctctgagagcagcgcccagctgctgcagggcaggaagaagaggcacctgtctgaaacagccctgggggagaggaccaagctggaggagagtgacttccagcacacagagagcggcagccacagcaacttcaccgctgtgtccaatgtgaatgtgctgagccgcatccagaacagcagcaggaacacagcccggcggcggctgcggtctgagagcagctatgacatcgacaacatcgtcatccccatgagcctggtggccccagccaagctggagaagctgcagtacaaggagatcctgacccccagctggaggatggtggtgctgcagcccctggatgagtacaacctgggcaaggaggagattgaggacctgagtgatgaggtgttcagcctgcggcacaagaagtatgaggagcgggagcaggcccgctggagcctgtgggagcagagcaagtggcacagaagaaacagccgggcctacagcaagaatgtggagggccaggacctgctgctgaaggagtaccccaacaacttcagcagcagccagcagtgtgccgccgccagccccccaggcctgcccagcgagaaccaggacctgtgtgcctacggcctgcccagcctgaaccagagccaggagaccaagagcctgtggtgggagcggcgggccttccccctgaagggggaggacatggccgccctgctgtgccaggatgagaagaaggaccaggtggagaggagcagcacagccttccacggggagatcttcggcacctctgtgcctgaaaatggccaccaccccaagaagcagagtgatggcatggaggagtacaagaccttcggcctgggcctgaccaacgtgaagaagaacagatag

SEQ ID NO: 147648 - DNA, 687 bp, Artificial Sequence
  Description of Artificial Sequence: Synthetic coding sequence
atgtcctatgcagagaagccagatgagatcaccaaggatgagtggatggagaagctgaacaacctgcacgtgcagagagctgacatgaacagactcatcatgaactacctggtgacagagggcttcaaggaggccgctgagaagttcaggatggagagcggcatcgagcccagcgtggacctggagaccctggatgagcgcatcaagatccgggagatgatcctgaagggccagatccaggaggccatcgccctgatcaacagcctgcaccctgagctgctggacaccaaccgctacctgtacttccacctgcagcagcagcacctgattgagctgatccggcagcgggagacagaggccgccctggagtttgcccagacccagctggccgagcagggcgaggagagccgggagtgcctgacagagatggagaggaccctggccctgctggcctttgacagccctgaggagagcccctttggagacctgctgcacaccatgcagaggcagaaggtgtggagcgaggtgaaccaggccgtgctggactatgagaaccgggagagcacccccaagctggccaagctgctgaagctgctgctgtgggcccagaatgagctggaccagaagaaggtgaagtaccccaagatgacagacctgagcaaaggagtcatcgaggagcccaagtag

SEQ ID NO: 147649 - DNA, 468 bp, Artificial Sequence
  Description of Artificial Sequence: Synthetic coding sequence
atgtcctatgcagagaagccagatgagatcaccaaggatgagtggatggagaagctgaacaacctgcacgtgcagagagctgacatgaacagactcatcatgaactacctggtgacagagggcttcaaggaggccgctgagaagttcaggatggagagcggcatcgagcccagcgtggacctggagaccctggatgagcgcatcaagatccgggagatgatcctgaagggccagatccagcaggtggtgcatgactgctggaggaaggagagggtcttcatcctgagtgacctgcccagcagcatctctgctgccagccacccccccagcagcgctggcagcgcagatgtgctgctgctcttcacccacaggacagtgccctgcagcgtggtgggcagaagagaggtggtgcagggctgtgtgcactgcctgcgggtgggcaccgtggatggccacatggccctgtag

SEQ ID NO: 147650 - DNA, 3534 bp, Artificial Sequence
  Description of Artificial Sequence: Synthetic coding sequence
atggatgtgtacccaccccggcggcagggcctgccccgggcccggagccctgggggcagcagccggggcagccccagcgtgtcctgcagccggctgcggcaggtgcagagcatcctgacccagagcagcaagagcaggccagatggcatcctgtgcatcctgggcatcgacagccgctacaatgaaggctgccgggagctggccaactacctgctgtttggcctgtacaaccagaacaccagtgactttgagaagacaggcttcagcgaggaggtgctggatgatgtgatcatcctgatcaagagtgacagcgtgcacctgtactgcaaccctgtgaacttccgctacctgctgccctacgtggcccactggaggaacctgcacttccactgcatgacagaaaatgaatatgaagatgaggaggccgctgaggagttcaagatcaccagctttgtggacatggtgcgggactgcagcagaattggcatcccctacagcagccagggccacctgcagatctttgacatgtttgtggtggagaagtggcccatcgtgcaggcctttgccctggagggcattggaggagatggcttcttcaccatgaagtatgagctgcaggatgtgtccctgaacctgtggaatgtgtacagcaagatggaccccatgagcctggagagcctgctgagtgatgacctggtggcctttgagcaccagtggaccagcttctttgccaactttgacacagagatccccttcctgctggagctgtctgagagccaggccggggagcccttccgcagctacttcagccacggcatgatcagcagccacatcacagagaacagccccaaccggcagccctttgtgctgtttggaaaccacagcacccgggagaacctgaatgccggcaacttcaacttccccagcgagggccacctggtgcgcagcactggacctgggggcagctttgccaagcacatggtggcccagtgtgtgagccccaagggccccctggcctgcagcaggacctacttcttcggggccacccacgtgccctacctgggcggggacagcaagctgcccaagaagacagagcagatccggctgctgagccagatctatgctgctgtgattgaggccgtgctggccggcatcgcctgctacgccaagaccagcagcctgaccaaggccaaggaggtggccgagcagaccctgggcagcggcctggacagctttgagctgatccccttcaaggccgccctgcggagcaagatgaccttccacatccatgctgtgaacaaccagggccgcatcgtgcccctggacagcgaggacagcctgagctttgtgaagacagcctgcatggctgtgtatgacatcccagacctgctgggcggcaatggctgcctgggctctgtggtgttcagcgagagcttcctgaccagccagatcctggtgaaggagaaggatggcaccgtgaccacagagaccagctctgtggtgctgacagctgctgtgccccgcttctgctcctggctggtggaggacaatgaggtgaagctgtctgagaagacccagcaggccgtgagaggagatgagagcttcctgggcacctacctgactggaggagagggcgcctacctgtacagcagcaacctgcagagctggccagaggagggcaatgtgcacttcttcagcagcggcctgctcttcagccactgccgccacaggagcatcatcatcagcaaggaccacatgaacagcatctccttctatgatggagacagcaccagcacagtggccgccctgctgattgacttcaagagcagcctgctgccccacctgcctgtgcacttccacggcagcagcaacttcctgatgattgccctcttccccaagagcaagatctaccaggccttctacagcgaggtgttcagcctgtggaagcagcaggacaacagcggcatcagcctgaaggtgatccaggaggatggcctgtctgtggagcagaagaggctgcacagcagcgcccagaagctgttcagcgccctgagccagcctgctggggagaagaggagcagcctgaagctgctgagcgccaagctgcctgagctggactggttcctgcagcactttgccatcagcagcatcagccaggagcctgtgatgaggacccacctgcctgtgctgctgcagcaggccgagatcaacaccacccaccgcatcgagagtgacaaggtgatcatcagcatcgtgacaggcctgcccggctgccacgccagcgagctgtgtgccttcctggtgaccctgcacaaggaatgtggccgctggatggtgtaccggcagatcatggacagcagcgagtgcttccacgccgcccacttccagcgctacctgagcagcgccctggaggcccagcagaacagaagtgcccggcagagcgcctacatcaggaagaagacccggctgctggtggtgctgcagggctacacagatgtgattgatgtggtgcaggccctgcagacccacccagacagcaatgtgaaggccagcttcaccatcggggccatcacagcctgtgtggagcccatgagctgctacatggagcaccgcttcctgttccccaagtgcctggaccagtgcagccagggcctggtgtccaatgtggtgttcaccagccacaccacagagcagaggcaccccctgctggtgcagctgcagagcctcatccgggccgccaacccagctgctgccttcatcctggctgaaaatggcatcgtgaccagaaatgaagatattgagctgatcctgtctgaaaattccttcagcagccctgagatgctgcggagccgctacctgatgtacccaggctggtatgagggcaagctgaatgccggctctgtgtaccccctgatggtgcagatctgtgtgtggtttggccggcccctggagaagaccaggtttgtggccaagtgcaaggccatccagagcagcatcaagcccagccccttcagcggcaacatctaccacatcctgggcaaggtgaagttcagtgacagcgagaggaccatggaggtgtgctacaacaccctggccaacagcctgagcatcatgcctgtgctggagggccccaccccacctccagacagcaagtctgtgtcccaggacagcagcggccagcaggagtgctacctggtgttcatcggctgcagcctgaaggaggacagcatcaaggactggctgcggcagagcgccaagcagaagccccagaggaaggccctgaagacccggggcatgctgacccagcaggagatccgcagcatccacgtgaagaggcacctggagcccctgcctgctggctacttctacaacggcacccagtttgtgaacttcttcggggacaagacagacttccaccccctgatggaccagttcatgaatgactatgtggaggaggccaaccgggagattgagaagtacaaccaggagctggagcagcaggagtaccatgacctgtttgagctgaagccctag

SEQ ID NO: 147651 - DNA, 1488 bp, Artificial Sequence
  Description of Artificial Sequence: Synthetic coding sequence
atggagggctgcctgggccaggagctgttcagcaaccacatgttcctgaccagcctgagcagccccaaccggcagccctttgtgctgtttggaaaccacagcacccgggagaacctgaatgccggcaacttcaacttccccagcgagggccacctggtgcgcagcacaggccctgggggcagctttgccaagcacatggtggcccagtgtgtgagccccaagggccccctggcctgcagcaggacctacttctttggagccacccacgtgccctacctgggcggggacagcaagctgcccaagaagacagagcagatgctgctgagccagatctatgctgctgtgattgaggccgtgctggccggcatcgcctgctacgccaagaccagcagcctgaccaaggccaaggaggtggccgagcagaccctgggcagcggcctggacagctttgagctgatccccttcaaggccgccctgcggagcaagatgaccttccacatccatgctgtgaacaaccagggccgcatcgtgcccctggacagcgaggacagcctgagctttgtgaagacagcctgcatggctgtgtatgacatcccagacctgctgggcggcaatggctgcctgggctctgtggtgttcagcgagagcttcctgaccagccagatcctggtgaaggagaaggatggcaccgtgaccacagagaccagctctgtggtgctgacagctgctgtgccccgcttctgctcctggctggtggaggacaatgaggtgaagctgtctgagaagacccagcaggccgtgagaggagatgagagcttcctgggcacctacctgactggaggagagggcgcctacctgtacagcagcaacctgcagagctggccagaggagggcaatgtgcacttcttcagcagcggcctgctcttcagccactgccgccacaggagcatcatcatcagcaaggaccacatgaacagcatctccttctatgatggagacagcaccagcacagtggccgccctgctgattgacttcaagagcagcctgctgccccacctgcctgtgcacttccacggcagcagcaacttcctgatgattgccctcttccccaagagcaagatctaccaggccttctacagcgaggtgttcagcctgtggaagcagcaggacaacagcggcatcagcctgaaggtgatccaggaggatggcctgtctgtggagcagaagaggctgcacagcagcgcccagaagctgttcagcgccctgagccagcctgctggggagaagaggagcagcctgaagctgctgagcgccaagctgcctgagctggactggttcctgcagcactttgccatcagcagcatcagccaggagcctgtgatgaggacccacctgcctgtgctgctgcagcaggccgagatcaacaccacccaccgcatcgagagtgacaagatggatggagtgagccccaaccacggccagctgtag

SEQ ID NO: 147652 - DNA, 615 bp, Artificial Sequence
  Description of Artificial Sequence: Synthetic coding sequence
atgggagaggccgaggtgggcggcggcggggccgccggggacaagggccctggagaggccgccaccagccctgctgaggagaccgtggtgtggagccctgaggtggaggtgtgcctcttccacgccatgctgggccacaagcctgtgggcgtgaacagacacttccacatgatctgcatccgggacaagttcagccagaacatcggccggcaggtgcccagcaaggtgatctgggaccacctgagcaccatgtatgacatgcaggccctgcatgaaagtgagatcctgcccttccccaaccctgagaggaactttgtgctgcctgaggagatcatccaggaggtgcgggagggcaaggtgatgattgaggaggagatgaaggaggagatgaaggaggatgtggacccccacaacggggctgatgatgtgttcagcagcagcggcagcctgggcaaggccagcgagaagagcagcaaggacaaggagaagaacagcagtgacctgggctgcaaggagggcgctgacaagaggaagaggagccgggtgacagacaaggtgctgacagccaacagcaaccccagcagccccagcgctgccaagagaagaagaacatag

SEQ ID NO: 147653 - DNA, 1278 bp, Artificial Sequence
  Description of Artificial Sequence: Synthetic coding sequence
atgtaccccagcaacaagaagaagaaggtgtggagggaggagaaggagcggctgctgaagatgaccctggaggagaggaggaaggagtacctgcgggactacatccccctgaacagcatcctgtcctggaaggaggagatgaagggcaagggccagaatgatgaggagaacacccaggagaccagccaggtgaagaagagcctgacagagaaggtgtccctgtacagaggagacatcaccctgctggaggtggatgccatcgtgaatgctgccaatgccagcctgctgggcggcggcggcgtggatggctgcatccacagagctgctggcccctgcctgctggccgagtgcaggaacctgaatggctgtgacaccggccacgccaagatcacctgtggctatgacctgcctgccaagtatgtgatccacacagtgggccccatcgcccggggccacatcaatggcagccacaaggaggacctggccaactgctacaagagcagcctgaagctggtgaaggagaacaacatccgctctgtggccttcccctgcatcagcacaggcatctacggcttccccaatgaacctgctgctgtgattgccctgaacaccatcaaggagtggctggccaagaaccaccacgaggtggaccgcatcatcttctgtgtgttcctggaggtggacttcaagatctacaagaagaagatgaatgagttcttctctgtggatgacaacaatgaggaggaggaggatgtggagatgaaggaggacagtgatgaaaatggacctgaggagaagcagagcgtggaggagatggaggagcagagccaggatgctgatggagtgaacacagtgacagtgcccggccctgccagcgaggaggccgtggaggactgcaaggatgaggactttgccaaggatgagaacatcaccaagggcggggaggtgacagaccacagcgtgcgggaccaggaccacccagatggccaggagaatgacagcaccaagaatgagatcaagattgaaacagagagccagagcagctacatggagacagaggagctgagcagcaaccaggaggatgctgtgattgtggagcagcctgaggtgatccccctgacagaggaccaggaggagaaggagggggagaaggcccctggagaggacacccccaggatgcctgggaagtctgagggcagcagtgacctggagaacaccccaggcccagatgctggggcccaggatgaggccaaggagcagagaaatggcaccaagtag

SEQ ID NO: 147654 - DNA, 1248 bp, Artificial Sequence
  Description of Artificial Sequence: Synthetic coding sequence
atggccttcctgatgcacctgctggtgtgtgtgtttggcatgggctcctgggtgaccatcaatggcctgtgggtggagctgcccctgctggtgatggagctgcctgagggctggtacctgcccagctacctgactgtggtgatccagctggccaacatcggccccctgctggtgaccctgctgcaccacttccggcccagctgcctgtctgaggtgcccatcatcttcaccctgctgggcgtgggcaccgtgacctgcatcatctttgccttcctgtggaacatgacctcctgggtgctggatggccaccacagcatcgccttcctggtgctgaccttcttcctggccctggtggactgcaccagctctgtgaccttcctgcccttcatgagccggctgcccacctactacctgaccaccttctttgtgggggagggcctgagcggcctgctgcctgccctggtggccctggcccagggcagcggcctgaccacctgtgtgaatgtgacagagatcagtgacagcgtgcccagccctgtgcccacccgggagacagacatcgcccagggcgtgccccgggccctggtgtctgccctgcccggcatggaggcccccctgagccacctggagagccgctacctgcctgcccacttcagccccctggtgttcttcctgctgctgagcatcatgatggcctgctgcctggtggccttctttgtgctgcagaggcagccccgctgctgggaggcctctgtggaggacctgctgaatgaccaggtgaccctgcacagcatccggccccgggaggagaatgacctgggccctgctggcaccgtggacagcagccagggccagggctacctggaggagaaggccgccccctgctgcccagcccacctggccttcatctacaccctggtggcctttgtgaatgccctgaccaacggcatgctgcccagcgtgcagacctacagctgcctgtcctatggccctgtggcctaccacctggccgccaccctgagcatcgtggccaaccccctggccagcctggtgtccatgttcctgcccaacagaagcctgctcttcctgggcgtgctgtctgtgctgggcacctgctttggaggctacaacatggccatggctgtgatgagcccctgccccctgctgcagggccactggggcggggaggtgctgattgtgtccatccggcctgtgggcctgctgcccctgcggaccccccacccctag

SEQ ID NO: 147655 - DNA, 1038 bp, Artificial Sequence
  Description of Artificial Sequence: Synthetic coding sequence
atgctgcggcctgctggcctgtggaggctgtgccggcggccctgggccgcccgggtgcctgctgagaacctgggccggcgggaggtgaccagcggcgtgagcccccggggcagcaccagccccaggaccctgaacatctttgaccgggacctgaagaggaagcagaagaactgggccgcccggcagcctgagcccaccaagtttgactacctgaaggaggaggtgggcagcagaattgctgacagagtgtatgacatccccaggaacttccccctggccctggacctgggctgcggccggggctacatcgcccagtacctgaacaaggagaccatcggcaagttcttccaggccgacattgctgaaaatgccctgaagaacagcagcgagacagagatccccaccgtgtctgtgctggctgatgaggagttcctgcccttcaaggagaacacctttgacctggtggtgagcagcctgagcctgcactgggtgaatgacctgccccgggccctggagcagatccactacatcctgaagccagatggagtcttcatcggggccatgtttggaggagacaccctgtatgagctgcgctgcagcctgcagctggccgagacagagcgggagggcggcttcagcccccacatcagccccttcaccgctgtgaatgacctgggccacctgctgggccgggccggcttcaacaccctgactgtggacacagatgagatccaggtgaactacccaggcatgtttgagctgatggaggacctgcagggcatgggagagagcaactgtgcctggaacaggaaggccctgctgcaccgggacaccatgctggccgctgctgctgtgtaccgggagatgtacagaaatgaagatggctctgtgcctgccacctaccagatctactacatgattggctggaagtaccacgagagccaggcccggcctgctgagcggggcagcgccaccgtgtcctttggagagctgggcaagatcaacaacctgatgcctcctgggaagaagagccagtag

SEQ ID NO: 147656 - DNA, 954 bp, Artificial Sequence
  Description of Artificial Sequence: Synthetic coding sequence
atgctgcggcctgctggcctgtggaggctgtgccggcggccctgggccgcccgggtgcctgctgagaacctgggccggcgggaggtgaccagcggcgtgagcccccggggcagcaccagccccaggaccctgaacatctttgaccgggacctgaagaggaagcagaagaactgggccgcccggcagcctgagcccaccaagtttgactacctgaaggaggaggtgggcagcagaattgctgacagagtgtatgacatccccaggaacttccccctggccctggacctgggctgcggccggggctacatcgcccagtacctgaacaagctgcagctgttccactgcaggaagctgctggagagcttcagcaagctgaccctgcagaagatgctgtgcctgcactgggtgaatgacctgccccgggccctggagcagatccactacatcctgaagccagatggagtcttcatcggggccatgtttggaggagacaccctgtatgagctgcgctgcagcctgcagctggccgagacagagcgggagggcggcttcagcccccacatcagccccttcaccgctgtgaatgacctgggccacctgctgggccgggccggcttcaacaccctgactgtggacacagatgagatccaggtgaactacccaggcatgtttgagctgatggaggacctgcagggcatgggagagagcaactgtgcctggaacaggaaggccctgctgcaccgggacaccatgctggccgctgctgctgtgtaccgggagatgtacagaaatgaagatggctctgtgcctgccacctaccagatctactacatgattggctggaagtaccacgagagccaggcccggcctgctgagcggggcagcgccaccgtgtcctttggagagctgggcaagatcaacaacctgatgcctcctgggaagaagagccagtag

SEQ ID NO: 147657 - DNA, 804 bp, Artificial Sequence
  Description of Artificial Sequence: Synthetic coding sequence
atgctgcggcctgctggcctgtggaggctgtgccggcggccctgggccgcccgggtgcctgctgagaacctgggccggcgggaggtgaccagcggcgtgagcccccggggcagcaccagccccaggaccctgaacatctttgaccgggacctgaagaggaagcagaagaactgggccgcccggcagcctgagcccaccaagtttgactacctgaaggaggaggtgggcagcagaattgctgacagagtgtatgacatccccaggaacttccccctggccctggacctgggctgcggccggggctacatcgcccagtacctgaacaaggagaccatcggcaagttcttccaggccgacattgctgaaaatgccctgaagaacagcagcgagacagagatccccaccgtgtctgtgctggctgatgaggagttcctgcccttcaaggagaacacctttgacctggtggtgagcagcctgagcctgcactgggtgaatgacctgccccgggccctggagcagatccactacatcctgaagccagatggagtcttcatcggggccatgtttggaggagacaccctgtatgagctgcgctgcagcctgcagctggccgagacagagcgggagggcggcttcagcccccacatcagccccttcaccgctgtgaatgacctgggccacctgctgggccgggccggcttcaacaccctgactgtggacacagatgagatccaggtgaactacccaggcatgtttgagctgatggaggacctgcaggagcagaagagcaggatgctgacctag

SEQ ID NO: 147658 - DNA, 771 bp, Artificial Sequence
  Description of Artificial Sequence: Synthetic coding sequence
atgaagctgaccaggaagatggtgctgacccgggccaaggccagcgagctgcacagcgtgaggaagctgaactgctggggcagccggctgacagacatcagcatctgccaggagatgcccagcctggaggtgatcaccctgtctgtgaacagcatcagcaccctggagcctgtgagccgctgccagaggctgtctgagctgtacctgcggaggaaccgcatccccagcctggccgagctgttctacctgaagggcctgccccggctgcgggtgctgtggctggccgagaacccctgctgcggcaccagcccccaccgctacaggatgacagtgctgcggaccctgccccggctgcagaagctggacaaccaggccgtgacagaggaggagctgagccgggccctgtctgagggggaggagatcacagctgcccctgagcgggagggcaccggccacggcggccccaagctgtgctgcaccctgagcagcctgagcagcgctgctgagaccggccgggaccccctggacagcgaggaggaggccaccagcggggcccaggatgagcggggcctgaagccacccagccggggccagttccccagcctgagcgccagagatgccagcagcagccaccggggcagaaatgtgctgacagccatcctgctgctgctgcgggagctggatgctgagggcctggaggccgtgcagcagacagtgggcagccggctgcaggccctgcggggggaggaggtgcaggagcacgccgagtag

SEQ ID NO: 147659 - DNA, 654 bp, Artificial Sequence
  Description of Artificial Sequence: Synthetic coding sequence
gtcacccagggcccccagggcctgcgggccagcggccgcagctgtgtgggccccttcctgagccacctgggccgggacaggaccccaggagtgctgacagagctgcgctgtgtggtgcctgcccggctgacagccctggagaggagcaggaagccccggggccggggccggggccgctacatcaccctgctgcctgtgcctgaggccgaccccatcctggagcgggtgccccagcctgagttctgcagctgtgtgaacagcatcagcaccctggagcctgtgagccgctgccagaggctgtctgagctgtacctgcggaggaaccgcatccccagcctggccgagctgttctacctgaagggcctgccccggctgcgggtgctgtggctggccgagaacccctgctgcggcaccagcccccaccgctacaggatgacagtgctgcggaccctgccccggctgcagaagctggacaaccaggccgtgacagaggaggagctgagccgggccctgtctgagggggaggagatcacagctgcccctgagcgggagggcaccggccacggcggccccaagctgtgctgcaccctgagcagcctgagcagcgctgctgagaccggccgggaccccctggacagcgaggaggaggcctag

SEQ ID NO: 147660 - DNA, 1128 bp, Artificial Sequence
  Description of Artificial Sequence: Synthetic coding sequence
atgaagctgaccaggaagatggtgctgacccgggccaaggccagcgagctgcacagcgtgaggaagctgaactgctggggcagccggctgacagacatcagcatctgccaggagatgcccagcctggaggtgatcaccctgtctgtgaacagcatcagcaccctggagcctgtgagccgctgccagaggctgtctgagctgtacctgcggaggaaccgcatccccagcctggccgagctgttctacctgaagggcctgccccggctgcgggtgctgtggctggccgagaacccctgctgcggcaccagcccccaccgctacaggatgacagtgctgcggaccctgccccggctgcagaagctggacaaccaggccgtgacagaggaggagctgagccgggccctgtctgagggggaggagatcacagctgcccctgagcgggagggcaccggccacggcggccccaagctgtgctgcaccctgagcagcctgagcagcgctgctgagaccggccgggaccccctggacagcgaggaggaggccaccggggcccaggatgagcggggcctgaagccacccagccggggccagttccccagcctgagcgccagagatgccagcagcagccaccggggccgggtgtctgggggccccctgggcgctgctgctgccagcgcccactgcacccactgcacagagaccgtgggccgggagcacggggccagccagggccctgtgggccgggagcacggggccagccagggcctggaggagctgtgcccccggggcagctgtgtgtgtggctctgtgaatgcccacaccagggtgacccgggcccctcatggagctgtgctggccccccagcccctgctgctgtcctggagcgtggagtgtggccctggcccctgctgggccgagggcaacagaagccacgtggaggaggtgccccacacccggccccaggccggcctgctgtgcagcgacagccccagcgtgcccaacgtgctgacagccatcctgctgctgctgcgggagctggatgctgagggcctggaggccgtgcagcagacagtgggcagccggctgcaggccctgcggggggaggaggtgcaggagcacgccgagtag

SEQ ID NO: 147661 - DNA, 807 bp, Artificial Sequence
  Description of Artificial Sequence: Synthetic coding sequence
atggctgctgtgcgggtgctggtggccagccggctggccgccgccagcgccttcaccagcctgagccctgggggccgcacccccagccagagagctgccctgcacctgtctgtgcccaggcctgctgcccgggtggccctggtgctgagcggctgcggcgtgtatgatggaacagagatccacgaggccagcgccatcctggtgcacctgagcagaggaggagctgaggtgcagatctttgccccagatgtgccccagatgcacgtgattgaccacaccaagggccagcccagcgagggggagagcagaaatgtgctgacagaaagtgcccgcatcgcccggggcaagatcacagacctggccaacctgtctgctgccaaccatgatgctgccatcttccctgggggctttggagctgccaagaacctgagcacctttgctgtggatggcaaggactgcaaggtgaacaaggaggtggagcgggtgctgaaggagttccaccaggccggcaagcccatcggcctgtgctgcatcgcccctgtgctggccgccaaggtgctgcggggcgtggaggtgacagtgggccacgagcaggaggagggcggcaagtggccctatgccggcacagctgaggccatcaaggccctgggcgccaagcactgtgtgaaggaggtggtggaggcccacgtggaccagaagaacaaggtggtgaccaccccagccttcatgtgtgaaacagccctgcactacatccatgatggcattggagccatggtgaggaaggtgctggagctgaccgggaagtag

SEQ ID NO: 147662 - DNA, 714 bp, Artificial Sequence
  Description of Artificial Sequence: Synthetic coding sequence
atggctgctgtgcgggtgctggtggccagccggctggccgccgccagcgccttcaccagcctgagccctgggggccgcacccccagccagagagctgccctgcacctgtctgtgcccaggcctgctgcccgggtggccctggtgctgagcggctgcggcgtgtatgatggaacagagatccacgaggccagcgccatcctggtgcacctgagcagaggaggagctgaggtgcagatctttgccccagatgtgccccagatgcacgtgattgaccacaccaagggccagcccagcgagggggagagcagaaatgtgctgacagaaagtgcccgcatcgcccggggcaagatcacagacctggccaacctgtctgctgccaaccatgatgctgccatcttccctgggggctttggagctgccaagaacctgctgtgctgcatcgcccctgtgctggccgccaaggtgctgcggggcgtggaggtgacagtgggccacgagcaggaggagggcggcaagtggccctatgccggcacagctgaggccatcaaggccctgggcgccaagcactgtgtgaaggaggtggtggaggcccacgtggaccagaagaacaaggtggtgaccaccccagccttcatgtgtgaaacagccctgcactacatccatgatggcatcggggccatggtgaggaaggtgctggagctgaccgggaagtag

SEQ ID NO: 147663 - DNA, 1023 bp, Artificial Sequence
  Description of Artificial Sequence: Synthetic coding sequence
atggccgagggcggggagctgatgagccggctgctgtctgaaaatgctgacctgaagaagcaggtgcggctgctgaaggagaaccagatgctgcggcggctgctgagccagagctgccaggagggcggcggccatgacctgctgcccccccgggcccacgcctacccagaggccggcagccctggcagcggcgtgcctgactttggccgcttcacctctgtggccgacacccccagccagctgcagaccagcagcctggaggacctgctgtgcagccacgcccccctgagcagtgaagatgacaccagccctggctgtgccgcccccagccaggcccccttcaaggccttcctgagccccccagagccccacagccaccggggcacagacaggaagctgagccccctgctgagccccctgcaggacagcctggtggacaagaccctgctggagccccgggagatggtgcggcccaagaaggtgtgcttcagcgagagcagcctgcccaccggggacaggaccaggaggagctactacctgaatgagatccagagctttgctggagctgagaaggatgcccgggtggtgggggagatcgccttccagctggaccggcgcatcctggcctacgtgtttcctggggtgacccggctgtatggcttcaccgtggccaacatccctgagaagattgagcagaccagcaccaagagcctggatggctctgtggatgagaggaagctgcgggagctgacccagcgctacctggccctgagcgcccggctggagaagctgggctacagcagagatgtgcacccagccttcagcgagttcctgatcaacacctacggcatcctgaagcagaggccagacctgcgggccaaccccctgcacagcagccctgctgccctgaggaagctggtgattgatgtggtgccccccaagttcctgggggacagcctgctgctgctgaactgcctgtgtgagctgagcaaggaggatggcaagcccctgtttgcctggtag

SEQ ID NO: 147664 - DNA, 561 bp, Artificial Sequence
  Description of Artificial Sequence: Synthetic coding sequence
atggtgcggcccaagaaggtgtgcttcagcgagagcagcctgcccaccggggacaggaccaggaggagctactacctgaatgagatccagagctttgctggagctgagaaggatgcccgggtggtgggggagatcgccttccagctggaccggcgcatcctggcctacgtgtttcctggggtgacccggctgtatggcttcaccgtggccaacatccctgagaagattgagcagaccagcaccaagagcctggatggctctgtggatgagaggaagctgcgggagctgacccagcgctacctggccctgagcgcccggctggagaagctgggctacagcagagatgtgcacccagccttcagcgagttcctgatcaacacctacggcatcctgaagcagaggccagacctgcgggccaaccccctgcacagcagccctgctgccctgaggaagctggtgattgatgtggtgccccccaagttcctgggggacagcctgctgctgctgaactgcctgtgtgagctgagcaaggaggatggcaagcccctgtttgcctggtag

SEQ ID NO: 147665 - DNA, 438 bp, Artificial Sequence
  Description of Artificial Sequence: Synthetic coding sequence
atggtgcagctgattgcccccctggaggtgatgtggaatgaagctgctgacctgaagcccctggccctgagccggcggctggagtgcagcggcggcatcatggcccactacagcccagacctgctgggccctgagatggagagccgctactttgcccaggtgggcctggagcacctggccagcagcagccccccagccttcggcttcctgaagtgcctggactacagcatctctgtgctgtgcagcgccaccagcctggccatgctggaggacaaccccaaggtgtccaagctggccaccggggactggatgctgaccctgaagcccaagagcatcaccgtgcctgtggagatccccagcagccccctggccggccggcccaggagaagaagaaggctgcgctgcccccatgaccagcacagccagggcacctgctag

SEQ ID NO: 147666 - DNA, 429 bp, Artificial Sequence
  Description of Artificial Sequence: Synthetic coding sequence
atgatcagcacagcccgggtgcctgctgacaagcctgtgagaattgccttcagcctgaatgatgccagtgatgacaccccaccagaagattccatccccctggtgtttcctgagctggaccagcagctgcagcccctgcccccctgccacgacagcgaggagagcatggaggtgttcaagcagcactgccagattgctgaggagtaccacgaggtgaagaaggagatcaccctgctggagcagaggaagaaggagctgattgccaagctggaccaggccgagaaggagaaggtggatgctgctgagctggtgcgggagtttgaggccctgacagaagaaaatagaaccctgcggctggcccagagccagtgtgtggagcagctggagaagctgcgcatccagtaccagaagaggcagggcagcagctag

SEQ ID NO: 147667 - DNA, 729 bp, Artificial Sequence
  Description of Artificial Sequence: Synthetic coding sequence
atggtgcagctgattgcccccctggaggtgatgtggaatgaagctgctgacctgaagcccctggccctgagccggcggctggagtgcagcggcggcatcatggcccactacagcccagacctgctgggccctgagatggagagccgctactttgcccaggtgggcctggagcacctggccagcagcagccccccagccttcggcttcctgaagtgcctggactacagcatctctgtgctgtgcagcgccaccagcctggccatgctggaggacaaccccaaggtgtccaagctggccaccggggactggatgctgaccctgaagcccaagagcatcaccgtgcctgtggagatccccagcagccccctggatgacaccccaccagaagattccatccccctggtgtttcctgagctggaccagcagctgcagcccctgcccccctgccacgacagcgaggagagcatggaggtgttcaagcagcactgccagattgctgaggagtaccacgaggtgaagaaggagatcaccctgctggagcagaggaagaaggagctgattgccaagctggaccaggccgagaaggagaaggtggatgctgctgagctggtgcgggagtttgaggccctgacagaagaaaatagaaccctgcggctggcccagagccagtgtgtggagcagctggagaagctgcgcatccagtaccagaagaggcagggcagcagctag

SEQ ID NO: 147668 - DNA, 429 bp, Artificial Sequence; identical to SEQ ID NO: 147666
  Description of Artificial Sequence: Synthetic coding sequence

SEQ ID NO: 147669 - DNA, 429 bp, Artificial Sequence; identical to SEQ ID NO: 147666
  Description of Artificial Sequence: Synthetic coding sequence

SEQ ID NO: 147670 - DNA, 429 bp, Artificial Sequence; identical to SEQ ID NO: 147666
  Description of Artificial Sequence: Synthetic coding sequence

SEQ ID NO: 147671 - DNA, 429 bp, Artificial Sequence; identical to SEQ ID NO: 147666
  Description of Artificial Sequence: Synthetic coding sequence

SEQ ID NO: 147672 - DNA, 429 bp, Artificial Sequence; identical to SEQ ID NO: 147666
  Description of Artificial Sequence: Synthetic coding sequence

SEQ ID NO: 147673 - DNA, 729 bp, Artificial Sequence; identical to SEQ ID NO: 147667
  Description of Artificial Sequence: Synthetic coding sequence

SEQ ID NO: 147674 - DNA, 135 bp, Artificial Sequence
  Description of Artificial Sequence: Synthetic coding sequence
atggtgcagctgattgcccccctggaggtgatgtggaatgaagctgctgacctgaagcccctggccctgagccggcggctggagtgcagcggcggcatcatggcccactacagcccagacctgctgggcccctag

SEQ ID NO: 147675 - DNA, 285 bp, Artificial Sequence
  Description of Artificial Sequence: Synthetic coding sequence
atgatcagcacagcccgggtgcctgctgacaagcctgtgagaattgccttcagcctgaatgatgccagtgatgacaccccaccagaagattccatccccctggtgtttcctgagctggaccagcagctgcagcccctgcccccctgccacgacagcgaggagagcatggaggtgttcaagcagcactgccagattgctgaggagtaccacgaggtgaagaaggagatcaccctgctggagcagaggaagaaggagctgattgccaagctggaccaggccgagtag

SEQ ID NO: 147676 - DNA, 411 bp, Artificial Sequence
  Description of Artificial Sequence: Synthetic coding sequence
atgctggtgagcagcagcagcctgacccccttcccccctgtgaggacagcagatgacaccccaccagaagattccatccccctggtgtttcctgagctggaccagcagctgcagcccctgcccccctgccacgacagcgaggagagcatggaggtgttcaagcagcactgccagattgctgaggagtaccacgaggtgaagaaggagatcaccctgctggagcagaggaagaaggagctgattgccaagctggaccaggccgagaaggagaaggtggatgctgctgagctggtgcgggagtttgaggccctgacagaagaaaatagaaccctgcggctggcccagagccagtgtgtggagcagctggagaagctgcgcatccagtaccagaagaggcagggcagcagctag

SEQ ID NO: 147677 - DNA, 786 bp, Artificial Sequence
  Description of Artificial Sequence: Synthetic coding sequence
atggtggtggtggccgccgcccccaacccagcagatggcacccccaaggtgctgctgctgagcggccagcctgccagcgctgctggggccccagctggccaggccctgcccctgatggtgcctgcccagagaggagccagccctgaggccgccagcggcggcctgccccaggccaggaagaggcagaggctgacccacctgagccctgaggagaaggccctgcggaggaagctgaagaacagagtggccgcccagacagcccgggacaggaagaaggccaggatgtctgagctggagcagcaggtggtggacctggaggaggagaaccagaagctgctgctggagaaccagctgctgcgggagaagacccacggcctggtggtggagaaccaggagctgcggcagaggctgggcatggatgccctggtggccgaggaggaggccgaggccaagggaaatgaggtgcggcctgtggccggcagcgctgagagcgctgccctgcggctgcgggcccccctgcagcaggtgcaggcccagctgagccccctgcagaacatcagcccctggatcctggccgtgctgaccctgcagatccagagcctcatcagctgctgggccttctggaccacctggacccagagctgcagcagcaatgccctgccccagagcctgcctgcctggaggagcagccagaggagcacccagaaggaccctgtgccctaccagccccccttcctgtgccagtggggccgccaccagcccagctggaagcccctgatgaactag

SEQ ID NO: 147678 - DNA, 528 bp, Artificial Sequence
  Description of Artificial Sequence: Synthetic coding sequence
atgagccgcagctacaatgatgagctgcagttcctggagaagatcaacaagaactgctggaggatcaagaagggctttgtgcccaacatgcaggtggagggcgtcttctacgtgaatgatgccctggagaagctgatgtttgaggagctgagaaatgcctgccggggcggcggcgtgggcggcttcctgcctgccatgaagcagattggaaatgtggccgccctgcccggcatcgtgcacaggagcatcggcctgcctgatgtgcacagcggctacggctttgccatcggcaacatggccgcctttgacatgaatgaccctgaggccgtggtgtccccaggaggagtgggctttgacatcaactgtggggtgcggctgctgcggaccaacctggatgaaagtgatgtgcagcctgtgaaggagcagctggcccaggccatgtttgaccacatccctgtgggcgtgggcagcaagggggacatgatgagagctgtgcactgcccagagcagaacctggatgtgatctag

SEQ ID NO: 147679 - DNA, 2304 bp, Artificial Sequence
  Description of Artificial Sequence: Synthetic coding sequence
atgagccatgctgtgaccatcgaggagccccaggcccagccccaggtgtcccagacccgctaccgggagaggagcagagctggcagccacatcagcagcaacagagcctatgacttcctgtatgaccccctcttcatcgtgtcctctgagaaggaccacacccaggccaacatccaggccaccctcatccgcagccggctgaggaaggtgccccgcttcaagaccatgttcagcaacctgatccactacccccgctacagcctgtactggagcaagagtgaccctgtgccccccttcatcagccgggagtggaagggccacaaggagaagcaccgggaggccctgcggcagctgaccaccacagatgccagcttccagatgcccaaggaggtgtatgaagatcctgaggtgacaggcaagaaccgctacaagtactttgagcggcccttcctgcccttcttccagcagatgcccttcaacgtggtgtatgctgtgtccaaggccgagccctacaccttcccccccaccagcaccaagcacctgagcatccccagcaagagcacagtgggcacccagacagactacagagatgctgatgtgcagacagacccctacagcgcagaatatgtggtgtgccaggacagcatccctgagctgctgaccctggccaccctgacctggggccggggcctgcctgctggccaggccgaggtggagatgattgagcgggcccgggagaagagggcctgggaggccagcctgcctgccctgagtgacaccagccagtttgagaagaggaggaagatgatgaatgagatggagaggaaggagtgggccttccgggagcaggagattgagaagctgcaggagatccggctggaggtgctgaaggagctgctgaggaagcgggaggagaaccagaatgaggtgaacatgaagcacctgaatgcccgctggagcaagctgcaggagggcaaggaggccaagatggccaagatccagaggacccacgtgtccaccatcaggaagctggtgggcaagaggaagaacatcgagggcaagctggagaggaggaacatcatcaaggactacagcgactatgccagccaggtgtatggccccctgagccggctgggctgcttcccagacaacaacagtgaagattttgtggtgaagaactactacctgaacacctatgagggcctggtggagctggagagctgcctgcctgactttgtgacccagccccagatccgggcccccaagcccaaggtgatcaccaccaaggccggcttcctgaagagagctgcccggctggactatgagctggccgaggtgcacaaggccctgctggacaagaagaacaaggtgctggaggtgaagaagcccccacgcttcctgcagaggaaccccatcccccagccccggctgcccacccccaccctggagatgaccagcaatgaggaggaggagatggagatggctgtgatctacctgcagaagctgctgcggggccgggtggtgcagaacatgatgtttgagggcaaggagaagaggctggagctgatccaggagctgcggacctgccacgccctgcaggaggatgagaagctggtgaagaaggccgagaagcaggtgaccctggccctgcagaggcagaggaacctgcacgagcacaaggtgtccctggtggagaaccacctggccggcctggagggccgggccctggccgacatgtttgacttcctgagcaaggagctggtgcggctgcaggaggagcggcgcatccacgcctttgtgatgctggccgagcggcagaggagagtgcgggaggccgaggagagcggccggcggcaggtggagaagcagaggctgcgggaggaggatgagatcttcaaggaggtggtgaaggtgcaccacagcaccatcagcagctacctggaggacatcatcctgaacacagaggccaacacagctgaggagcaggcccgggcagaaattgagaagatggccgagaagatcaatgacatcgcctatgagatggagagcaggaggacctacctgcagagcgaggagatcgtggccgagctggtgtacagcttcctgatccctgaggtgcagaagtactttgtgaaggagaaggtgagaaatgcccagaggaagcacatcctggccgcccaccagatcatccacagctacacagagagcatggtgcagaagaagctgacagaaggagagcaggatgaggccagcaatgctgccatgctgctggagaaggagacccagaatgaaaacaacagctag

SEQ ID NO: 147680 - DNA, 564 bp, Artificial Sequence
  Description of Artificial Sequence: Synthetic coding sequence
atgagccatgctgtgaccatcgaggagccccaggcccagccccaggtgtcccagacccgctaccgggagaggagcagagctggcagccacatcagcagcaacagagcctatgacttcctgtatgaccccctcttcatcgtgtcctctgagaaggaccacacccaggccaacatccaggccaccctcatccgcagccggctgaggaaggtgccccgcttcaagaccatgttcagcaacctgatccactacccccgctacagcctgtactggagcaagagtgaccctgtgccccccttcatcagccgggagtggaagggccacaaggagaagcaccgggaggccctgcggcagctgaccaccacagatgccagcttccagatgcccaaggaggtgtatgaagatcctgaggtgacaggcaagaaccgctacaagggccagaaccacaccctcttcctgctgctgctgctgagcacctaccccagcctgcagagcctgctgtgggccctgcggctcatcatcggcatgctgaccttcaagcagatccacaccctgcagaacatgtag

SEQ ID NO: 147681 - DNA, 717 bp, Artificial Sequence
  Description of Artificial Sequence: Synthetic coding sequence
atgagccatgctgtgaccatcgaggagccccaggcccagccccaggtgtcccagacccgctaccgggagaggagcagagctggcagccacatcagcagcaacagagcctatgacttcctgtatgaccccctcttcatcgtgtcctctgagaaggaccacacccaggccaacatccaggccaccctcatccgcagccggctgaggaaggtgccccgcttcaagaccatgttcagcaacctgatccactacccccgctacagcctgtactggagcaagagtgaccctgtgccccccttcatcagccgggagtggaagggccacaaggagaagcaccgggaggccctgcggcagctgaccaccacagatgccagcttccagatgcccaaggaggtgtatgaagatcctgaggtgacaggcaagaaccgctacaagtactttgagcggcccttcctgcccttcttccagcagatgcccttcaacgtggtgtatgctgtgtccaaggccgagccctacaccttcccccccaccagcaccaagcacctgagcatccccagcaagagcacagtgggcacccagacagactacagagatgctgatgtgcagacagacccctacagcgcagaatatgtggtgtgccaggacagcatccctgagctgctgaccctggccaccctgacctggggcgagctggtgaacctgctgaccatcggccgctag

SEQ ID NO: 147682 - DNA, 654 bp, Artificial Sequence
  Description of Artificial Sequence: Synthetic coding sequence
atggacctggcccagcccagccagcctgtggatgagctggagctgtctgtgctggagcggcagcctgaggagaacacccccctgaatggagctgacaaggtgttccccagcctggatgaggaggtgcccccagctgaggccaacaaggagagcccctggagcagctgcaacaagaatgtggtgggccgctgcaagctgtggatgatcatcaccagcatcttcctgggcgtcatcaccgtcatcatcatcggcctgtgcctggccgctgtgacctacgtggatgaagatgaaaatgagatcctggagctgagcagcaacaagaccttcttcatcatgctgaagatccctgaggagtgtgtggccgaggaggagctgccccacctgctgacagagcggctgacagatgtgtacagcaccagccccagcctgggccgctacttcacctctgtggagatcgtggacttcagcggggagaatgccaccgtgacctatgacctgcagtttggagtgcccagtgatgatgagaacttcatgaagtacatgatgtctgaggagctggtgctgggcatcctgctgcaggacttccgggaccagaacatccctggctgtgagagcctgggcctggaccccaccagcctgctgctgtatgaatag

SEQ ID NO: 147683 - DNA, 444 bp, Artificial Sequence
  Description of Artificial Sequence: Synthetic coding sequence
atggacctggcccagcccagccagcctgtggatgagctggagctgtctgtgctggagcggcagcctgaggagaacacccccctgaatggagctgacaaggtgttccccagcctggatgaggaggtgcccccagctgaggccaacaaggagagcccctggagcagctgcaacaagaatgtggtgggccgctgcaagctgtggatgatcatcaccagcatcttcctgggcgtcatcaccgtcatcatcatcggcctgtgcctggccgctgtgacctacgtggatgaagatgaaaatgagatcctggagctgagcagcaacaagaccttcttcatcatgctgaagatccctgaggagtgtgtggccgaggaggagctgccccacctgctgacagagcgggaggtgggcctgaagcccaaccctgaggccctggtgggctttgaatag

SEQ ID NO: 147684 - DNA, 753 bp, Artificial Sequence
  Description of Artificial Sequence: Synthetic coding sequence
atggacctggcccagcccagccagcctgtggatgagctggagctgtctgtgctggagcggcagcctgaggagaacacccccctgaatggagctgacaaggtgttccccagcctggatgaggaggtgcccccagctgaggccaacaaggagagcccctggagcagctgcaacaagaatgtggtgggccgctgcaagctgtggatgatcatcaccagcatcttcctgggcgtcatcaccgtcatcatcatcggcctgtgcctggccgctgtgacctacgtggatgaagatgaaaatgagatcctggagctgagcagcaacaagaccttcttcatcatgctgaagatccctgaggagtgtgtggccgaggaggagctgccccacctgctgacagaaagaaatgaggtgatggaggccggcctgtgcctgaaggctgtgctgtaccaggtgctggagatgaagggcatccacagcgtgctgcagaagcgcttctgtggcctcatccagaagcaccagcagcaccagaggggcggggacagcttcctgagccgcttctacagcctggccctgagccctgtgaagcagctgcccagcacagccagcgctggcagcagcctggacaagggcaggaagccagcccgggtgggcgccatcggcagcgctggcatgagccactgctggaggagcctggtgttctgcctcttcctgttctgctttgtgctcttctttgagaccggcagccgctctgtggcctag

SEQ ID NO: 147685 - DNA, 1293 bp, Artificial Sequence
  Description of Artificial Sequence: Synthetic coding sequence
atgtggaggctggtgccccccaagctgggccgcctgagccgcagcctgaagctggccgccctgggcagcctgctggtgctgatggtgctgcacagccccagcctgctggcctcctggcagagaaatgagctgacagaccggcgcttcctgcagctgaacaagtgcccagcctgcttcggcacctcctggtgccgccgcttcctgaatggccaggtggtgtttgaggcctggggccgcctgcggctgctggacttcctgaatgtgaagaatgtgtactttgcccagtacggggagccccgggagggcggcagaagaagagtggtgctgaagaggctgggcagccagcgggagctggcccagctggaccagagcatctgcaagagggccaccggccggccccgctgtgacctgctgcaggccatgcccaggacagaatttgcccggctgaatggagatgtgcggctgctgaccccagaggccgtggagggctggagcgacctggtgcactgccccagccagaggctgctggaccggctggtgagaagatatgcagagaccaaggacagcggcagcttcctgctgaggaacctgaaggacagcgagaggatgcagctgctgctgaccctggccttcaaccctgagcccctggtgctgcagagcttccccagtgatgagggctggccctttgccaagtacctgggcgcctgtggccgcatggtggccgtgaactacgtgggggaggagctgtggagctacttcaatgccccctgggagaagagggtggacctggcctggcagctgatggagattgctgagcagctgaccaacaatgactttgaatttgccctgtacctgctggatgtgtcctttgacaactttgctgtgggccccagagatggcaaggtgatcatcgtggatgctgaaaatgtgctggtggccgacaagaggctcatccggcagaacaagccagagaactgggatgtgtggtatgagagcaagtttgatgactgtgacaaggaggcctgcctgtccttcagcaaggagatcctgtgtgcccgggccaccgtggaccacaactactatgctgtgtgccagaacctgctgagcagacatgccacctggaggggcaccagcggcggcctgctgcatgaccccccatctgaaattgccaaggatggccgcctggaggccctgctggatgaatgtgccaaccccaagaagagatatggccgcttccaggccgccaaggagctgcgggagtacctggcccagctgagcaacaacgtgaggtag

SEQ ID NO: 147686 - DNA, 666 bp, Artificial Sequence
  Description of Artificial Sequence: Synthetic coding sequence
atgaagtcagaaaatggaacagtggtgggcagcttccccagtgatgagggctggccctttgccaagtacctgggcgcctgtggccgcatggtggccgtgaactacgtgggggaggagctgtggagctacttcaatgccccctgggagaagagggtggacctggcctggcagctgatggagattgctgagcagctgaccaacaatgactttgaatttgccctgtacctgctggatgtgtcctttgacaactttgctgtgggccccagagatggcaaggtgatcatcgtggatgctgaaaatgtgctggtggccgacaagaggctcatccggcagaacaagccagagaactgggatgtgtggtatgagagcaagtttgatgactgtgacaaggaggcctgcctgtccttcagcaaggagatcctgtgtgcccgggccaccgtggaccacaactactatgctgtgtgccagaacctgctgagcagacatgccacctggaggggcaccagcggcggcctgctgcatgacccccccagcgagatcgccaaggatggccgcctggaggccctgctggatgaatgtgccaaccccaagaagagatatggccgcttccaggccgccaaggagctgcgggagtacctggcccagctgagcaacaacgtgaggtag

SEQ ID NO: 147687 - DNA, 5079 bp, Artificial Sequence
  Description of Artificial Sequence: Synthetic coding sequence
atgaggcggcccccacccctgggccccaccacagccagcggccctgagggcaatgtgaggaacctgcagaagaggcaggcccctggccctggagctgctgggggctgcggccctgaggccggcggctgccgggagaacaagcagaagaggaggatggtggcccgggccaccccaggccgcggggaggtggagagtgacaagtctgtggccgccagcggggccggcaaggccgcccggcggcaggtggagggcagaagaggccctgtgagccccagcgacagcagtgacccccggggcctggaggccgccaaggaggccgagctgcccctgcagacagagcggcacaccaaggagaagaggaaggtgacagaggccagcagtgatgacccccagcccggcctggacctggtgaggaaggagagcctgaccagcagcgagagcttccagacagtggagtgcctgcagagcctgggcaaggagagcatcatcgagggcatcaagaggcgcatccggaacaagaagctgaagagcctggagaacccccccctgaagatcacagaaaatgaggccacccagaacatcaaggtggagttccaggatgagctgtacaagaacacccccaagtacagctgcaacatcctgagccctgaggtggagaacaacagcgtgctgaagctgcgggactgcaactgcttcccccacagcaagggctgcaatgatgagaacaacctgccctacaagccagatggcggctgcatgcacgtggccgagaacttcagcaagaaggagaacctgcggagcctggccgagaagagtgacaccaacagcatcccccagctgctgcagacagaagaaaatgtgatgggcgtgaacaagctgctgcctgaggagagtgacctgtaccagagcaagaccaacggcctgctgagctgcctgcagcacgagaagaacaagtacagcattgaggagagctctgtgggcaggaagcccaggaagaggatgaagctgtctgagaaggcagatgaaacagtgacagagatgaacttcagcaatgagtacaacaagtctgagctgatgctgcaggagaaccagatgattgctgatggcaaggaggccgagaccaagagccccctgaatgtgctgaggaaggtgagccacaacacagtgtccctgatggaccacctgctgtctgtgcctgagaccgtggagaaggagaccagcagcgagcaccacgtgaatgctgtgttccagaagaccatcgagcccctgctgaaggaggagacagaaaatgccagcgagcccctgggctatgaatccatggccagcaaggaggacttcaagtccatgaagagcttcatcggcaagagccccaatgagtaccacatcgagcggcgcagcagccgggaggacctgcggagcgccagcgaggagctgaagctgagctgccagaggaccatccccatgaccgggaagaggacctggccctactacagctgtgcccgcatcagcgcctggtgctggaagaaggccagcctgcctgagagcagctacttcctgcggggcagccaggagagctgccggcaggtggatgtgcccaagcaccagaccaaccagacccacctgacagacagcaagctgctgctgcagagcagcctgacagagaccaacacagagagcagcagcaaggagaagctggacagcaacagcaactgcctgagctctgtgtctgctgtggagcccaccctgatggtgatcaaggagcccatcatcaaggatgacaagaagatcaagtctgaggagctgagcagaagaggcagcgaggtgatcagcaacaccacagaggacacccagctgaccagcgagacccagagcctgaccggcaacaagaagaaggcccggggcaacctgaccaagctgaacctgacagccaccagcaaggatggccaggaggccaacaacagcgctgggaagaccatccacaggaaggcctgcatcgcccagcagaccttcatcgtgcctgacctggtgaagatcctgaacacaggccgcctgaccaacttcaagatccccctgctgaagaacaagtctgagaagaggaaggaggtgaatgccaagagcagcgagcgggaggcctacagccccctggagctgctggacaacctgagcggggctgatgtgcggcagaacagaagcaaagaaaatgtgtccatgatgatgctgggcccccagaccctgagcatccggaacagcgtgacccctgtgcaggccagcagtgacagcttctacaacaagaagagctacagcatcagccccagcttcaccaagcagggcaacaacagcaagcccagcaaccacgtgtctgagcccggcaacatcgtgagcaacaaggaggtggccagcctgactgtggagaacaatgccttcagctgtgaccccggctacgtggagaagagccccagcttctgctgcaatgagcaggagaccttccggcctgtgagcagcgaggtgcggggcaggaagatcaccaagaacttcagcgaggtgggcttcccagacatcctgaaggcctatgaagatgatgtgctgctgattgatgtgatccaggatgatcctgacctgtttggagtgtccaatgaaggagagctgtccttcaccagcgaggtgcccaagatcagccaggagcccaacgtggccggggagcaccagagcacagacagcaagtacatggagacccctgtgaagaaggagcccagtgatgacctgcgggagctgcctgtgctggactgtggctggatcaagccagacatctgtgccagcaacagcgctgagagcgagatcaagagggaccccaaggatgtgaacaccagcctgggggaggtggccaatgagaccagtgaaaatgagaccctgggggacttcagcgagcagatcaagggcagtgacctggatgagaagcaccgcttcacagacaaggtgatcaccaaggaggagaaggagaacatctatgaggtgtgcaagagcaaggacagcagaaatgctgacttcatggtgggggagtgccagtttgctgtgcctgtgcccaagcccctgtgcctgctggtgccccccctgaacctgagcggccggcaggaggacaccatcctgaacacctggatgaatgacttccgcttcctgggcaagcacagcgtgctgaagctgcagaaccctgagacctgtgagatcttcaagcgggagaagaatgtgggcgtcttccagaagagcctgggcctgatgatcccctacaagtactgcaagttccacttcaacaccctgcggggctgtgagcggcccctgtgcaagtttgcccacgtgcctgagcagggagatgagaaggtgtgcatggatgtgttcaagaagtacatcaacatcaatgagctgtgcctgctgcagagagctgtgaacatcttcatggagtactacaggaagtttcctcctggggtgtactttgacctgcaggtgctgaatgacctgctgaacagcctgctgaagcactgcctgctgaaggaggtgttccagatcgtgaacctgagcatcatggtgaagatgctgcccagcctgaagatcctgctgaacatctttgaatatgtggccaccatgaagctgagaaatgctgtgcctgccctgattgacatcttctgcaagctggtggaggccggcatggtgctggaccctgagcacttcaactacatcgtgaagctgctgtaccaggtgcaggccagcaagcaggagatcacagctgtgctggagatgaagagccggctgcagatgaggcgcttcaagaagaactggaagtgtgacctggacagcgccctgaacaagctggagcactgcaaggagaagggggactggaccaagctgggcaagctgtacatcaacgtgaagatgggctgtgagaagtttgctgacttccagaccttctgtgcctgcatcgccgagaccctgaccaagaactatgaagatgagaggccagacatccccttctgtgaatttgctgagaccgtgtccaaggacccccagaacagcaaggtggacaagggcgtgctgggccgcatcggcatcagcgccatgtacttctaccacaagctgctgcagtggagcaagggcaggaaggtgctggagaagctgtatgagctgaagatccacttcaccagcctgaagggcctcatcggccctgagaagctggccagccgctgccagatcgtgaatgtggccgctgagatcttcctgaagagcggcagcctggatggagccatctgggtgatgagggagagcgagtggatcatcaacacccccctgtggccctgtgaccggctggatgtgctgaacagacacaacctgctgtgcaccatcgcccacgagatcctggccaagagcctgtaccggcagacctttgaggtgctgcagaacctgcccggcttccagaacagccaggagaccgtggaggtgtcccagtacagcctgctcttcaacaagctgctgggcagctgcatcgagagcagcagcctgggcatgagcagctctgtggccgagttcatgatcagcaagagcatccccatcgacttctccttcctgcggcggctcatcaccagcctgggccgcagccggctgtggctgaaggcccgggcccactacaagagcgccctgagcctgggctgctacccacccctggagggcaacctgtacaggaagctgctgctgatccccagctacctgtctgaaattgagatgctgctggccatcgagatcttcatggtgtccaatgccagcagcatccagagccctggcaccagcacccagatcctgcagatcgtgctgaagagatgtgaggacaaccagagccgcagcaatgatgactaccaggccgctgtggagcggctcatcatggccgcccgcatcagtgaccccaagctgtttgtgaagcacatgacagtgaatgtgaacaaggagcaggtgtacagcctggagcactgcagcgccctgaagtggctgaaggagaacatgaagtgggccggcaaggtgtggctgttcagcaaccactag

SEQ ID NO: 147688 - DNA, 207 bp, Artificial Sequence
  Description of Artificial Sequence: Synthetic coding sequence
atggtgtactacccagagctgtttgtgtgggtgtcccaggagcccttccccaacaaggacatggagggccgcctgcccaagggccgcctgcctgtgcccaaggaggtgaacaggaagaagaatgatgagaccaatgctgccagcctgacccccctgggcagcagcgagctgcggagcccccgcatctcctacctgcacttcttctag

SEQ ID NO: 147689 - DNA, 207 bp, Artificial Sequence; identical to SEQ ID NO: 147688
  Description of Artificial Sequence: Synthetic coding sequence

SEQ ID NO: 147690 - DNA, 339 bp, Artificial Sequence
  Description of Artificial Sequence: Synthetic coding sequence
atgaagggcgtgtggaactacagcgccctgagccggcgggaggatgagaccaggacccagaggagcaggatgacagacagagtgccctgcagcaagtgcttccaggtgcactgccagatctctgtgctgaactgtgtgtactacccagagctgtttgtgtgggtgtcccaggagcccttccccaacaaggacatggagggccgcctgcccaagggccgcctgcctgtgcccaaggaggtgaacaggaagaagaatgatgagaccaatgctgccagcctgacccccctgggcagcagcgagctgcggagcccccgcatctcctacctgcacttcttctag

SEQ ID NO: 147691 - DNA, 207 bp, Artificial Sequence; identical to SEQ ID NO: 147688
  Description of Artificial Sequence: Synthetic coding sequence

SEQ ID NO: 147692 - DNA, 207 bp, Artificial Sequence; identical to SEQ ID NO: 147688
  Description of Artificial Sequence: Synthetic coding sequence

SEQ ID NO: 147693 - DNA, 207 bp, Artificial Sequence; identical to SEQ ID NO: 147688
  Description of Artificial Sequence: Synthetic coding sequence

SEQ ID NO: 147694 - DNA, 207 bp, Artificial Sequence; identical to SEQ ID NO: 147688
  Description of Artificial Sequence: Synthetic coding sequence

SEQ ID NO: 147695 - DNA, 207 bp, Artificial Sequence; identical to SEQ ID NO: 147688
  Description of Artificial Sequence: Synthetic coding sequence

SEQ ID NO: 147696 - DNA, 207 bp, Artificial Sequence; identical to SEQ ID NO: 147688
  Description of Artificial Sequence: Synthetic coding sequence

SEQ ID NO: 147697 - DNA, 18 bp, Artificial Sequence
  Description of Artificial Sequence: Synthetic coding sequence
atggtgtactacccctag

SEQ ID NO: 147698 - DNA, 102 bp, Artificial Sequence
  Description of Artificial Sequence: Synthetic coding sequence
atggtgtactacccagagctgtttgtgtgggtgtcccaggagcccttccccaacaaggacatggagggccgcctgcccaagggccgcctgcctgtgccctag

SEQ ID NO: 147699 - DNA, 207 bp, Artificial Sequence; identical to SEQ ID NO: 147688
  Description of Artificial Sequence: Synthetic coding sequence

SEQ ID NO: 147700 - DNA, 207 bp, Artificial Sequence; identical to SEQ ID NO: 147688
  Description of Artificial Sequence: Synthetic coding sequence

SEQ ID NO: 147701 - DNA, 198 bp, Artificial Sequence
  Description of Artificial Sequence: Synthetic coding sequence
atggtgtactacccagagctgtttgtgtgggtgtcccaggagcccttccccaacaaggacatggagggccgcctgcccaagggccgcctgcctgtgcccaaggaggtgaacaggaagaagaatgatgagaccaatgctgccagcctgacccccctgggcagcagcgagctgcggagcccccgcatctcctacctgtag

SEQ ID NO: 147702 - DNA, 735 bp, Artificial Sequence
  Description of Artificial Sequence: Synthetic coding sequence
atgcactatggagctgccacccacatccagaacagccgcagccacggcctggagaccgtgcccggccaccagaggctggagcggggggccggcggggagaccccagagttccctggctgccacagccctgcccccccagaaaattttggaaatgagctgctgcccctgagcgcccccctgcagggcctgtctgagggcctgtacccacctggcaggaacaagaccctgcctgctggggtgctgcgggagggcgctgtgcagttcctgcaccggggcctgtgcaacagcaacctgagcagcgaggccagcgcccggcccagcggcacccaggatgagctgcacagcagcaggaggaagacaggccagacccggcgggagggcgccaggaagcacctggtgtgcagcttccggctgtaccccttcaccgtgcacacagtgtccccaggcaacagccacctggccctgtaccaggtgttcaaggctgtgaagctgtgccccagcgagaccagcttcttcctgagcaggaagagcctgaagagcagtgacccctggcacccccccagcctgagccccaacagctggaaccggcaggccggcttccgggcctggagcagccacctgatcagcctgagcctgacctgcagcgacagccagagccggcgggtgagcagcagccagcagccccccctgcacagcctgagcagccacagaagagctgcccacgtgcctgagtag

SEQ ID NO: 147703 - DNA, 480 bp, Artificial Sequence
  Description of Artificial Sequence: Synthetic coding sequence
atgtacagaaggaagagcggctggacaggctgtgccatcacctgcagcccctgcacagccatgacccagctgaggaactgcatgaggctgagccgcagctgcagcctgacctgggagaccccccgctggtacatggccggccgggtggccaccagcaccagcggctgccactgctggatgagccggcgggacctgacccccctgccccaccccagcgagcccggggtgctggactgcctgggcccctgccacctgctgcccctgctgagccctggcagcccctgctgggtgctgggcctgcacttcagcctgcacccccccagcgctgccagcgccagccacgccctgaccatcaccagcctgcccccaggcctgctgccctttgtgggcgtggagctgacagcccacccccaggccctgatgggccggggcttccccagcggcatgggcgccgccggccgccacctgtgcttcctgtag

SEQ ID NO: 147704 - DNA, 480 bp, Artificial Sequence; identical to SEQ ID NO: 147703
  Description of Artificial Sequence: Synthetic coding sequence

SEQ ID NO: 147705 - DNA, 480 bp, Artificial Sequence; identical to SEQ ID NO: 147703
  Description of Artificial Sequence: Synthetic coding sequence

SEQ ID NO: 147706 - DNA, 480 bp, Artificial Sequence; identical to SEQ ID NO: 147703
  Description of Artificial Sequence: Synthetic coding sequence

SEQ ID NO: 147707 - DNA, 294 bp, Artificial Sequence
  Description of Artificial Sequence: Synthetic coding sequence
atgagcagcgcccctgagccccccaccttcaagaaggagccccccaaggagaaggagttccagagccctggcctgcggggcgtgaggaccaccaccctcttccgggctgtgaaccctgagctgttcatcaagcccaacaagcctgtgatggccttcggcctggtgaccctgagcctgtgtgtggcctacatcggctacctgcacgccatccaggagaacaagaaggacctgtatgaggccattgattctgagggccacagctacatgaggaggaagaccagcaagtgggactag

SEQ ID NO: 147708 - DNA, 768 bp, Artificial Sequence
  Description of Artificial Sequence: Synthetic coding sequence
atgaccaagaccagcacctgcatctaccacttcctggtgctgtcctggtacaccttcctgaactactacatcagccaggagggcaaggatgaggtgaagcccaagatcctggccaatggagcccgctggaagtacatgaccctgctgaacctgctgctgcagaccatcttctacggcgtgacctgcctggatgatgtgctgaagaggaccaagggcggcaaggacatcaagttcctgacagccttccgggacctgctcttcaccaccctggccttccctgtgtccacctttgtgttcctggccttctggatcctcttcctgtacaacagagacctgatctaccccaaggtgctggacaccgtcatccctgtgtggctgaaccacgccatgcacaccttcatcttccccatcaccctggccgaggtggtgctgcggccccacagctaccccagcaagaagacaggcctgaccctgctggccgccgccagcatcgcctacatcagccgcatcctgtggctgtactttgaaacaggcacctgggtgtaccctgtgtttgccaagctgagcctgctgggcctggccgccttcttcagcctgtcctatgtgttcatcgccagcatctacctgctgggggagaagctgaaccactggaagtgggtgtctgtgcagatcctgcagcgctggaggctggagagcgtgggcatctgcttccagtggccagactggaagagccctgccaagcaccagctggtgaagaacatcagatag

SEQ ID NO: 147709 - DNA, 510 bp, Artificial Sequence
  Description of Artificial Sequence: Synthetic coding sequence
atgaccaagaccagcacctgcatctaccacttcctggtgctgtcctggtacaccttcctgaactactacatcagccaggagggcaaggatgaggtgaagcccaagatcctggccaatggagcccgctggaagtacatgaccctgctgaacctgctgctgcagaccatcttctacggcgtgacctgcctggatgatgtgctgaagaggaccaagggcggcaaggacatcaagttcctgacagccttccgggacctgctcttcaccaccctggccttccctgtgtccacctttgtgttcctggccttctggatcctcttcctgtacaacagagacctgatctaccccaaggtgctggacaccgtcatccctgtgtggctgaaccacgccatgcacaccttcatcttccccatcaccctggccgaggtggtgctgcggccccacagctaccccagcaagaagacaggcctgaccctgctggccgccgccagcatcgcctacatcagcaggtag

SEQ ID NO: 147710 - DNA, 693 bp, Artificial Sequence
  Description of Artificial Sequence: Synthetic coding sequence
atgaccaagaccagcacctgcatctaccacttcctggtgctgtcctggtacaccttcctgaactactacatcagccaggagggcaaggatgaggtgaagcccaagatcctggccaatggagcccgctggaagtacatgaccctgctgaacctgctgctgcagaccatcttctacggcgtgacctgcctggatgatgtgctgaagaggaccaagggcggcaaggacatcaagttcctgacagccttccgggacctgctcttcaccaccctggccttccctgtgtccacctttgtgttcctggccttctggatcctcttcctgtacaacagagacctgatctaccccaaggtgctggacaccgtcatccctgtgtggctgaaccacgccatgcacaccttcatcttccccatcaccctggccgaggtggtgctgcggccccacagctaccccagcaagaagacaggcctgaccctgctggccgccgccagcatcgcctacatcagccgcatcctgtggctgtactttgaaacaggcacctgggtgtaccctgtgtttgccaagctgagcctgctgggcctggccgccttcttcagcctgtcctatgtgttcatcgccagcatctacctgctgggggagaagctgaaccactggaagtggggagacatgaggcagcccaggaagaagaggaagtag

SEQ ID NO: 147711 - DNA, 507 bp, Artificial Sequence
  Description of Artificial Sequence: Synthetic coding sequence
atgaccaagaccagcacctgcatctaccacttcctggtgctgtcctggtacaccttcctgaactactacatcagccaggagggcaaggatgaggtgaagcccaagatcctggccaatggagcccgctggaagtacatgaccctgctgaacctgctgctgcagaccatcttctacggcgtgacctgcctggatgatgtgctgaagaggaccaagggcggcaaggacatcaagttcctgacagccttccgggacctgctcttcaccaccctggccttccctgtgtccacctttgtgttcctggccttctggatcctcttcctgtacaacagagacctgatctaccccaaggtgctggacaccgtcatccctgtgtggctgaaccacgccatgcacaccttcatcttccccatcaccctggccgaggtggtgctgcggccccacagctaccccagcaagaagacaggcctgaccctgctggccgccgccagcatcgcctacatctcctag

SEQ ID NO: 147712 - DNA, 675 bp, Artificial Sequence
  Description of Artificial Sequence: Synthetic coding sequence
atgagctttgtggaggatgtgaccatcggggagggggagagcatccccccagacacccagtttgtgaagacctggaggatccagaacagcggggctgaggcctggcccccaggagtgtgcctgaagtatgtgggcggggaccagtttggacatgtgaacatggtgatggtgcgcagcctggagccccaggagattgctgatgtgtctgtgcagatgtgcagccccagccgggccggcatgtaccagggccagtggaggatgtgcacagccaccggcctgtactatggagatgtgatctgggtgatcctgtctgtggaggtgggcggcctgctgggcgtgacccagcagctgagcagctttgaaacagagttcaacacccagccccacaggaaggtggagggcaacttcaacccctttgccagcccccagaagaaccggcagagtgatgagaacaacctgaaggaccccggcggcagcgagtttgacagcatcagcaagaacacctgggccccagccccagacacctgggccccagccccagaccagacagagcaggaccagaaccggctgagccagaacagcgtgaacctgagccccagcagccacgccaacaacctgtctgtggtgacctacagcaagggcctgcacggcccctaccccttcggccagagctag

SEQ ID NO: 147713 - DNA, 897 bp, Artificial Sequence
  Description of Artificial Sequence: Synthetic coding sequence
atggagggcatggatgtggacctggaccctgagctgatgcagaagttcagctgcctgggcaccacagacaaggatgtgctgatcagcgagttccagaggctgctgggcttccagctgaacccagctggctgtgccttcttcctggacatgaccaactggaacctgcaggccgccatcggggcctactatgactttgagagccccaacatctctgtgcccagcatgagctttgtggaggatgtgaccatcggggagggggagagcatccccccagacacccagtttgtgaagacctggaggatccagaacagcggggctgaggcctggcccccaggagtgtgcctgaagtatgtgggcggggaccagtttggacatgtgaacatggtgatggtgcgcagcctggagccccaggagattgctgatgtgtctgtgcagatgtgcagccccagccgggccggcatgtaccagggccagtggaggatgtgcacagccaccggcctgtactatggagatgtgatctgggtgatcctgtctgtggaggtgggcggcctgctgggcgtgacccagcagctgagcagctttgaaacagagttcaacacccagccccacaggaaggtggagggcaacttcaacccctttgccagcccccagaagaaccggcagagtgatgagaacaacctgaaggaccccggcggcagcgagtttgacagcatcagcaagaacacctgggccccagccccagacacctgggccccagccccagaccagacagagcaggaccagaaccggctgagccagaacagcgtgaacctgagccccagcagccacgccaacaacctgtctgtggtgacctacagcaagggcctgcacggcccctaccccttcggccagagctag

SEQ ID NO: 147714 - DNA, 699 bp, Artificial Sequence
  Description of Artificial Sequence: Synthetic coding sequence
atggagggcatggatgtggacctggaccctgagctgatgcagaagttcagctgcctgggcaccacagacaaggatgtgctgatcagcgagttccagaggctgctgggcttccagctgaacccagctggctgtgccttcttcctggacatgaccaactggaacctgcaggccgccatcggggcctactatgactttgagagccccaacatctctgtgcccagcatgagctttgtggaggatgtgaccatcggggagggggagagcatccccccagacacccagtttgtgaagacctggaggatccagaacagtgatgtgatctgggtgatcctgtctgtggaggtgggcggcctgctgggcgtgacccagcagctgagcagctttgaaacagagttcaacacccagccccacaggaaggtggagggcaacttcaacccctttgccagcccccagaagaaccggcagagtgatgagaacaacctgaaggaccccggcggcagcgagtttgacagcatcagcaagaacacctgggccccagccccagacacctgggccccagccccagaccagacagagcaggaccagaaccggctgagccagaacagcgtgaacctgagccccagcagccacgccaacaacctgtctgtggtgacctacagcaagggcctgcacggcccctaccccttcggccagagctag

SEQ ID NO: 147715 - DNA, 126 bp, Artificial Sequence
  Description of Artificial Sequence: Synthetic coding sequence
atgggagacatctacatcacctggattggctgcggcctggaccggctgcagtgggagaatgtgtctgccatgattgaggaggtgtttgaggccacagacatcaagatcaccgtgtacaccctgtag

SEQ ID NO: 147716 - DNA, 459 bp, Artificial Sequence
  Description of Artificial Sequence: Synthetic coding sequence
atggccagcagcctgaatgaagatcctgagggcagccgcatcacctacgtgaagggggacctgtttgcctgccccaagacagacagcctggcccactgcatcagcgaggactgcaggatgggcgccggcattgctgtgctcttcaagaagaagtttggaggagtgcaggagctgctgaaccagcagaagaagtctggagaggtggccgtgctgaagagagatggccgctacatctactacctgatcaccaagaagagggccagccacaagcccacctatgagaacctgcagaagagcctggaggccatgaagagccactgcctgaagaatggagtgacagacctgtccatgccccgcatcggctgcggcctggaccggctgcagtgggagaatgtgtctgccatgattgaggaggtgtttgaggccacagacatcaagatcaccgtgtacaccctgtag

SEQ ID NO: 147717 - DNA, 459 bp, Artificial Sequence; identical to SEQ ID NO: 147716
  Description of Artificial Sequence: Synthetic coding sequence

SEQ ID NO: 147718 - DNA, 459 bp, Artificial Sequence; identical to SEQ ID NO: 147716
  Description of Artificial Sequence: Synthetic coding sequence

SEQ ID NO: 147719 - DNA, 459 bp, Artificial Sequence; identical to SEQ ID NO: 147716
  Description of Artificial Sequence: Synthetic coding sequence

SEQ ID NO: 147720 - DNA, 396 bp, Artificial Sequence
  Description of Artificial Sequence: Synthetic coding sequence
atggccagcagcctgaatgaagatcctgagggcagccgcatcacctacgtgaagggggacctgtttgcctgccccaagacagacagcctggcccactgcatcagcgaggactgcaggatgggcgccggcattgctgtgctcttcaagaagaagtttggaggagtgcaggagctgctgaaccagcagaagaagtctggagaggtggccgtgctgaagagagatggccgctacatctactacctgatcaccaagaagagggccagccacaagcccacctatgagaacctgcagaagagcctggaggccatgaagagccactgcctgaagaatggagtgacagacctgtccatgccccgcatcggctgcggcctggaccggctgcagtgggagaactag

SEQ ID NO: 147721 - DNA, 1371 bp, Artificial Sequence
  Description of Artificial Sequence: Synthetic coding sequence
atggaggccctgggggacctggagggcccccgggcccctggaggagatgatcctgctggcagcgctggggagaccccaggctggctgagccgggagcaggtgtttgtgctgatctctgctgcctctgtgaacctgggctccatgatgtgctacagcatcctgggccccttcttccccaaggaggccgagaagaagggggccagcaacaccatcatcggcatgatcttcggctgctttgccctgtttgagctgctggccagcctggtgtttggaaactacctggtgcacatcggggccaagttcatgtttgtggccggcatgtttgtgtctgggggcgtgaccatcctgtttggagtgctggacagagtgcctgatggccctgtgttcatcgccatgtgcttcctggtgcgggtgatggatgctgtgtcctttgctgctgccatgacagccagcagcagcatcctggccaaggccttccccaacaacgtggccaccgtgctgggcagcctggagaccttcagcggcctgggcctcatcctgggcccccctgtgggcggcttcctgtaccagagctttggctatgaggtgcccttcatcgtgctgggctgtgtggtgctgctgatggtgcccctgaacatgtacatcctgcccaactatgaaagtgaccctggagagcacagcttctggaagctgattgccctgcccaaggtgggcctcatcgccttcgtcatcaacagcctgagcagctgcttcggcttcctggaccccaccctgagcctgtttgtgctggagaagttcaacctgcctgctggctacgtgggcctggtgttcctgggcatggccctgtcctatgccatcagcagccccctgtttggcctgctgagtgacaagaggcctcccctgaggaagtggctgctggtgtttggaaacctgatcacagctggctgctacatgctgctgggccctgtgcccatcctgcacatcaagagccagctgtggctgctggtgctgatcctggtggtgtctggcctgtctgctggcatgagcatcatccccaccttccctgagatcctgagctgtgcccatgaaaatggatttgaggagggcctgagcaccctgggcctggtgtctggcctcttcagcgccatgtggagcatcggggccttcatgggccccaccctgggcggcttcctgtatgagaagattggatttgagtgggccgccgccatccagggcctgtgggccctgatcagcggcctggccatgggcctcttctacctgctggagtacagcaggaggaagaggagcaagagccagaacatcctgagcacagaggaggagaggaccaccctgctgcccaatgagacctag

SEQ ID NO: 147722 - DNA, 324 bp, Artificial Sequence
  Description of Artificial Sequence: Synthetic coding sequence
atggaggccctgggggacctggagggcccccgggcccctggaggagatgatcctgctggcagcgctggggagaccccaggctggctgagccgggagcaggtgtttgtgctgatctctgctgcctctgtgaacctgggctccatgatgtgctacagcatcctgggccccttcttccccaaggaggccgagaagaagggggccagcaacaccatcatcggcatgatcttcggcttccagttcacctcctggatctgtggcaccagcatccctggctacggcaccgtgctgtgccacctgttcaccaccatctggagccccaagtag

SEQ ID NO: 147723 - DNA, 324 bp, Artificial Sequence; identical to SEQ ID NO: 147722
  Description of Artificial Sequence: Synthetic coding sequence

SEQ ID NO: 147724 - DNA, 711 bp, Artificial Sequence
  Description of Artificial Sequence: Synthetic coding sequence
atgttctgctttgtgcgggtggccggcatcctgggcatctggaagctgagctgcacctactggagcaagatctacgtgtgcagcagaaatgtgtgcctgcggcgcagctacaacagcctgtggggcagcctggagaccttcagcggcctgggcctcatcctgggcccccctgtgggcggcttcctgtaccagagctttggctatgaggtgcccttcatcgtgctgggctgtgtggtgctgctgatggtgcccctgaacatgtacatcctgcccaactatgaaagtgaccctggagagcacagcttctggaagctgattgccctgcccaaggtgggcctcatcgccttcgtcatcaacagcctgagcagctgcttcggcttcctggaccccaccctgagcctgtttgtgctggagaagttcaacctgcctgctggctacgtgggcctggtgttcctgggcatggccctgtcctatgccatcagcagccccctgtttggcctgctgagtgacaagaggcctcccctgaggaagtggctgctggtgtttggaaacctgatcacagctggctgctacatgctgctgggccctgtgcccatcctgcacatcaagagccagctgtggctgctggtgctgatcctggtggtgtctggcctgtctgctggcatgagcatcatccccaccttccctgagatcctgagctgtgcccagtag

SEQ ID NO: 147725 - DNA, 654 bp, Artificial Sequence
  Description of Artificial Sequence: Synthetic coding sequence
atggatgccccccggcgcttccccaccctggtgcagctgatgcagcccaaggccatgcctgtggaggtgctgggccacctgcccaagcgcttctcctggttccacagcgagttcctgaagaaccccaaggtggtgcggctggaggtgtggctggtggagaagatcttcggccggggcggggagcgcatcccccacgtgcagggcatgagccagatcctgattcatgtgaaccggctggaccccaacggggaggccgagatcctggtgtttggccggcccagctaccaggaggacaccatcaagatgatcatgaacctggccgactaccaccggcagctgcaggccaagggcagcggcaaggccctggcccaggatgtggccacccagaaggccgagacccagaggagcagcattgaggtgcgggaggccggcacccagaggtctgtggaggtgcgggaggccggcacccagaggtctgtggaggtgcaggaggtgggcacccagggcagccctgtggaggtgcaggaggccggcacccagcagagcctgcaggccgccaacaagagcggcacccagaggagccctgaggccgccagcaaggctgtgacccagcgcttccgggaggatgcccgggaccctgtgacccggctgtag

SEQ ID NO: 147726 - DNA, 1416 bp, Artificial Sequence
  Description of Artificial Sequence: Synthetic coding sequence
atgcccagcgagacccacgccatgctggccaccctggcccgggtggccgccctgcggaggacctgcctcttcagcggccggggcggcggccggggcctgtggacaggccggccccagagcgacatgaacaacatcaagcccctggagggcgtgaagatcctggacctgaccagggtgctggccggcccctttgccaccatgaacctgggggacctgggcgctgaggtgatcaaggtggagaggcctggagctggagatgacaccaggacctggggccccccatttgtgggcacagagagcacctactacctgtctgtgaacagaaacaagaagagcattgctgtgaacatcaaggaccccaagggcgtgaagatcatcaaggagctggccgctgtgtgtgatgtgtttgtggagaactacgtgcctgggaagctgagcgccatgggcctgggctatgaagatattgatgagatcgccccccacatcatctactgcagcatcaccggctacggccagacaggccccatcagccagagagctggctatgatgctgtggccagcgctgtgtctggcctgatgcacatcaccggcccagaaaatggagaccctgtgcggcctggggtggccatgacagacctggccaccggcctgtatgcctacggggccatcatggccggcctcatccagaagtacaagacaggcaagggcctcttcatcgactgcaacctgctgagcagccaggtggcctgcctgagccacatcgccgccaactacctgattggccagaaggaggccaagcgctggggcacagcccacggcagcatcgtgccctaccaggccttcaagaccaaggatggctacatcgtggtgggcgccggcaacaaccagcagtttgccaccgtgtgcaagatcctggacctgcctgagctgattgacaacagcaagtacaagaccaaccacctgcgggtgcacaacaggaaggagctgatcaagatcctgtctgaaagatttgaggaggagctgaccagcaagtggctgtacctgtttgagggcagcggcgtgccctacggccccatcaacaacatgaagaatgtgtttgctgagccccagaatgctgtgtctggcttccagagcctgctgcacagcctggcccacggccccttcctgcacctgcagggcagcgcccgggtgctgcacaacggcctggtgatggagatggagcaccccaccgtgggcaagatctctgtgcccggccctgctgtgcgctacagcaagttcaagatgtctgaggcccggcccccacccctgctgggccagcacaccacccacatcctgaaggaggtgctgcgctatgatgaccgggccatcggggagctgctgtctgctggggtggtggaccagcacgagacccactag

SEQ ID NO: 147727 - DNA, 1338 bp, Artificial Sequence
  Description of Artificial Sequence: Synthetic coding sequence
atgcccagcgagacccacgccatgctggccaccctggcccgggtggccgccctgcggaggacctgcctcttcagcggccggggcggcggccggggcctgtggacaggccggccccagagcgacatgaacaacatcaagcccctggagggcgtgaagatcctggacctgaccagggtgctggccggcccctttgccaccatgaacctgggggacctgggcgctgaggtgatcaaggtggagaggcctggagctggagatgacaccaggacctggggccccccatttgtgggcacagagagcacctactacctgtctgtgaacagaaacaagaagagcattgctgtgaacatcaaggaccccaagggcgtgaagatcatcaaggagctggccgctgtgtgtgatgtgtttgtggagaactacgtgcctgggaagctgagcgccatgggcctgggctatgaagatattgatgagatcgccccccacatcatctactgcagcatcaccggctacggccagacaggccccatcagccagagagctggctatgatgctgtggccagcgctgtgtctggcctgatgcacatcaccggcccagaaaatggagaccctgtgcggcctggggtggccatgacagacctggccaccggcctgtatgcctacggggccatcatggccggcctcatccagaagtacaagacaggcaagggcctcttcatcgactgcaacctgctgagcagccaggtggcctgcctgagccacatcgccgccaactacctgattggccagaaggaggccaagcgctggggcacagcccacggcagcatcgtgccctaccaggccttcaagaccaaggatggctacatcgtggtgggcgccggcaacaaccagcagtttgccaccgtgtgcaagatcctggacctgcctgagctgattgacaacagcaagtacaagaccaaccacctgcgggtgcacaacaggaaggagctgatcaagatcctgtctgaaagatttgaggaggagctgaccagcaagtggctgtacctgtttgagggcagcggcgtgccctacggccccatcaacaacatgaagaatgtgtttgctgagccccaggtgctgcacaacggcctggtgatggagatggagcaccccaccgtgggcaagatctctgtgcccggccctgctgtgcgctacagcaagttcaagatgtctgaggcccggcccccacccctgctgggccagcacaccacccacatcctgaaggaggtgctgcgctatgatgaccgggccatcggggagctgctgtctgctggggtggtggaccagcacgagacccactag

SEQ ID NO: 147728 - DNA, 609 bp, Artificial Sequence
  Description of Artificial Sequence: Synthetic coding sequence
atgctggccaccctggcccgggtggccgccctgcggaggacctgcctcttcagcggccggggcggcggccggggcctgtggacaggccggccccagagcgacatgaacaacatcaagcccctggagggcgtgaagatcctggacctgaccagggtgctggccggcccctttgccaccatgaacctgggggacctgggcgctgaggtgatcaaggtggagaggcctggagctggagatgacaccaggacctggggccccccatttgtgggcacagagagcacctactacctgtctgtgaacagaaacaagaagagcattgctgtgaacatcaaggaccccaagggcgtgaagatcatcaaggagctggccgctgtgtgtgatgtgtttgtggagaactacgtgcctgggaagctgagcgccatgggcctgggctatgaggacattgatgaaattgccccccacatcatctactgcagcatcacagagaagggcttcagccacgtggcccaggacggcctggacctgcagaccagcagcaacctgcctgccctggtgtcccagagcgctggcatcaccggcatgagccaccgggcctggcccaccagctag

SEQ ID NO: 147729 - DNA, 1194 bp, Artificial Sequence
  Description of Artificial Sequence: Synthetic coding sequence
atgcccagcgagacccacgccatgctggccaccctggcccgggtggccgccctgcggaggacctgcctcttcagcggccggggcggcggccggggcctgtggacaggccggccccagagcgacatgaacaacatcaagcccctggagggcgtgaagatcctggacctgaccagggtgctggccggcccctttgccaccatgaacctgggggacctgggcgctgaggtgatcaaggtggagaggcctggagctggagatgacaccaggacctggggccccccatttgtgggcacagagagcacctactacctgtctgtgaacagaaacaagaagagcattgctgtgaacatcaaggaccccaagggcgtgaagatcatcaaggagctggccgctgtgtgtgatgtgtttgtggagaactacgtgcctgggaagctgagcgccatgggcctgggctatgaagatattgatgagatcgccccccacatcatctactgcagcatcaccggctacggccagacaggccccatcagccagagagctggctatgatgctgtggccagcgctgtgtctggcctgatgcacatcaccggccctgaggtggcctgcctgagccacatcgccgccaactacctgattggccagaaggaggccaagcgctggggcacagcccacggcagcatcgtgccctaccaggccttcaagaccaaggatggctacatcgtggtgggcgccggcaacaaccagcagtttgccaccgtgtgcaagatcctggacctgcctgagctgattgacaacagcaagtacaagaccaaccacctgcgggtgcacaacaggaaggagctgatcaagatcctgtctgaaagatttgaggaggagctgaccagcaagtggctgtacctgtttgagggcagcggcgtgccctacggccccatcaacaacatgaagaatgtgtttgctgagccccaggtgctgcacaacggcctggtgatggagatggagcaccccaccgtgggcaagatctctgtgcccggccctgctgtgcgctacagcaagttcaagatgtctgaggcccggcccccacccctgctgggccagcacaccacccacatcctgaaggaggtgctgcgctatgatgaccgggccatcggggagctgctgtctgctggggtggtggaccagcacgagacccactag

SEQ ID NO: 147730 - DNA, 540 bp, Artificial Sequence
  Description of Artificial Sequence: Synthetic coding sequence
atgcagaggcagaacttccggccccccaccccaccctacccaggccctgggggcggcggctggggcagcggcagcagcttccggggcaccccaggcggcggcggcccccggccccccagccccagagatggctacggcagcccccaccacaccccaccctacggccccaggagccggccctacggcagcagccacagccccaggcatggaggcagcttccctgggggccgcttcggcagccccagccctgggggctacccaggcagctacagccgcagccctgctggcagccagcagcagtttggctacagccctggccagcagcagacccacccccagggcagccccaggaccagcacccccttcggcagcggccgggtgcgggagaagaggatgagcaatgagctggagaactacttcaagcccagcatgctggaggacccctgggccggcctggagcctgtgtctgtggtggacatcagccagcagtacagcaacacccagaccttcaccgggaagaagggccgctacttctgctag

SEQ ID NO: 147731 - DNA, 480 bp, Artificial Sequence
  Description of Artificial Sequence: Synthetic coding sequence
atgaagatcgtggatgagcgggagaagaacctggatgacaaggcctacagaaacatcaaggagctggagaactatgcagagaacacccagagcagcctgctgtacctgaccctggagatcctgggcatcaaggacctgcacgccgaccatgctgccagccacatcggcaaggcccagggcatcgtgacctgcctgcgggccaccccctaccacggcagcaggaggaaggtgttcctgcccatggacatctgcatgctgcatggagtgtcccaggaggacttcctgcggaggaaccaggacaagaatgtgagagatgtgatctatgacatcgccagccaggcccacctgcacctgaagcacgcccgctccttccacaagacagtgcctgtgaaggccttccctgccttcctgcagacagagatcaaggatgctgacacccagggcgtgtgcctggcccagcctgccagcctgggcaagtag

SEQ ID NO: 147732 - DNA, 1002 bp, Artificial Sequence
  Description of Artificial Sequence: Synthetic coding sequence
atggccgccagcgcccacggctctgtgtggggccccctgcggctgggcatccctggcctgtgctgcagaagaccacccctgggcctgtatgccaggatgaggcggctgcccggccctgaggtgtctggccgctctgtggccgccgccagcggccctggggcctggggcacagaccactactgcctggagctgctgaggaagagggactatgagggctacctgtgcagcctgctgctgcctgctgagagccgcagctctgtgtttgccctgcgggccttcaacgtggagctggcccaggtgaaggacagcgtgtctgagaagaccatcggcctgatgaggatgcagttctggaagaagacagtggaggacatctactgtgacaaccccccccaccagcctgtggccatcgagctgtggaaggctgtgaagaggcacaacctgaccaagcgctggctgatgaagatcgtggatgagcgggagaagaacctggatgacaaggcctacagaaacatcaaggagctggagaactatgcagagaacacccagagcagcctgctgtacctgaccctggagatcctgggcatcaaggacctgcacgccgaccatgctgccagccacatcggcaaggcccagggcatcgtgacctgcctgcgggccaccccctaccacggcagcaggaggaaggtgttcctgcccatggacatctgcatgctgcatggagtgtcccaggaggacttcctgcggaggaaccaggacaagaatgtgagagatgtgatctatgacatcgccagccaggcccacctgcacctgaagcacgcccgctccttccacaagacagtgcctgtgaaggccttccctgccttcctgcagacagtgtccctggaggacttcctgaagaagatccagagggtggactttgacatcttccaccccagcctgcagcagaagaacaccctgctgcccctgtacctgtacatccagagctggaggaagacctactag

SEQ ID NO: 147733 - DNA, 846 bp, Artificial Sequence
  Description of Artificial Sequence: Synthetic coding sequence
atgcccatcagcatcagccacagctcctggctggtgcagaggaagagggactatgagggctacctgtgcagcctgctgctgcctgctgagagccgcagctctgtgtttgccctgcgggccttcaacgtggagctggcccaggtgaaggacagcgtgtctgagaagaccatcggcctgatgaggatgcagttctggaagaagacagtggaggacatctactgtgacaaccccccccaccagcctgtggccatcgagctgtggaaggctgtgaagaggcacaacctgaccaagcgctggctgatgaagatcgtggatgagcgggagaagaacctggatgacaaggcctacagaaacatcaaggagctggagaactatgcagagaacacccagagcagcctgctgtacctgaccctggagatcctgggcatcaaggacctgcacgccgaccatgctgccagccacatcggcaaggcccagggcatcgtgacctgcctgcgggccaccccctaccacggcagcaggaggaaggtgttcctgcccatggacatctgcatgctgcatggagtgtcccaggaggacttcctgcggaggaaccaggacaagaatgtgagagatgtgatctatgacatcgccagccaggcccacctgcacctgaagcacgcccgctccttccacaagacagtgcctgtgaaggccttccctgccttcctgcagacagtgtccctggaggacttcctgaagaagatccagagggtggactttgacatcttccaccccagcctgcagcagaagaacaccctgctgcccctgtacctgtacatccagagctggaggaagacctactag

SEQ ID NO: 147734 - DNA, 321 bp, Artificial Sequence
  Description of Artificial Sequence: Synthetic coding sequence
atgaaggccaagaggagccaccaggccgtcatcatgagcaccagcctgcgggtgagccccagcatccacggctaccactttgacacagccagcaggaagaaggctgtgggcaacatctttgaaaatacagaccaggagagcctggagcggctcttcagaaattctggggacaagaaggccgaggagcgggccaagatcatctttgccatcgaccaggatgtggaggagaagacccgggccctgatggccctgaagaagaggaccaaggacaagctgttccagttcctgaagctgaggaagtacagcatcaaggtgcactag

SEQ ID NO: 147735 - DNA, 1185 bp, Artificial Sequence
  Description of Artificial Sequence: Synthetic coding sequence
atggccggggccgccatggccgagcggggccgggtgcccccaccagccccagcccccagcacagagggcctgccccgggccttcctgcagagcctgcggaccctgtttgacatcctggatgacagaagaagaggctgtgtgcacctgcgggagattgagagccgctggcagggcacagatgcccgggagctgccccggggcgtgctggagggcctgcggcaggtggccccagccagcggctacctgacctttgaaagatttgtggccggcctgcggaccagcctgctgtctgcagatggcggcccccgggaccccacccgggccccagcccggcctggggaccagcccccacctccaccccagaggctggtgtttgccccagcagatgagcccaggacagtgctggagaggaagcccctgcccctgggcgtgcgggcccccctggccggccccagcgctgctgcccggagccctgagcagctgtgtgccccagctgaggccgccccctgcccagctgagcctgagaggagccagagcgctgccctggagcccagcagcagcgcagatgctggagctgtggcctgccgggccctggaggccgacagcggagatgcccggcgggccccccgggcccggggggagcggcggcggcacaccatcgccagcggcgtggactgtggcctgctgaagcagatgaaggagctggagcaggagaaggaggtgctgctgcagggcctggagatgatggcccggggccgggactggtaccagcagcagctgcagagggtgcaggagcggcagaggcggctgggccagagccgggccagcgctgactttggagctgctggcagcccccggcccctgggccgcctgctgcccaaggtgcaggaggtggcccgctgcctgggggagctgctggccgccgcctgtgccagccgggccctgccccccagcagcagcggccccccctgcccagccctgaccagcaccagcccccctgtgtggcagcagcagaccatcctgatgctgaaggagcagaaccggctgctgacccaggaggtgacagagaagtctgagcgcatcacccagctggagcaggagaagagcgccctgatcaagcagctgtttgaggcccgggccctgagccagcaggacggcggccccctggacagcaccttcatctag

SEQ ID NO: 147736 - DNA, 1035 bp, Artificial Sequence
  Description of Artificial Sequence: Synthetic coding sequence
atgaggcggccccggcagggcggcggcggggccggcggcagcgctgctgcccgggcccgggccggcggcctgggcggcggctctgtgcctgcccgggcccggggggccccagctgctgcccgggccgcctggctgcgggacctgtgtgccaggatggcccggcccccccggcagcaccctggggtgtgggccagcctgctgctgctgctgctgaccggccctgctgcctgtgccgccagccctgcagatgatggagctggccctgggggccggggcccccggggccgggcccggggggacacaggagcagatgaggccgtgcccaggcatgacagcagctatggcacctttgctggggagttctatgacctgcgctacctgtctgaggagggctaccccttccccacagcccctcctgtggacccctttgccaagatcaaggtggatgactgtgggaagaccaagggctgcttccgctatggcaagccaggctgcaatgctgagacctgtgactacttcctgagctacaggatgattggagcagatgtggagtttgagctgtctgctgacacagatggctgggtggccgtgggcttcagcagtgacaagaagatgggaggagatgatgtgatggcctgtgtgcatgatgacaatggccgggtgcgcatccagcacttctacaacgtgggccagtgggccaaggagatccagaggaacccagccagagatgaggagggcgtgtttgagaacaacagagtgacctgccgcttcaagaggcctgtgaatgtgcccagagatgagaccatcgtggacctgcacctgtcctggtactacctgtttgcctggggccctgccatccagggcagcatcaccaggcatgacatcgacagccccccagccagcgagcgggtggtgtccatctacaagtatgaggacatcttcatgcccagcgctgcctaccagaccttcagcagccccttctgcctgctgctgattgtggccctgaccttctacctgctgatgggcaccccctag

SEQ ID NO: 147737 - DNA, 393 bp, Artificial Sequence
  Description of Artificial Sequence: Synthetic coding sequence
atgagcagcagcggcggggcccctggggccagcgccagcagcgcccccccagcccaggaggagggcatgacctggtggtaccgctggctgtgccgcctgagcggcgtgctgggcgctgtgtcctgtgccatcagcggcctcttcaactgcatcaccatccaccccctgaacattgctgctggggtgtggatgatgatggctgtggtgcccatcgtcatcagcctgaccctgaccaccctgctgggcaatgccatcgcctttgccactggagtgctgtatggcctgagcgccctgggcaagaagggagatgccatctcctatgcccgcatccagcagcagaggcagcaggctgatgaggagaagctggccgagaccctggagggggagctgtag

SEQ ID NO: 147738 - DNA, 519 bp, Artificial Sequence
  Description of Artificial Sequence: Synthetic coding sequence
atgagcagcagcggcggggcccctggggccagcgccagcagcgcccccccagcccaggaggagggcatgacctggtggtaccgctggctgtgccgcctgagcggcgtgctgggcgctgtgtcctgtgccatcagcggcctcttcaactgcatcaccatccaccccctgaacattgctgctggggtgtggatgatcatgaatgccttcatcctgctgctgtgtgaggcccccttctgctgccagttcattgaatttgccaacacagtggccgagaaggtggaccggctgcgctcctggcagaaggctgtgttctactgcggcatggctgtggtgcccatcgtcatcagcctgaccctgaccaccctgctgggcaatgccatcgcctttgccactggagtgctgtatggcctgagcgccctgggcaagaagggagatgccatctcctatgcccgcatccagcagcagaggcagcaggctgatgaggagaagctggccgagaccctggagggggagctgtag

SEQ ID NO: 147739 - DNA, 345 bp, Artificial Sequence
  Description of Artificial Sequence: Synthetic coding sequence
atgctgacagctgctggcagcacagctgagctgagcgcctgtgccatcagcggcctcttcaactgcatcaccatccaccccctgaacattgctgctggggtgtggatgatcatgaatgccttcatcctgctgctgtgtgaggcccccttctgctgccagttcattgaatttgccaacacagtggccgagaaggtggaccggctgcgctcctggcagaaggctgtgttctactgcggcatggctgtggtgcccatcgtcatcagcctgaccctgaccaccctgctgggcaatgccatcgcctttgccactggagtgctgtatggcctgagcgccctgggcaagtag

SEQ ID NO: 147740 - DNA, 489 bp, Artificial Sequence
  Description of Artificial Sequence: Synthetic coding sequence
atgagcagcagcgcccccccagcccaggaggagggcatgacctggtggtaccgctggctgtgccgcctgagcggcgtgctgggcgctgtgtcctgtgccatcagcggcctcttcaactgcatcaccatccaccccctgaacattgctgctggggtgtggatgatcatgaatgccttcatcctgctgctgtgtgaggcccccttctgctgccagttcattgaatttgccaacacagtggccgagaaggtggaccggctgcgctcctggcagaaggctgtgttctactgcggcatggctgtggtgcccatcgtcatcagcctgaccctgaccaccctgctgggcaatgccatcgcctttgccactggagtgctgtatggcctgagcgccctgggcaagaagggagatgccatctcctatgcccgcatccagcagcagaggcagcaggctgatgaggagaagctggccgagaccctggagggggagctgtag

SEQ ID NO: 147741 - DNA, 702 bp, Artificial Sequence
  Description of Artificial Sequence: Synthetic coding sequence
atgagcagcagcggcggggcccctggggccagcgccagcagcgcccccccagcccaggaggagggcatgacctggtggtaccgctggctgtgccgcctgagcggcgtgctgggcgctgtgtcctgtgccatcagcggcctcttcaactgcatcaccatccaccccctgaacattgctgctggggtgtggatgatcatgaatgccttcatcctgctgctgtgtgaggcccccttctgctgccagttcattgaatttgccaacacagtggccgagaaggtggaccggctgcgctcctggcagaaggctgtgttctactgcggcatggctgtggtgcccatcgtcatcagcctgaccctgaccaccctgctgggcaatgccatcgcctttgccactggagtgctgtatggcctgagcgccctgggcaagaaggcccagacagaggccggcagctttgctgcccagcacccccgggagcccggccccttcagcgagggcacccggcaggcctttgccaccccagctgtggtgtctggagagatccgcatgcctgctggggccatgaggagccccatgcctggcagcagcagccggggcagcaggaggatgagaagaagcagcagaagaccctggaggggcagctgtgagggcctgggcgccccacccagcctgagccccctgctggccctgtgtggcagcaagtag

SEQ ID NO: 147742 - DNA, 576 bp, Artificial Sequence
  Description of Artificial Sequence: Synthetic coding sequence
atgagcagcagcggcggggcccctggggccagcgccagcagcgcccccccagcccaggaggagggcatgacctggtggtaccgctggctgtgccgcctgagcggcgtgctgggcgctgtgtcctgtgccatcagcggcctcttcaactgcatcaccatccaccccctgaacattgctgctggggtgtggatgatgatggctgtggtgcccatcgtcatcagcctgaccctgaccaccctgctgggcaatgccatcgcctttgccactggagtgctgtatggcctgagcgccctgggcaagaaggcccagacagaggccggcagctttgctgcccagcacccccgggagcccggccccttcagcgagggcacccggcaggcctttgccaccccagctgtggtgtctggagagatccgcatgcctgctggggccatgaggagccccatgcctggcagcagcagccggggcagcaggaggatgagaagaagcagcagaagaccctggaggggcagctgtgagggcctgggcgccccacccagcctgagccccctgctggccctgtgtggcagcaagtag

SEQ ID NO: 147743 - DNA, 669 bp, Artificial Sequence
  Description of Artificial Sequence: Synthetic coding sequence
atgagcaccctgtgccccccacccagccctgctgtggccaagacagaaattgccctgagcggcaagagccccctgctggccgccacctttgcctactgggacaacatcctgggcccccgggtgcgccacatctgggcccccaagacagagcaggtgctgctgagtgatggagagatcaccttcctggccaaccacaccctgaatggagagatcctgagaaatgctgagagcggggccattgatgtgaagttctttgtgctgtctgagaagggcgtcatcatcgtgtccctcatctttgatggcaactggaatggagacaggagcacctacggcctgagcatcatcctgccccagacagagctgtccttctacctgcccctgcaccgggtgtgtgtggaccggctgacccacatcatcaggaagggccgcatctggatgcacaaggagcggcaggagaatgtgcagaagatcatcctggagggcacagagaggatggaggaccagggccagagcatcatccccatgctgactggagaggtgattcctgtgatggagctgctgagctccatgaagagccacagcgtgcctgaggagattgatattgctgacacagtgctgaatgatgatgacattggagacagctgccacgagggcttcctgctgaagtag

SEQ ID NO: 147744 - DNA, 669 bp, Artificial Sequence; identical to SEQ ID NO: 147743
  Description of Artificial Sequence: Synthetic coding sequence

SEQ ID NO: 147745 - DNA, 1446 bp, Artificial Sequence
  Description of Artificial Sequence: Synthetic coding sequence
atgagcaccctgtgccccccacccagccctgctgtggccaagacagaaattgccctgagcggcaagagccccctgctggccgccacctttgcctactgggacaacatcctgggcccccgggtgcgccacatctgggcccccaagacagagcaggtgctgctgagtgatggagagatcaccttcctggccaaccacaccctgaatggagagatcctgagaaatgctgagagcggggccattgatgtgaagttctttgtgctgtctgagaagggcgtcatcatcgtgtccctcatctttgatggcaactggaatggagacaggagcacctacggcctgagcatcatcctgccccagacagagctgtccttctacctgcccctgcaccgggtgtgtgtggaccggctgacccacatcatcaggaagggccgcatctggatgcacaaggagcggcaggagaatgtgcagaagatcatcctggagggcacagagaggatggaggaccagggccagagcatcatccccatgctgactggagaggtgattcctgtgatggagctgctgagctccatgaagagccacagcgtgcctgaggagattgatattgctgacacagtgctgaatgatgatgacattggagacagctgccacgagggcttcctgctgaatgccatcagcagccacctgcagacctgtggctgcagcgtggtggtgggcagcagcgctgagaaggtgaacaagatcgtgaggaccctgtgcctcttcctgaccccagctgagaggaagtgcagccggctgtgtgaggccgagagcagcttcaagtatgagagcggcctgtttgtgcagggcctgctgaaggacagcacaggcagctttgtgctgcccttccggcaggtgatgtatgccccctaccccaccacccacattgatgtggatgtgaacacagtgaagcagatgccaccctgccacgagcacatctacaaccagaggcgctacatgaggtctgagctgacagccttctggagggccaccagcgaggaggacatggcccaggacaccatcatctacacagatgagagcttcaccccagacctgaacatcttccaggatgtgctgcaccgggacaccctggtgaaggccttcctggaccaggtgttccagctgaagccaggcctgagcctgcggagcaccttcctggcccagttcctgctggtgctgcacaggaaggccctgaccctcatcaagtacattgaagatgacacccagaagggcaagaagcccttcaagagcctgaggaacctgaagattgacctggacctgacagctgagggggacctgaacatcatcatggccctggccgagaagatcaagccaggcctgcacagcttcatcttcggccggcccttctacacctctgtgcaggagagagatgtgctgatgaccttctag

SEQ ID NO: 147746 - DNA, 168 bp, Artificial Sequence
  Description of Artificial Sequence: Synthetic coding sequence
atgcagaaccagagcagcaccaaccaccctggggcctccatgctgatgcacatccacctggacaccagcagcctgaagaccctgcacctgggcaccctcttcttcctgttctacctggccctgacccagaatgaggagaacatctgtgatggcaaggtgaccctgtag

SEQ ID NO: 147747 - DNA, 225 bp, Artificial Sequence
  Description of Artificial Sequence: Synthetic coding sequence
atgcagaaccagagcagcaccaaccaccctggggccagcatcgccctgagccggcccagcctgaacaaggacttccgggaccatgctgagcagcagcacatcgccgcccagcagaaggccgccctgcagcacgcccacgcccacagcagcggctacttcatcacccaggacagcgccttcggcaacctgatcctgcctgtgctgccccggctggaccctgagtag

SEQ ID NO: 147748 - DNA, 168 bp, Artificial Sequence; identical to SEQ ID NO: 147746
  Description of Artificial Sequence: Synthetic coding sequence

SEQ ID NO: 147749 - DNA, 315 bp, Artificial Sequence
  Description of Artificial Sequence: Synthetic coding sequence
atggccgccaacagcagcggccagggcttccagaacaagaacagagtggccatcctggccgagctggacaaggagaagaggaagctgctgatgcagaaccagagcagcaccaaccaccctggggccagcatcgccctgagccggcccagcctgaacaaggacttccgggaccatgctgagcagcagcacatcgccgcccagcagaaggccgccctgcagcacgcccacgcccacagcagcggctacttcatcacccaggacagcgccttcggcaacctgatcctgcctgtgctgccccggctggaccctgagtag

SEQ ID NO: 147750 - DNA, 2190 bp, Artificial Sequence
  Description of Artificial Sequence: Synthetic coding sequence
atgttttctgccctgaagaagctggtgggcagtgaccaggcccctggccgggacaagaacatcccagctggcctgcagagcatgaaccaggccctgcagaggagatttgccaagggcgtgcagtacaacatgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacaggcctcctggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgcccccatctgaggccctgcccccaccagcctgccccagcgccccagccccccggcgcagcatcatcagccggctgtttggcaccagccctgccacagaggccgcccctcctcctcctgagcctgtgcctgctgctgagggccctgccaccgtgcagagcgtggaggactttgtgcctgatgaccggctggacaggagcttcctggaggacaccaccccagccagagatgagaagaaggtgggcgccaaggccgcccagcaggacagcgacagtgatggagaggccctgggcggcaaccccatggtggccggcttccaggatgatgtggacctggaggaccagccccggggcagcccccccctgcctgctggccctgtgcccagccaggacatcaccctgagcagcgaggaggaggccgaggtggccgcccccaccaagggccctgccccagccccccagcagtgcagcgagcctgagaccaagtggagcagcatcccagccagcaagccccggcggggcacagcccccaccaggacagctgccccaccctggccaggaggagtgtctgtgaggacaggccctgagaagaggagcagcacccggcccccagctgagatggagcccgggaagggggagcaggccagcagcagcgagagtgaccctgagggccccatcgccgcccagatgctgagctttgtgatggatgatcctgactttgaaagtgagggcagtgacacccagaggagagcagatgacttccctgtgagagatgaccccagtgatgtgacagatgaagatgagggccctgctgagcccccacctccacccaagctgcccctgcctgccttccggctgaagaatgacagcgacctgtttggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagaggagaagacggcagcagaggcctcccaggagccgggagaggacagctgctgatgagctggaggccttcctgggcggcggggcccctgggggccgccaccctgggggcggggactatgaggagctgtag

SEQ ID NO: 147751 - DNA, 1563 bp, Artificial Sequence
  Description of Artificial Sequence: Synthetic coding sequence
atgttttctgccctgaagaagctggtgggcagtgaccaggcccctggccgggacaagaacatcccagctggcctgcagagcatgaaccaggccctgcagaggagatttgccaagggcgtgcagtacaacatgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacaggcctcctggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgcccccatctgaggccctgcccccaccagcctgccccagcgccccagccccccggcgcagcatcatcagccggcccccaccctggggctggaggctgcggggggccctgggccggcggggccagtggccaccctggggcggcggccgggcctgccactgcctgggccgccacctgcccctgtaccaccggctgtgccgctgccctgtggccgctgtgtgtgccagcgagctggaggaggccggccactggtggagccctggctgggccctgcaggtgctgggcctgcaggcccagtgtgagcccgccctgcaggagggccggggccagctggccagcgcccggctgggcggccaccctggccccctgggcgctgagccccctgtgttcctgagagatgtgacagaggcccaggagggccctgtgcgggtgtgcctgcagaggctgggccggggccgcctggccgtgggctgtgccctgcccaggcacctgctggccctgcgggcccacctgggcccccagcacgcctacggcagcgccagcggccgggagccctag

SEQ ID NO: 147752 - DNA, 2193 bp, Artificial Sequence
  Description of Artificial Sequence: Synthetic coding sequence
atgttttctgccctgaagaagctggtgggcagtgaccaggcccctggccgggacaagaacatcccagctggcctgcagagcatgaaccaggccctgcagaggagatttgccaagggcgtgcagtacaacatgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacagccggcccccaggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgccccccagcgaggccctgcccccaccagcctgccccagcgccccagcccccaggaggagcatcatcagccggctgtttggcaccagccctgccacagaagctgcccctcctcctcctgagcctgtgcctgctgctgagggccctgccaccgtgcagagcgtggaggactttgtgcctgatgaccggctggaccgctccttcctggaggacaccaccccagccagagatgagaagaaggtgggcgccaaggccgcccagcaggacagcgacagtgatggagaggccctgggcggcaaccccatggtggccggcttccaggatgatgtggacctggaggaccagccccggggcagcccccccctgcctgctggccctgtgcccagccaggacatcaccctgagcagcgaggaggaggccgaggtggccgcccccaccaagggccctgccccagccccccagcagtgcagcgagcctgagaccaagtggagcagcatcccagccagcaagccccggcggggcacagcccccaccaggacagctgccccaccctggccaggcggcgtgtctgtgaggactggacctgagaagaggagcagcaccaggcctcctgctgagatggagcctggaaaaggagagcaggccagcagcagcgagagtgaccctgagggccccatcgccgcccagatgctgagctttgtgatggatgatcctgactttgagagcgagggcagtgacacccagaggagagcagatgacttccctgtgagagatgaccccagtgatgtgacagatgaagatgagggccctgctgagcccccacctccacccaagctgcccctgcctgccttccggctgaagaatgacagcgacctgtttggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagaggagaagacggcagcagaggcctcccaggagccgggagaggacagctgctgatgagctggaggccttcctgggcggcggggcccctgggggccgccaccctgggggcggggactatgaggagctgtag

SEQ ID NO: 147753 - DNA, 945 bp, Artificial Sequence
  Description of Artificial Sequence: Synthetic coding sequence
atgttttctgccctgaagaagctggtgggcagtgaccaggcccctggccgggacaagaacatcccagctggcctgcagagcatgaaccaggccctgcagaggagatttgccaagggcgtgcagtacaacatgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacaggcctcctggcagcagctacttccgctatgcagagagctccatgaagaacagctttggcctgaagtacctgcacaagttcttcaacatccccttcctgcagctgcagaaggatgtgcggctggcccaggagcggggctgtgctgtggtgctggtgtctgaggaggtgaggatgcctgctggctgggactgctgctggggccgcctgggctggaaggagggcggcagccagacctgccctgtgcctgccctgctgggccggcccctgctgcctgctgagcccagcccccaccactgggtggactacagcctggagagcagccccctgctgagctgcagcatcccctag

SEQ ID NO: 147754 - DNA, 1566 bp, Artificial Sequence
  Description of Artificial Sequence: Synthetic coding sequence
atgttttctgccctgaagaagctggtgggcagtgaccaggcccctggccgggacaagaacatcccagctggcctgcagagcatgaaccaggccctgcagaggagatttgccaagggcgtgcagtacaacatgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacagccggcccccaggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgccccccagcgaggccctgcccccaccagcctgccccagcgccccagcccccaggaggagcatcatcagccggcccccaccctggggctggaggctgcggggggccctgggcagaagaggccagtggccaccctggggcggcggccgggcctgccactgcctgggccgccacctgcccctgtaccaccggctgtgccgctgccctgtggccgctgtgtgtgccagcgagctggaggaggccggccactggtggagccctggctgggccctgcaggtgctgggcctgcaggcccagtgtgagcccgccctgcaggagggccggggccagctggccagcgcccggctgggcggccaccctggccccctgggcgctgagccccctgtgttcctgagagatgtgacagaggcccaggagggccctgtgcgggtgtgcctgcagaggctgggccggggccgcctggccgtgggctgtgccctgcccaggcacctgctggccctgcgggcccacctgggcccccagcacgcctacggcagcgccagcggccgggagccctag

SEQ ID NO: 147755 - DNA, 1845 bp, Artificial Sequence
  Description of Artificial Sequence: Synthetic coding sequence
atggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggaccggcccccaggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgccccccagcgaggccctgcccccaccagcctgccccagcgccccagcccccaggaggagcatcatcagccggctgtttggcaccagccctgccacagaagctgcccctcctcctcctgagcctgtgcctgctgctgagggccctgccaccgtgcagagcgtggaggactttgtgcctgatgaccggctggaccgctccttcctggaggacaccaccccagccagagatgagaagaaggtgggcgccaaggccgcccagcaggacagcgacagtgatggagaggccctgggcggcaaccccatggtggccggcttccaggatgatgtggacctggaggaccagccccggggcagcccccccctgcctgctggccctgtgcccagccaggacatcaccctgagcagcgaggaggaggccgaggtggccgcccccaccaagggccctgccccagccccccagcagtgcagcgagcctgagaccaagtggagcagcatcccagccagcaagccccggcggggcacagcccccaccaggacagctgccccaccctggccaggcggcgtgtctgtgaggactggacctgagaagaggagcagcaccaggcctcctgctgagatggagcctggaaaaggagagcaggccagcagcagcgagagtgaccctgagggccccatcgccgcccagatgctgagctttgtgatggatgatcctgactttgagagcgagggcagtgacacccagaggagagcagatgacttccctgtgagagatgaccccagtgatgtgacagatgaagatgagggccctgctgagcccccacctccacccaagctgcccctgcctgccttccggctgaagaatgacagcgacctgtttggcctgggcctggaggaggccggccccaaggagagcagcgaggagggcaaggagggcaagacccccagcaaggagaagaagaagaagaagaagaagggcaaggaggaggaggagaaggccgccaagaagaagagcaagcacaagaagagcaaggacaaggaggagggcaaggaggagaggagaagacggcagcagaggcctcccaggagccgggagaggacagctgctgatgagctggaggccttcctgggcggcggggcccctgggggccgccaccctgggggcggggactatgaggagctgtag

SEQ ID NO: 147756 - DNA, 678 bp, Artificial Sequence
  Description of Artificial Sequence: Synthetic coding sequence
tgagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggaccggcccccaggcagcagctacttccgctatgcagagagctccatgaagaacagctttggcctgaagtacctgcacaagttcttcaacatccccttcctgcagctgcagaaggatgtgcggctggcccaggagcggggctgtgctgtggtgctggtgtctgaggaggtgaggatgcctgctggctgggactgctgctggggccgcctgggctggaaggagggcggcagccagacctgccctgtgcctgccctgctgggccggcccctgctgcctgctgagcccagcccccaccactgggtggactacagcctggagagcagccccctgctgagctgcagcatcccctag

SEQ ID NO: 147757 - DNA, 1416 bp, Artificial Sequence
  Description of Artificial Sequence: Synthetic coding sequence
atgacagtgggcaccgtgaagatcgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacaggcctcctggcagcagctacttccgctatgcagagagctccatgaagaacagctttggcctgaagtacctgcacaagttcttcaacatccccttcctgcagctgcagcgggagaccctgctgcggcagctggagaccaaccagctggacatggatgccaccctggaggagctgtctgtgcagcaggagacagaggaccagaactacggcatcttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgcccccatctgaggccctgcccccaccagcctgccccagcgccccagccccccggcgcagcatcatcagccggctgtttggcaccagccctgccacagaggccgcccctcctcctcctgagcctgtgcctgctgctgagggccctgccaccgtgcagagcgtggaggactttgtgcctgatgaccggctggacaggagcttcctggaggacaccaccccagccagagatgagaagaaggtgggcgccaaggccgcccagcaggacagcgacagtgatggagaggccctgggcggcaaccccatggtggccggcttccaggatgatgtggacctggaggaccagccccggggcagcccccccctgcctgctggccctgtgcccagccaggacatcaccctgagcagcgaggaggaggccgaggtggccgcccccaccaagggccctgccccagccccccagcagtgcagcgagcctgagaccaagtggagcggggaggcccagcagcaccaggccccctgctag

SEQ ID NO: 147758 - DNA, 1347 bp, Artificial Sequence
  Description of Artificial Sequence: Synthetic coding sequence
atgagccaccgggcctggctggccctgctgcccctggaggtggatggagatgatggcctgtgtggggccggcggccctgagcacagcggcagcagccagccccagcagcagcagcagagggccccctgccacctgcgggccagcggccggggccgcggggcccggctgctgacccggctgctgcccttctccttcctggagatgatggaggcccggagccggggccacgccagccccctggccgccaacggccagagccccagccctggcagccagagccctgtggtgcctgctggagctgtgtccacaggcagcagcagccctggcaccccccagcctgccccccagctgcccctgaatgctgccccacccagctctgtgccccctgtgcccccatctgaggccctgcccccaccagcctgccccagcgccccagccccccggcgcagcatcatcagccggctgtttggcaccagccctgccacagaggccgcccctcctcctcctgagcctgtgcctgctgctgagggccctgccaccgtgcagagcgtggaggactttgtgcctgatgaccggctggacaggagcttcctggaggacaccaccccagccagagatgagaagaaggtgggcgccaaggccgcccagcaggacagcgacagtgatggagaggccctgggcggcaaccccatggtggccggcttccaggatgatgtggacctggaggaccagccccggggcagcccccccctgcctgctggccctgtgcccagccaggacatcaccctgagcagcgaggaggaggccgaggtggccgcccccaccaagggccctgccccagccccccagcagtgcagcgagcctgagaccaagtggagcagcatcccagccagcaagccccggcggggcacagcccccaccaggacagctgccccaccctggccaggaggagtgtctgtgaggacaggccctgagaagaggagcagcacccggcccccagctgagatggagcccgggaagggggagcaggccagcagcagcgagagtgaccctgagggccccatcgccgcccagatgctgagctttgtgatggatgatcctgactttgaaagtgagggcagtgacacccagaggagagcagatgacttccctgtgagagatgaccccagtgatgtgacagatgaagatgagggccctgctgagcccccacctccacccaagctgcccctgcctgccttccggctgaagaatgacagcgacctgtttggcctgggcctggaggaggccggccccaaggagagcagcgaggagggcaaggagggcaagacccccagcaaggagaagtag

SEQ ID NO: 147759 - DNA, 648 bp, Artificial Sequence
  Description of Artificial Sequence: Synthetic coding sequence
tgaaaaattgtcatccggggggacaggaacacaggcaagacagccctgtggcaccggctgcagggccggccctttgtggaggagtacatccccacccaggagatccaggtgaccagcatccactggagctacaagaccacagatgacatcgtgaaggtggaggtgtgggatgtggtggacaagggcaagtgcaagaagagaggagatggcctgaagatggagaatgacccccaggaggccgagagcgagatggccctggatgctgagttcctggatgtgtacaagaactgcaatggagtggtgatgatgtttgacatcaccaagcagtggaccttcaactacatcctgcgggagctgcccaaggtgcccacccacgtgcctgtgtgtgtgctgggcaactacagagacatgggagagcacagggtcatcctgcctgatgatgtgcgggacttcatcgacaacctggacagcaggcctcctggcagcagctacttccgctatgcagagagctccatgaagaacagctttggcctgaagtacctgcacaagttcttcaacatccccttcctgcagctgcaggtgtccacccaccacgtgggctggagcggctgctggagcctgaccagcttccaggtgtcccctgtgtag

SEQ ID NO: 147760 - DNA, 336 bp, Artificial Sequence
  Description of Artificial Sequence: Synthetic coding sequence
atgtacagccgcctcttctacctgaagagcagctacatcatctactttgagcccctcttcagcaatgccatcatcaacatcctgtccttcatcaacagcctggccagccccctgaccatcttctgctttgccctgagcgcccaggccctgagcaccatcttctacttccgcatcttcatcttcatcttccacagctggatcctgctcttccacttctacttcacctgcagcttcaagacctatgagcaccagcacagcaagatggtgcctgcctacaggatgcagagcccccgggccctgcccaggacctacctgtatgtgtggccctacaagtag

SEQ ID NO: 147761 - DNA, 342 bp, Artificial Sequence
  Description of Artificial Sequence: Synthetic coding sequence
atgaacttctacctgctgctggccagcagcatcctgtgtgccctgattgtgttctggaagtaccgccgcttccagaggaacacaggagagatgagcagcaacagcacagccctggccctggtgcggcccagcagcagcggcctcatcaacagcaacacagacaacaacctggccgtgtatgacctgagccgggacatcctgaacaacttcccccacagcatcgcccggcagaagaggatcctggtgaacctgtccatggtggagaacaagctggtggagctggagcacaccctgctgagcaagggcttccggggggccagcccccacaggaagagcacctag

SEQ ID NO: 147762 - DNA, 2853 bp, Artificial Sequence
  Description of Artificial Sequence: Synthetic coding sequence
atgacctggaggatgggcccccgcttcaccatgctgctggccatgtggctggtgtgtggcagcgagccccacccccacgccaccatccggggcagccatggaggcaggaaggtgcccctggtgtccccagacagcagcaggcctgcccgcttcctgcggcacacaggccgcagccggggcatcgagaggagcaccctggaggagcccaacctgcagcccctgcagaggagaagatctgtgcctgtgctgcggctggcccggcccacagagcccccagcccggagtgacatcaacggggctgctgtgcggcctgagcagaggcctgctgcccggggcagcccccgggagatgatcagagatgagggcagcagcgcccggagcaggatgctgcgcttccccagcggcagcagcagccccaacatcctggccagctttgctgggaagaacagagtgtgggtgatcagcgccccccacgccagcgagggctactaccgcctgatgatgagcctgctgaaggatgatgtgtactgtgagctggccgagcggcacatccagcagatcgtgctcttccaccaggccggggaggagggcggcaaggtgcggcgcatcaccagcgagggccagatcctggagcagcccctggaccccagcctcatccccaagctgatgtccttcctgaagctggagaagggcaagtttggcatggtgctgctgaagaagaccctgcaggtggaggagcgctacccctaccctgtgcggctggaggccatgtatgaggtgattgaccagggccccatcagaagaattgagaagatccggcagaagggctttgtgcagaagtgcaaggccagcggcgtggagggccaggtggtggccgagggcaatgatggcggcggcggggccggccggcccagcctgggcagcgagaagaagaaggaggacccccggcgggcccaggtgccccccacccgggagagccgggtgaaggtgctgaggaagctggccgccacagccccagccctgccccagccccccagcaccccccgggccaccaccctgcccccagccccagccaccaccgtgaccaggagcaccagcagagctgtgacagtggccgcccggcccatgaccaccacagccttccccaccacccagaggccctggacccccagccccagccaccggccccccaccaccacagaggtgatcacagcccggcggcccagcgtgtctgagaacctgtacccacccagcaggaaggaccagcaccgggagcggccccagaccacccggcggcccagcaaggccaccagcctggagagcttcaccaatgccccacccaccaccatcagcgagcccagcaccagggctgctggccctggccgcttccgggacaacaggatggaccggcgggagcacggccaccgggaccccaacgtggtgcccggcccccccaagccagccaaggagaagccacccaagaagaaggcccaggacaagatcctgagcaatgaatatgaggagaagtatgacctgagccggcccacagccagccagctggaggatgagctgcaggtgggcaatgtgcccctgaagaaggccaaggagagcaagaagcatgagaagctggagaagccagagaaggagaagaagaagaagatgaagaatgaaaatgctgacaagctgctgaagtctgagaagcagatgaagaagtctgagaagaagagcaagcaggagaaggagaagagcaagaagaagaagggcggcaagacagagcaggacggctaccagaagcccaccaacaagcacttcacccagagccccaagaagtctgtggccgacctgctgggcagctttgagggcaagaggcggctgctgctgatcacagcccccaaggccgagaacaacatgtatgtgcagcagagagatgagtacctggagagcttctgcaagatggccaccaggaagatcagcgtcatcaccatctttggacctgtgaacaacagcaccatgaagattgaccacttccagctggacaatgagaagcccatgagggtggtggatgatgaggacctggtggaccagaggctcatcagcgagctgaggaaggagtatggcatgacctacaatgacttcttcatggtgctgacagatgtggacctgcgggtgaagcagtactatgaggtgcccatcaccatgaagtctgtgtttgacctgattgacaccttccagagccgcatcaaggacatggagaagcagaagaaggagggcatcgtgtgcaaggaggacaagaagcagagcctggagaacttcctgagccgcttccgctggaggcggcggctgctggtgatcagcgccccaaatgatgaggactgggcctacagccagcagctgagcgccctgagcggccaggcctgcaactttggcctgcggcacatcaccatcctgaagctgctgggcgtgggggaggaggtgggcggcgtgctggagctgttccccatcaatggcagctctgtggtggagagagaagatgtgcctgcccacctggtgaaggacatccggaactacttccaggtgtccccagagtacttctccatgctgctggtgggcaaggatggaaatgtgaagtcctggtaccccagccccatgtggagcatggtgattgtgtatgacctgattgacagcatgcagctgcggcggcaggagatggccatccagcagagcctgggcatgcgctgcccagaagatgaatatgccggctacggctaccacagctaccaccagggctaccaggacggctaccaggatgactaccgccaccacgagagctaccaccacggctacccctactag

SEQ ID NO: 147763 - DNA, 744 bp, Artificial Sequence
  Description of Artificial Sequence: Synthetic coding sequence
atgctgctgctgcccctgcccctgctgctcttcctgctgtgcagcagagctgaggccggggagatcattggaggaacagagtgcaagccccacagccggccctacatggcctacctggagatcgtgaccagcaatggccccagcaagttctgtggcggcttcctgatcagaagaaactttgtgctgacagctgcccactgtgccggccgcagcatcaccgtgaccctgggcgcccacaacatcacagaggaggaggacacctggcagaagctggaggtgatcaagcagttccgccaccccaagtacaacaccagcaccctgcaccacgacatcatgctgctgaagctgaaggagaaggccagcctgaccctggccgtgggcaccctgcccttccccagccagttcaactttgtgcccccaggccgcatgtgccgggtggccggctggggccgcactggagtgctgaagccaggcagtgacaccctgcaggaggtgaagctgcggctgatggacccccaggcctgcagccacttccgggactttgaccacaacctgcagctgtgtgtgggcaaccccaggaagaccaagagcgccttcaagggggacagcggcggccccctgctgtgtgccggcgtggcccagggcatcgtgtcctatggccgcagtgatgccaagcccccagctgtgttcacccgcatcagccactaccggccctggatcaaccagatcctgcaggccaactag

SEQ ID NO: 147764 - DNA, 210 bp, Artificial Sequence
  Description of Artificial Sequence: Synthetic coding sequence
atgctgggcatcaccgtgctggccgccctgctggcctgtgccaccccaggccccaccgtgtggccctgggagaggaccacctggcgctggaagaccaagaaggacccctgcctgtgggtgtggacccccagcaccagcaccagagatggcatgcccagctgctgtgccatgatcctgcccagcagcagcctgcagagcatgtggagctag

SEQ ID NO: 147765 - DNA, 807 bp, Artificial Sequence
  Description of Artificial Sequence: Synthetic coding sequence
atgctgggcatcaccgtgctggccgccctgctggcctgtgccagcagctgtggggtgcccagcttcccccccaacctgagcgcccgggtggtgggcggggaggatgcccggccccacagctggccctggcagatcagcctgcagtacctgaagaatgacacctggaggcacacctgtggcggcaccctcatcgccagcaactttgtgctgacagctgcccactgcatcagcaacaccaggacctacagagtggccgtgggcaagaacaacctggaggtggaggatgaggagggcagcctgtttgtgggcgtggacaccatccacgtgcacaagcgctggaatgccctgctgctgagaaatgacatcgccctgatcaagctggccgagcacgtggagctgagtgacaccatccaggtggcctgcctgcctgagaaggacagcctgctgcccaaggactacccctgctacgtgacaggctggggccgcctgtggaccaacggccccatcgctgacaagctgcagcagggcctgcagcctgtggtggaccacgccacctgcagcagaattgactggtggggcttccgggtgaagaagaccatggtgtgtgctggaggagatggagtcatcagcgcctgcaatggagacagcggcggccccctgaactgccagctggagaatggctcctgggaggtgtttggcatcgtgtcctttggcagccggcggggctgcaacaccaggaagaagcctgtggtgtacaccagggtgtctgcctacatcgactggatcaatgagaagatgcagctgtag

SEQ ID NO: 147766 - DNA, 795 bp, Artificial Sequence
  Description of Artificial Sequence: Synthetic coding sequence
atgctgctgctgagcctgaccctgagcctggtgctgctgggcagctcctggggctgcggcatcccagccatcaagccagccctgtccttcagccagagaattgtgaatggagaaaatgctgtgctgggctcctggccctggcaggtgtccctgcaggacagcagcggcttccacttctgtggcggcagcctcatcagccagagctgggtggtgacagctgcccactgcaatgtgtccccaggccgccactttgtggtgctgggggagtatgacaggagcagcaatgctgagcccctgcaggtgctgtctgtgtcccgggccatcacccaccccagctggaacagcaccaccatgaacaatgatgtgaccctgctgaagctggccagccctgcccagtacaccacccgcatcagccctgtgtgcctggccagcagcaatgaggccctgacagagggcctgacctgtgtgaccaccggctggggccgcctgagcggcgtgggcaatgtgaccccagcccacctgcagcaggtggccctgcccctggtgacagtgaaccagtgccggcagtactggggcagcagcatcacagacagcatgatctgtgccggcggggccggggccagcagctgccagggcgacagcggcggccccctggtgtgccagaagggcaacacctgggtgctgattggaattgtgtcctggggcaccaagaactgcaatgtgcgggccccagctgtgtacaccagggtgtccaagttcagcacctggatcaaccaggtgattgcctacaactag

SEQ ID NO: 147767 - DNA, 795 bp, Artificial Sequence; identical to SEQ ID NO: 147766
  Description of Artificial Sequence: Synthetic coding sequence

SEQ ID NO: 147768 - DNA, 792 bp, Artificial Sequence
  Description of Artificial Sequence: Synthetic coding sequence
atggccagcctgtggctgctgagctgcttcagcctggtgggcgccgccttcggctgcggcgtgcctgccatccaccctgtgctgagcggcctgagccgcatcgtgaatggagaagatgctgtgcccggctcctggccctggcaggtgtccctgcaggacaagacaggcttccacttctgtggcggcagcctcatcagcgaggactgggtggtgacagctgcccactgcggcgtgaggaccagtgatgtggtggtggccggggagtttgaccagggcagtgatgaggagaacatccaggtgctgaagatcgccaaggtgttcaagaaccccaagttcagcatcctgactgtgaacaatgacatcaccctgctgaagctggccaccccagcccgcttcagccagacagtgtctgctgtgtgcctgcccagcgcagatgatgacttccctgctggcaccctgtgtgccaccaccggctggggcaagaccaagtacaatgccaacaagaccccagacaagctgcagcaggccgccctgcccctgctgagcaatgctgagtgcaagaagtcctggggccgccgcatcacagatgtgatgatctgtgccggggccagcggcgtgagcagctgcatgggagacagcggcggccccctggtgtgccagaaggatggagcctggaccctggtgggcatcgtgtcctggggcagtgacacctgcagcaccagcagccctggggtgtatgcccgggtgaccaagctgatcccctgggtgcagaagatcctggccgccaactag

SEQ ID NO: 147769 - DNA, 1119 bp, Artificial Sequence
  Description of Artificial Sequence: Synthetic coding sequence
atggccgcccctgtgccctgggcctgctgtgctgtgctggccgctgctgctgctgtggtgtatgcccagaggcacagcccccaggaggccccccacgtgcagtatgagcggctgggcagtgatgtgaccctgccctgtggcacagccaactgggatgctgctgtgacctggagggtgaatggaacagacctggccccagacctgctgaatggcagccagctggtgctgcacggcctggagctgggccacagcggcctgtatgcctgcttccaccgggacagctggcacctgcggcaccaggtgctgctgcacgtgggcctgcccccccgggagcctgtgctgagctgccgcagcaacacctaccccaagggcttctactgctcctggcacctgcccacccccacctacatccccaacaccttcaacgtgacagtgctgcacggcagcaagatcatggtgtgtgagaaggaccctgccctgaagaaccgctgccacatccgctacatgcacctgttcagcaccatcaagtacaaggtgtccatctctgtgtccaatgccctgggccacaatgccacagccatcacctttgatgagttcaccatcgtgaagccagaccccccagaaaatgtggtggcccggcctgtgcccagcaacccccggcggctggaggtgacctggcagacccccagcacctggccagaccctgagagcttccccctgaagttcttcctgcgctaccggcccctcatcctggaccagtggcagcacgtggagctgagtgatggaacagcccacaccatcacagatgcctatgctgggaaggagtacatcatccaggtggccgccaaggacaatgaaattggcacctggagcgactggagcgtggccgcccacgccaccccctggacagaggagcccaggcacctgaccacagaggcccaggccgctgagaccaccaccagcaccaccagcagcctggcccccccacccaccaccaagatctgtgaccctggagagctgggcagcggcggcggccccagcgcccccttcctggtgtctgtgcccatcaccctggccctggccgctgctgctgccacagccagcagcctgctgatctag

SEQ ID NO: 147770 - DNA, 1119 bp, Artificial Sequence; identical to SEQ ID NO: 147769
  Description of Artificial Sequence: Synthetic coding sequence

SEQ ID NO: 147771 - DNA, 771 bp, Artificial Sequence
  Description of Artificial Sequence: Synthetic coding sequence
atggccgcccctgtgccctgggcctgctgtgctgtgctggccgctgctgctgctgtggtgtatgcccagaggcacagcccccaggaggccccccacgtgcagtatgagcggctgggcagtgatgtgaccctgccctgtggcacagccaactgggatgctgctgtgacctggagggtgaatggaacagacctggccccagacctgctgaatggcagccagctggtgctgcacggcctggagctgggccacagcggcctgtatgcctgcttccaccgggacagctggcacctgcggcaccaggtgctgctgcacgtgggcctgcccccccgggagcctgtgctgagctgccgcagcaacacctaccccaagggcttctactgctcctggcacctgcccacccccacctacatccccaacaccttcaacgtgacagtgctgcacggcagcaagatcatggtgtgtgagaaggaccctgccctgaagaaccgctgccacatccgctacatgcacctgttcagcaccatcaagtacaaggtgtccatctctgtgtccaatgccctgggccacaatgccacagccatcacctttgatgagttcaccatcgtgaagccagaccccccagaaaatgtggtggcccggcctgtgcccagcaacccccggcggctggaggtgacctggcagacccccagcacctggccagaccctgagagcttccccctgaagttcttcctgcgctaccggcccctcatcctggaccagtggcagcactag

SEQ ID NO: 147772 - DNA, 3909 bp, Artificial Sequence
  Description of Artificial Sequence: Synthetic coding sequence
atggagctgtactttggagagtaccagcacgtgcagcaggagtatggagtgcacctgcggctggccagtgatgacacccagaagagccgcagcagccagaacagcaaggccggcagctatggagtgtccatccgggtgcagggcattgatggccacccctacatcgtgctgaacaacacagagcgctgcctggccggcaccagcttctctgaaaatggcccccccttccccccacctgtgatcaacaacctgcccctgcacagcagcaatggatctgtgcccaaggagaacagcgaggagctgcagctgcctgagaacccctatgcccagcccagccccatccggaacctgaagcagcccctgctgcacgagggcaagaatggagtgctggacaggaaggatggctctgtgaagcccagccacctgctgaacttccagaggcaccctgagctgctgcagccctatgaccctgagaagaatgagctgaacctgcagaaccaccagcccagcgagagcaactggctgaagaccctgacagaggagggcatcaacaacaagaagccctggacctgcttccccaagcccagcaacagccagcccaccagccccagcctggaggaccctgccaagtctggagtgacagccatccggctgtgcagctctgtggtgattgaggaccccaagaagcagacctctgtgtgtgtgaatgtgcagagctgcaccaaggagcgggtgggggaggaggccctcttcaccagcggccggcccctgacagcccacagcccccacgcccaccctgagaccaagaagaccaggccagatgtgctgcccttccggcggcaggacagcgctggccctgtgctggatggagcccggagccgccgcagcagcagcagcagcaccacccccaccagcgccaacagcctgtaccgcttcctgctggatgaccaggagtgtgccatccatgctgacaacgtgaacagacatgagaacagacgctacatccccttcctgcccggcaccggccgggacatcgacaccggcagcatccctggggtggaccagctgattgagaagtttgaccagaagccaggcctgcagaggcggggccgcagcggcaagaggaaccgcatcaacacagatgacaggaagaggagccgctctgtggacagcgccttccccttcggcctgcagggcaacagcgagtacctgattgagttcagcaggaacctgggcaagagcagcgagcacctgctgcggcccagccaggtgtgcccccagaggcccctgagccaggagcggcggggcaagcagagcgtgggccgcacctttgccaagctgcagggcgccgcccacggggccagctgtgcccacagcaggcctccccagcccaacattgatggcaaggtgctggagacagagggcagccaggagagcaccgtcatccgggcccccagcctgggcgcccagagcaagaaggaggaggaggtgaagacagccacagccaccctgatgctgcagaacagagccacagccaccagcccagattctggggccaagaagatctctgtgaagaccttccccagcgccagcaacacccaggccaccccagacctgctgaagggccagcaggagctgacccagcagaccaatgaggagacagccaagcagatcctgtacaactacctgaaggagggcagcacagacaatgatgatgccaccaagaggaaggtgaacctggtgtttgagaagatccagaccctgaagagcagagctgctggcagcgcccagggcaacaaccaggcctgcaacagcaccagcgaggtgaaggacctgctggagcagaagagcaagctgaccatcgaggtggccgagctgcagaggcagctgcagctggaggtgaagaaccagcagaacatcaaggaggagcgggagaggatgagggccaacctggaggagctgcggagccagcacaatgagaaggtggaggagaacagcaccctgcagcagaggctggaggagagcgagggggagctgaggaagaacctggaggagctgttccaggtgaagatggagcgggagcagcaccagacagagatccgggacctgcaggaccagctgtctgagatgcatgatgagctggacagcgccaagagaagtgaagatcgggagaagggggccctgattgaggagctgctgcaggccaagcaggacctgcaggacctgctgattgccaaggaggagcaggaggacctgctgaggaagcgggagcgggagctgacagccctgaagggggccctgaaggaggaggtgagcagccatgaccaggagatggacaagctgaaggagcagtatgatgctgagctgcaggccctgcgggagagcgtggaggaggccaccaagaatgtggaggtgctggccagccgcagcaacaccagcgagcaggaccaggccggcacagagatgagggtgaagctgctgcaggaggagaatgagaagctgcagggccgctctgaggagctggagaggagagtggcccagctgcagaggcagatcgaggacctgaagggagatgaggccaaggccaaggagaccctgaagaagtatgaaggagagatccggcagctggaggaggccctggtgcacgccaggaaggaggagaaggaggccgtgtctgcccggcgggccctggagaatgagctggaggccgcccagggcaacctgagccagaccacccaggagcagaagcagctgtctgagaagctgaaggaggagagcgagcagaaggagcagctgcggcggctgaagaatgagatggagaatgaacgctggcacctgggcaagaccatcgagaagctgcagaaggagatggctgacatcgtggaggccagcaggaccagcaccctggagctgcagaaccagctggatgagtacaaggagaagaacagaagagagctggccgagatgcagaggcagctgaaggagaagaccctggaggccgagaagagccggctgacagccatgaagatgcaggatgagatgaggctgatggaggaggagctgcgggactaccagagggcccaggatgaggccctgaccaagaggcagctgctggagcagaccctgaaggacctggagtatgagctggaggccaagagccacctgaaggatgacaggagccggctggtgaagcagatggaggacaaggtgtcccagctggagatggagctggaggaggagaggaacaacagcgacctgctgtctgagcgcatcagccgcagccgggagcagatggagcagctgagaaatgagctgctgcaggagcgggccgcccggcaggacctggagtgtgacaagatcagcctggagcggcagaacaaggacctgaagagccgcatcatccacctggagggcagctaccgcagcagcaaggagggcctggtggtgcagatggaggccagaattgctgagctggaggaccggctggagagcgaggagcgggaccgggccaacctgcagctgagcaacagaaggctggagaggaaggtgaaggagctggtgatgcaggtggatgatgagcacctgagcctgacagaccagaaggaccagctgagcctgcggctgaaggccatgaagaggcaggtggaggaggccgaggaggagattgaccggctggagagcagcaagaagaagctgcagcgggagctggaggagcagatggacatgaatgagcacctgcagggccagctgaacagcatgaagaaggacctgcggctgaagaagctgcccagcaaggtgctggatgacatggatgatgatgatgacctgagcacagatggcggcagcctgtatgaggcccctgtgtcctacaccttcagcaaggacagcacagtggccagccagatctag

SEQ ID NO: 147773 - DNA, 2061 bp, Artificial Sequence
  Description of Artificial Sequence: Synthetic coding sequence
atgggagagttcaaggtgcaccgggtgcgcttcttcaactacgtgcccagcggcatccgctgtgtggcctacaacaaccagagcaaccggctggccgtgtccaggacagatggcaccgtggagatctacaacctgagcgccaactacttccaggagaagttcttccctggccacgagagccgggccacagaggccctgtgctgggccgagggccagaggctcttctctgctggcctgaatggagagatcatggagtatgacctgcaggccctgaacatcaagtatgccatggatgccttcggcggccccatctggagcatggccgccagccccagcggcagccagctgctggtgggctgtgaagatggctctgtgaagctgttccagatcaccccagacaagatccagtttgaaagaaactttgaccggcagaagagccgcatcctgagcctgtcctggcaccccagcggcacccacatcgccgccggcagcattgactacatctctgtgtttgatgtgaagagcggcagcgctgtgcacaagatgattgtggaccggcagtacatgggcgtgtccaagaggaaatgtattgtgtggggcgtggccttcctgagtgatggcaccatcatctctgtggacagcgctgggaaggtgcagttctgggacagcgccaccggcaccctggtgaagagccacctgattgccaatgctgatgtgcagagcattgctgtggccgaccaggaggacagctttgtggtgggcacagctgagggcaccgtcttccacttccagctggtgcctgtgaccagcaacagcagcgagaagcagtgggtgaggaccaagcccttccagcaccacacccatgatgtgaggacagtggcccacagccccacagccctgatcagcggcggcacagacacccacctggtgttccggcccctgatggagaaggtggaggtgaagaactatgatgctgccctgaggaagatcaccttcccccaccgctgcctgatcagctgcagcaagaagaggcagctgctgctcttccagtttgcccaccacctggagctgtggaggctgggcagcacagtggccaccgggaagaatggagacaccctgcccctgagcaagaatgctgaccacctgctgcacctgaagaccaagggccctgagaacatcatctgcagctgcatcagcccctgtggctcctggatcgcctacagcacagtgagccgcttcttcctgtaccgcctgaactatgaacatgacaacatcagcctgaagagggtgtccaagatgcctgccttcctgcggagcgccctgcagatcctcttcagcgaggacagcaccaagctgtttgtggccagcaaccagggcgccctgcacatcgtgcagctgagcggcggcagcttcaagcacctgcacgccttccagccccagagcggcaccgtggaggccatgtgcctgctggccgtgtccccagatggcaactggctggccgccagcggcaccagcgctggggtgcacgtgtacaacgtgaagcagctgaagctgcactgcaccgtgcctgcctacaacttccctgtgacagccatggccatcgcccccaacaccaacaacctggtgattgcccacagcgaccagcaggtgtttgagtacagcatcccagacaagcagtacacagactggagcaggacagtgcagaagcagggcttccaccacctgtggctgcagagggacacccccatcacccacatctccttccaccccaagaggcccatgcacatcctgctgcatgatgcctacatgttctgcatcatcgacaagagcctgcccctgcccaatgacaagaccctgctgtacaaccccttcccccccaccaatgaaagtgatgtgatcagaagaagaacagcccacgccttcaagatcagcaagatctacaagcccctgctcttcatggacctgctggatgagaggaccctggtggccgtggagcggcccctggatgacatcatcgcccagctgcccccacccatcaagaagaagaagtttggcacctag

SEQ ID NO: 147774 - DNA, 1716 bp, Artificial Sequence
  Description of Artificial Sequence: Synthetic coding sequence
atgggagagttcaaggtgcaccgggtgcgcttcttcaactacgtgcccagcggcatccgctgtgtggcctacaacaaccagagcaaccggctggccgtgtccaggacagatggcaccgtggagatctacaacctgagcgccaactacttccaggagaagttcttccctggccacgagagccgggccacagaggccctgtgctgggccgagggccagaggctcttctctgctggcctgaatggagagatcatggagtatgacctgcaggccctgaacatcaagtatgccatggatgccttcggcggccccatctggagcatggccgccagccccagcggcagccagctgctggtgggctgtgaagatggctctgtgaagctgttccagatcaccccagacaagatccagtttgaaagaaactttgaccggcagaagagccgcatcctgagcctgtcctggcaccccagcggcacccacatcgccgccggcagcattgactacatctctgtgtttgatgtgaagagcggcagcgctgtgcacaagatgattgtggaccggcagtacatgggcgtgtccaagaggaaatgtattgtgtggggcgtggccttcctgagtgatggcaccatcatctctgtggacagcgctgggaaggtgcagttctgggacagcgccaccggcaccctggtgaagagccacctgattgccaatgctgatgtgcagagcattgctgtggccgaccaggaggacagctttgtggtgggcacagctgagggcaccgtcttccacttccagctggtgcctgtgaccagcaacagcagcgagaagcagtgggtgaggaccaagcccttccagcaccacacccatgatgtgaggacagtggcccacagccccacagccctgatcagcggcggcacagacacccacctggtgttccggcccctgatggagaaggtggaggtgaagaactatgatgctgccctgaggaagatcaccttcccccaccgctgcctgatcagctgcagcaagaagaggcagctgctgctcttccagtttgcccaccacctggagctgtggaggctgggcagcacagtggccaccggcaccgtggaggccatgtgcctgctggccgtgtccccagatggcaactggctggccgccagcggcaccagcgctggggtgcacgtgtacaacgtgaagcagctgaagctgcactgcaccgtgcctgcctacaacttccctgtgacagccatggccatcgcccccaacaccaacaacctggtgattgcccacagcgaccagcaggtgtttgagtacagcatcccagacaagcagtacacagactggagcaggacagtgcagaagcagggcttccaccacctgtggctgcagagggacacccccatcacccacatctccttccaccccaagaggcccatgcacatcctgctgcatgatgcctacatgttctgcatcatcgacaagagcctgcccctgcccaatgacaagaccctgctgtacaaccccttcccccccaccaatgaaagtgatgtgatcagaagaagaacagcccacgccttcaagatcagcaagatctacaagcccctgctcttcatggacctgctggatgagaggaccctggtggccgtggagcggcccctggatgacatcatcgcccagctgcccccacccatcaagaagaagaagtttggcacctag

SEQ ID NO: 147775 - DNA, 1023 bp, Artificial Sequence
  Description of Artificial Sequence: Synthetic coding sequence
atggccctgcggctgctgcggcgggccgcccggggagctgctgctgctgccctgctgcggctgaaggccagcctggccgctgacatcccccggctgggctacagcagcagcagccaccacaagtacatccccaggagagctgtgctgtatgtgcctggaaatgatgagaagaagatcaagaagatccccagcctgaatgtggactgtgctgtgctggactgtgaagatggagtggccgccaacaagaagaatgaggcccggctgcgcatcgtgaagaccctggaggacatcgacctgggccccacagagaagtgtgtgcgggtgaacagcgtgagcagcggcctggccgaggaggacctggagaccctgctgcagagccgggtgctgcccagcagcctgatgctgcccaaggtggagagccctgaggagatccagtggtttgctgacaagttctccttccacctgaagggcaggaagctggagcagcccatgaacctgatcccctttgtggagacagccatgggcctgctgaacttcaaggctgtgtgtgaggagaccctgaaggtgggcccccaggtgggcctcttcctggatgctgtggtgtttggaggagaggacttccgggccagcattggagccaccagcagcaaggagaccctggacatcctgtatgcccggcagaagatcgtggtgattgccaaggccttcggcctgcaggccatcgacctggtgtacatcgacttcagagatggagctggcctgctgcggcagagccgggagggcgccgccatgggcttcaccgggaagcaggtgatccaccccaaccagattgctgtggtgcaggagcagttcagccccagccctgagaagatcaagtgggccgaggagctgattgctgccttcaaggagcaccagcagctgggcaaaggagccttcaccttccagggctccatgattgacatgcccctgctgaagcaggcccagaacacagtgaccctggccaccagcatcaaggagaagtag

SEQ ID NO: 147776 - DNA, 921 bp, Artificial Sequence
  Description of Artificial Sequence: Synthetic coding sequence
atggccctgcggctgctgcggcgggccgcccggggagctgctgctgctgccctgctgcggctgaaggccagcctggccgctgacatcccccggctgggctacagcagcagcagccaccacaagtacatccccaggagagctgtgctgtatgtgcctggaaatgatgagaagaagatcaagaagatccccagcctgaatgtggactgtgctgtgctggactgtgaagatggagtggccgccaacaagaagaatgaggcccggctgcgcatcgtgaagaccctggaggacatcgacctgggccccacagagaagtgtgtgcgggtgaacagcgtgagcagcggcctggccgaggaggacctggagaccctgctgcagagccgggtgctgcccagcagcctgatgctgcccaaggtggagagccctgaggagatccagtgggccgtgtgtgaggagaccctgaaggtgggcccccaggtgggcctcttcctggatgctgtggtgtttggaggagaggacttccgggccagcattggagccaccagcagcaaggagaccctggacatcctgtatgcccggcagaagatcgtggtgattgccaaggccttcggcctgcaggccatcgacctggtgtacatcgacttcagagatggagctggcctgctgcggcagagccgggagggcgccgccatgggcttcaccgggaagcaggtgatccaccccaaccagattgctgtggtgcaggagcagttcagccccagccctgagaagatcaagtgggccgaggagctgattgctgccttcaaggagcaccagcagctgggcaaaggagccttcaccttccagggctccatgattgacatgcccctgctgaagcaggcccagaacacagtgaccctggccaccagcatcaaggagaagtag

SEQ ID NO: 147777 - DNA, 921 bp, Artificial Sequence; identical to SEQ ID NO: 147776
  Description of Artificial Sequence: Synthetic coding sequence

SEQ ID NO: 147778 - DNA, 1023 bp, Artificial Sequence; identical to SEQ ID NO: 147775
  Description of Artificial Sequence: Synthetic coding sequence

SEQ ID NO: 147779 - DNA, 546 bp, Artificial Sequence
  Description of Artificial Sequence: Synthetic coding sequence
aatgaggcccggctgagaattgtgaagaccctggaggacatcgacctgggccccacagagaagtgtgtgcgggtgaacagcgtgagcagcggcctggccgaggaggacctggagaccctgctgcagagccgggtgctgcccagcagcctgatgctgcccaaggtggagagccctgaggagatccagtggtttgctgacaagttctccttccacctgaagggcaggaagctggagcagcccatgaacctgatcccctttgtggagacagccatgggcctgctgaacttcaaggctgtgtgtgaggagaccctgaaggtgggcccccaggtgggcctcttcctggatgctgtggtgtttggaggagaggacttccgggccagcattggagtgaaggacatcagcctgagcctcttcctgtgtgtgtgtgtgtacatgtgtgtgtacatcttcagcctgcccctgaaggatggccacctgcacaacaacgtgtacctgcccaccatgaccatggtgttccatgacaatggcatggacaccaccagctag

SEQ ID NO: 147780 - DNA, 312 bp, Artificial Sequence
  Description of Artificial Sequence: Synthetic coding sequence
ctgcaggccatcgacctggtgtacatcgacttcagagatggagctggcctgctgcggcagagccgggagggcgccgccatgggcttcaccgggaagcaggtgatccaccccaaccagattgctgtggtgcaggagcagttcagccccagccctgagaagatcaagtgggccgaggagctgattgctgccttcaaggagcaccagcagctgggcaagggggccttcaccttccagggctccatgattgacatgcccctgctgaagcaggcccagaacacagtgaccctggccaccagcatcaaggagaagtag

SEQ ID NO: 147781 - DNA, 270 bp, Artificial Sequence
  Description of Artificial Sequence: Synthetic coding sequence
gaggagctgattgctgccttcaaggagcaccagcagctgggcaaggtgggccgctactgctgctcctggctgtgcatccagcccttccccagcagccctggccagaggagccagagcatcagccgggtgcccggccgctactgggtgctgggcgcccgctcctgggagagcaagggggccttcaccttccagggctccatgattgacatgcccctgctgaagcaggcccagaacacagtgaccctggccaccagcatcaaggagaagtag

SEQ ID NO: 147782 - DNA, 444 bp, Artificial Sequence
  Description of Artificial Sequence: Synthetic coding sequence
aatgaggcccggctgagaattgtgaagaccctggaggacatcgacctgggccccacagagaagtgtgtgcgggtgaacagcgtgagcagcggcctggccgaggaggacctggagaccctgctgcagagccgggtgctgcccagcagcctgatgctgcccaaggtggagagccctgaggagatccagtgggccgtgtgtgaggagaccctgaaggtgggcccccaggtgggcctcttcctggatgctgtggtgtttggaggagaggacttccgggccagcattggagtgaaggacatcagcctgagcctcttcctgtgtgtgtgtgtgtacatgtgtgtgtacatcttcagcctgcccctgaaggatggccacctgcacaacaacgtgtacctgcccaccatgaccatggtgttccatgacaatggcatggacaccaccagctag

SEQ ID NO: 147783 - DNA, 909 bp, Artificial Sequence
  Description of Artificial Sequence: Synthetic coding sequence
atggccctgcggctgctgcggcgggccgcccggggagctgctgctgctgccctgctgcggctgaaggccagcctggccgctgacatcccccggctgggctacagcagcagcagccaccacaagtacatccccaggagagctgtgctgtatgtgcctggaaatgatgagaagaagatcaagaagatccccagcctgaatgtggactgtgctgtgctggactgtgaagatggagtggccgccaacaagaagaatgaggcccggctgcgcatcgtgaagaccctggaggacatcgacctgggccccacagagaagtgtgtgcgggtgaacagcgtgagcagcggcctggccgaggaggacctggagaccctgctgcagagccgggtgctgcccagcagcctgatgctgcccaaggtggagagccctgaggagatccagtgggccgtgtgtgaggagaccctgaaggtgggcccccaggtgggcctcttcctggatgctgtggtgtttggaggagaggacttccgggccagcattggagccaccagcagcaaggagaccctggacatcctgtatgcccggcagaagatcgtggtgattgccaaggccttcggcctgcaggccatcgacctggtgtacatcgacttcagagatggagctggcctgctgcggcagagccgggagggcgccgccatgggcttcaccgggaagcaggtgatccaccccaaccagattgctgtggtgcaggagcagttcagccccagccctgagaagatcaagtgggccgaggagctgattgctgccttcaaggagcaccagcagctgggcaagacagtgtcctgcagcgccagccaggccggcgtgcagtggagggacctgggcagcctgcagcccccacctcctggcttcaagtag

SEQ ID NO: 147784 - DNA, 1401 bp, Artificial Sequence
  Description of Artificial Sequence: Synthetic coding sequence
atggccctgctgacagctgctgcccggctgctgggcaccaagaatgccagctgcctggtgctggccgcccggcatgccagcgccagcagcaccaacctgaaggacatcctggccgacctgatccccaaggagcaggcccgcatcaagaccttccggcagcagcacggcaagacagtggtgggccagatcaccgtggacatgatgtatggaggcatgaggggcatgaagggcctggtgtatgagacctctgtgctggaccctgatgagggcatccgcttccggggcttcagcatccctgagtgccagaagctgctgcccaaggccaagggcggggaggagcccctgcctgagggcctcttctggctgctggtgacaggccacatccccacagaggagcaggtgtcctggctgagcaaggagtgggccaagagagctgccctgcccagccacgtggtgaccatgctggacaacttccccaccaacctgcaccccatgagccagctgtctgctgctgtgacagccctgaacagcgagagcaactttgcccgggcctatgcccagggcatcagcaggaccaagtactgggagctgatctatgaggacagcatggacctgattgccaagctgccctgtgtggccgccaagatctacagaaacctgtaccgggagggcagcggcattggagccatcgacagcaacctggactggagccacaacttcaccaacatgctgggctacacagaccaccagttcacagagctgacccggctgtacctgaccatccacagcgaccatgaaggaggaaatgtgtctgcccacaccagccacctggtgggcagcgccctgagtgacccctacctgagctttgctgctgccatgaatggcctggccggccccctgcacggcctggccaaccaggaggtgctggtgtggctgacccagctgcagaaggaggtgggcaaggatgtgtctgatgagaagctgcgggactacatctggaacaccctgaacagcggccgggtggtgcccggctacggccatgctgtgctgaggaagacagacccccgctacacctgccagcgggagtttgccctgaagcacctgcccaatgaccccatgttcaagctggtggcccagctgtacaagatcgtgcccaacgtgctgctggagcagggcaaggccaagaacccctggcccaacgtggatgcccacagcggcgtgctgctgcagtactacggcatgacagagatgaactactacacagtgctgtttggagtgtcccgggccctgggcgtgctggcccagctgatctggagccgggccctgggcttccccctggagcggcccaagtccatgagcacagagggcctgatgaagtttgtggacagcaagtctggatag

SEQ ID NO: 147785 - DNA, 537 bp, Artificial Sequence
  Description of Artificial Sequence: Synthetic coding sequence
atggccctgctgacagctgctgcccggctgctgggcaccaagaatgccagctgcctggtgctggccgcccggcatgccagcgccagcagcaccaacctgaaggacatcctggccgacctgatccccaaggagcaggcccgcatcaagaccttccggcagcagcacggcaagacagtggtgggccagatcaccgtggacatgatgtatggaggcatgaggggcatgaagggcctggtgtatgagacctctgtgctggaccctgatgagggcatccgcttccggggcttcagcatccctgagtgccagaagctgctgcccaaggccaagggcggggaggagcccctgcctgagggcctcttctggctgctggtgacaggccacatccccacagaggagcaggtgtcctggctgagcaaggagtgggccaagagagctgccctgcccagccacgtggtgaccatgctggacaacttccccaccaacctgcaccccatgagccagctgtctgctgctgtgacagccctgaacagcgagtag

SEQ ID NO: 147786 - DNA, 6084 bp, Artificial Sequence
  Description of Artificial Sequence: Synthetic coding sequence
atgctgaagttcaagtacggggccaggaaccccctggatgctggagctgctgagcccatcgccagccgggccagccggctgaacctcttcttccagggcaagccacccttcatgacccagcagcagatgagccccctgagccgggagggcatcctggatgccctgtttgtgctgtttgaagaatgttcccagcctgccctgatgaagatcaagcacgtgagcaactttgtgaggaagtacagcgacaccatcgccgagctgcaggagctgcagcccagcgccaaggactttgaggtgcgcagcctggtgggctgcggccactttgctgaggtgcaggtggtgcgggagaaggccactggagacatctatgccatgaaggtgatgaagaagaaggccctgctggcccaggagcaggtgtccttctttgaggaggagaggaacatcctgagccgcagcaccagcccctggatcccccagctgcagtatgccttccaggacaagaaccacctgtacctggtgatggagtaccagcccggcggggacctgctgagcctgctgaacagatatgaggaccagctggatgaaaatctcatccagttctacctggccgagctgatcctggccgtgcacagcgtgcacctgatgggctacgtgcaccgggacatcaagccagagaacatcctggtggacagaacaggccacatcaagctggtggactttggcagcgctgccaagatgaacagcaacaagatggtgaatgccaagctgcccatcggcaccccagactacatggcccctgaggtgctgactgtgatgaatggagatggcaagggcacctacggcctggactgtgactggtggagcgtgggcgtcatcgcctatgagatgatctacggccgcagcccctttgctgagggcaccagcgcccggaccttcaacaacatcatgaacttccagcgcttcctgaagttcccagatgaccccaaggtgtccagtgacttcctggacctgatccagagcctgctgtgtggccagaaggagcggctgaagtttgagggcctgtgctgccaccccttcttcagcaagattgactggaacaacatccggaacagccccccaccatttgtgcccaccctgaagagtgatgatgacaccagcaactttgatgagcctgagaagaacagctgggtgagcagcagcccctgccagctgagccccagcggcttcagcggggaggagctgccctttgtgggcttctcctacagcaaggccctgggcatcctgggccgctctgagagcgtggtgtctggcctggacagccctgccaagaccagctccatggagaagaagctgctgatcaagagcaaggagctgcaggacagccaggacaagtgccacaagatggagcaggagatgacccggctgcacagaagagtgtctgaggtggaggccgtgctgagccagaaggaggtggagctgaaggccagcgagacccagaggagcctgctggagcaggacctggccacctacatcacagaatgtagcagcctgaagaggagcctggagcaggccaggatggaggtgtcccaggaggatgacaaggccctgcagctgctgcatgacatccgggagcagagcaggaagctgcaggagatcaaggagcaggagtaccaggcccaggtggaggagatgaggctgatgatgaaccagctggaggaggacctggtgtctgcccggcggcggagtgacctgtatgaaagtgagctgcgggagagccggctggccgctgaggagttcaagaggaaggccacagagtgccagcacaagctgctgaaggccaaggaccagggcaagccagaggtgggggagtatgccaagctggagaagatcaatgctgagcagcagctgaagatccaggagctgcaggagaagctggagaaggctgtgaaggccagcacagaggccacagagctgctgcagaacatccggcaggccaaggagagagctgagcgggagctggagaagctgcagaaccgggaggacagcagcgagggcatcaggaagaagctggtggaggccgaggagctggaggagaagcaccgggaggcccaggtgtctgcccagcacctggaggtgcacctgaagcagaaggagcagcactatgaggagaagatcaaggtgctggacaaccagatcaagaaggacctggccgacaaggagaccctggagaacatgatgcagagacatgaggaggaggcccacgagaagggcaagatcctgtctgagcagaaggccatgatcaatgccatggacagcaagatccgcagcctggagcagagaattgtggagctgtctgaggccaacaagctggccgccaacagcagcctcttcacccagaggaacatgaaggcccaggaggagatgatcagcgagctgcggcagcagaagttctacctggagacccaggccggcaagctggaggcccagaacaggaagctggaggagcagctggagaagatcagccaccaggaccacagcgacaagaaccggctgctggagctggagacccggctgcgggaggtgtccctggagcacgaggagcagaagctggagctgaagaggcagctgacagagctgcagctgagcctgcaggagcgggagagccagctgacagccctgcaggccgcccgggccgccctggagagccagctgcggcaggccaagacagagctggaggagaccacagctgaggccgaggaggagatccaggccctgacagcccacagagatgagatccagaggaagtttgatgccctgaggaacagctgcaccgtcatcacagacctggaggagcagctgaaccagctgacagaggacaatgctgagctgaacaaccagaacttctacctgagcaagcagctggatgaggccagcggggccaatgatgagatcgtgcagctgcggtctgaggtggaccacctgcggcgggagatcacagagcgggagatgcagctgaccagccagaagcagaccatggaggccctgaagaccacctgcaccatgctggaggagcaggtgatggacctggaggccctgaatgatgagctgctggagaaggagcggcagtgggaggcctggaggtctgtgctgggagatgagaagagccagtttgagtgccgggtgcgggagctgcagaggatgctggacacagagaagcagagccgggcccgggctgaccagaggatcacagagagccggcaggtggtggagctggccgtgaaggagcacaaggccgagatcctggccctgcagcaggccctgaaggagcagaagctgaaggccgagagcctgagtgacaagctgaatgacctggagaagaagcacgccatgctggagatgaatgcccggagcctgcagcagaagctggagacagagcgggagctgaagcagaggctgctggaggagcaggccaagctgcagcagcagatggacctgcagaagaaccacatcttccggctgacccagggcctgcaggaggccctggacagagctgacctgctgaagacagagaggagtgacctggagtaccagctggagaacatccaggtgctgtacagccatgagaaggtgaagatggagggcaccatcagccagcagaccaagctgattgacttcctgcaggccaagatggaccagcctgccaagaagaagaagggcctcttcagcaggaggaaggaggaccctgccctgcccacccaggtgcccctgcagtacaatgagctgaagctggccctggagaaggagaaggcccgctgtgccgagctggaggaggccctgcagaagacccgcatcgagctgcggagcgcccgggaggaggccgcccacaggaaggccacagaccacccccaccccagcaccccagccacagcccggcagcagatcgccatgtctgccatcgtgcgcagccctgagcaccagcccagcgccatgagcctgctggccccacccagcagcaggaggaaggagagcagcaccccagaggagttcagccggcggctgaaggagaggatgcaccacaacatcccccaccgcttcaacgtgggcctgaacatgagggccaccaagtgtgctgtgtgcctggacacagtgcacttcggccggcaggccagcaagtgcctggagtgccaggtgatgtgccaccccaagtgcagcacctgcctgcctgccacctgtggcctgcctgcagaatatgccacccacttcacagaggccttctgccgggacaagatgaacagccctggcctgcagaccaaggagcccagcagcagcctgcacctggagggctggatgaaggtgcccaggaacaacaagaggggccagcagggctgggacaggaagtacatcgtgctggagggcagcaaggtgctgatctatgacaatgaggcccgggaggccggccagaggcctgtggaggagtttgagctgtgcctgcctgatggagatgtgtccatccatggagctgtgggcgccagcgagctggccaacacagccaaggcagatgtgccctacatcctgaagatggagagccacccccacaccacctgctggccaggccgcaccctgtacctgctggcccccagcttcccagacaagcagcgctgggtgacagccctggagagcgtggtggccggcggccgggtgtcccgggagaaggccgaggctgatgccaagctgctgggcaacagcctgctgaagctggagggagatgaccggctggacatgaactgcaccctgcccttcagtgaccaggtggtgctggtgggcacagaggagggcctgtatgccctgaatgtgctgaagaacagcctgacccacgtgcccggcattggagctgtgttccagatctacatcatcaaggacctggagaagctgctgatgattgctggggaggagcgggccctgtgcctggtggatgtgaagaaggtgaagcagagcctggcccagagccacctgcctgcccagcctgacatcagccccaacatctttgaggccgtgaagggctgccacctgtttggagctgggaagattgaaaatggcctgtgcatctgtgccgccatgcccagcaaggtggtgatcctgcgctacaatgaaaacctgagcaagtactgcatcaggaaggagattgagaccagcgagccctgcagctgcatccacttcaccaactacagcatcctgattggcaccaacaagttctatgaaattgacatgaagcagtacaccctggaggagttcctggacaagaatgaccacagcctggccccagctgtgtttgctgccagcagcaacagcttccctgtgtccatcgtgcaggtgaacagcgctggccagcgggaggagtacctgctgtgcttccatgaatttggagtgtttgtggacagctatggccgccgcagcaggacagatgacctgaagtggagccggctgcccctggcctttgcctaccgggagccctacctgtttgtgacccacttcaacagcctggaggtgattgagatccaggcccggagcagcgctggcaccccagcccgggcctacctggacatccccaacccccgctacctgggccctgccatcagcagcggggccatctacctggccagcagctaccaggacaagctgcgggtcatctgctgcaagggcaacctggtgaaggagagcggcacagagcaccaccggggccccagcaccagccgcagcagccccaacaagaggggcccccccacctacaatgagcacatcaccaagagggtggccagcagccctgcccctcctgagggccccagccacccccgggagcccagcaccccccaccgctaccgggagggccgcacagagctgcggcgggacaagagccctggccggcccctggagcgggagaagagccctggccgcatgctgagcacccggcgggagaggagccctggccgcctgtttgaggacagcagccggggccgcctgcctgctggagctgtgaggacccccctgagccaggtgaacaaggtgtgggaccagagctctgtgtag

SEQ ID NO: 147787 - DNA, 6210 bp, Artificial Sequence
  Description of Artificial Sequence: Synthetic coding sequence
atgctgaagttcaagtacggggccaggaaccccctggatgctggagctgctgagcccatcgccagccgggccagccggctgaacctcttcttccagggcaagccacccttcatgacccagcagcagatgagccccctgagccgggagggcatcctggatgccctgtttgtgctgtttgaagaatgttcccagcctgccctgatgaagatcaagcacgtgagcaactttgtgaggaagtacagcgacaccatcgccgagctgcaggagctgcagcccagcgccaaggactttgaggtgcgcagcctggtgggctgcggccactttgctgaggtgcaggtggtgcgggagaaggccactggagacatctatgccatgaaggtgatgaagaagaaggccctgctggcccaggagcaggtgtccttctttgaggaggagaggaacatcctgagccgcagcaccagcccctggatcccccagctgcagtatgccttccaggacaagaaccacctgtacctggtgatggagtaccagcccggcggggacctgctgagcctgctgaacagatatgaggaccagctggatgaaaatctcatccagttctacctggccgagctgatcctggccgtgcacagcgtgcacctgatgggctacgtgcaccgggacatcaagccagagaacatcctggtggacagaacaggccacatcaagctggtggactttggcagcgctgccaagatgaacagcaacaagatggtgaatgccaagctgcccatcggcaccccagactacatggcccctgaggtgctgactgtgatgaatggagatggcaagggcacctacggcctggactgtgactggtggagcgtgggcgtcatcgcctatgagatgatctacggccgcagcccctttgctgagggcaccagcgcccggaccttcaacaacatcatgaacttccagcgcttcctgaagttcccagatgaccccaaggtgtccagtgacttcctggacctgatccagagcctgctgtgtggccagaaggagcggctgaagtttgagggcctgtgctgccaccccttcttcagcaagattgactggaacaacatccggaacagccccccaccatttgtgcccaccctgaagagtgatgatgacaccagcaactttgatgagcctgagaagaacagctgggtgagcagcagcccctgccagctgagccccagcggcttcagcggggaggagctgccctttgtgggcttctcctacagcaaggccctgggcatcctgggccgctctgagagcgtggtgtctggcctggacagccctgccaagaccagctccatggagaagaagctgctgatcaagagcaaggagctgcaggacagccaggacaagtgccacaagatggagcaggagatgacccggctgcacagaagagtgtctgaggtggaggccgtgctgagccagaaggaggtggagctgaaggccagcgagacccagaggagcctgctggagcaggacctggccacctacatcacagaatgtagcagcctgaagaggagcctggagcaggccaggatggaggtgtcccaggaggatgacaaggccctgcagctgctgcatgacatccgggagcagagcaggaagctgcaggagatcaaggagcaggagtaccaggcccaggtggaggagatgaggctgatgatgaaccagctggaggaggacctggtgtctgcccggcggcggagtgacctgtatgaaagtgagctgcgggagagccggctggccgctgaggagttcaagaggaaggccacagagtgccagcacaagctgctgaaggccaaggaccagggcaagccagaggtgggggagtatgccaagctggagaagatcaatgctgagcagcagctgaagatccaggagctgcaggagaagctggagaaggctgtgaaggccagcacagaggccacagagctgctgcagaacatccggcaggccaaggagagagctgagcgggagctggagaagctgcagaaccgggaggacagcagcgagggcatcaggaagaagctggtggaggccgaggagcggcggcacagcctggagaacaaggtgaagaggctggagaccatggagcggcgggagaaccggctgaaggatgacatccagaccaagagccagcagatccagcagatggctgacaagatcctggagctggaggagaagcaccgggaggcccaggtgtctgcccagcacctggaggtgcacctgaagcagaaggagcagcactatgaggagaagatcaaggtgctggacaaccagatcaagaaggacctggccgacaaggagaccctggagaacatgatgcagagacatgaggaggaggcccacgagaagggcaagatcctgtctgagcagaaggccatgatcaatgccatggacagcaagatccgcagcctggagcagagaattgtggagctgtctgaggccaacaagctggccgccaacagcagcctcttcacccagaggaacatgaaggcccaggaggagatgatcagcgagctgcggcagcagaagttctacctggagacccaggccggcaagctggaggcccagaacaggaagctggaggagcagctggagaagatcagccaccaggaccacagcgacaagaaccggctgctggagctggagacccggctgcgggaggtgtccctggagcacgaggagcagaagctggagctgaagaggcagctgacagagctgcagctgagcctgcaggagcgggagagccagctgacagccctgcaggccgcccgggccgccctggagagccagctgcggcaggccaagacagagctggaggagaccacagctgaggccgaggaggagatccaggccctgacagcccacagagatgagatccagaggaagtttgatgccctgaggaacagctgcaccgtcatcacagacctggaggagcagctgaaccagctgacagaggacaatgctgagctgaacaaccagaacttctacctgagcaagcagctggatgaggccagcggggccaatgatgagatcgtgcagctgcggtctgaggtggaccacctgcggcgggagatcacagagcgggagatgcagctgaccagccagaagcagaccatggaggccctgaagaccacctgcaccatgctggaggagcaggtgatggacctggaggccctgaatgatgagctgctggagaaggagcggcagtgggaggcctggaggtctgtgctgggagatgagaagagccagtttgagtgccgggtgcgggagctgcagaggatgctggacacagagaagcagagccgggcccgggctgaccagaggatcacagagagccggcaggtggtggagctggccgtgaaggagcacaaggccgagatcctggccctgcagcaggccctgaaggagcagaagctgaaggccgagagcctgagtgacaagctgaatgacctggagaagaagcacgccatgctggagatgaatgcccggagcctgcagcagaagctggagacagagcgggagctgaagcagaggctgctggaggagcaggccaagctgcagcagcagatggacctgcagaagaaccacatcttccggctgacccagggcctgcaggaggccctggacagagctgacctgctgaagacagagaggagtgacctggagtaccagctggagaacatccaggtgctgtacagccatgagaaggtgaagatggagggcaccatcagccagcagaccaagctgattgacttcctgcaggccaagatggaccagcctgccaagaagaagaagggcctcttcagcaggaggaaggaggaccctgccctgcccacccaggtgcccctgcagtacaatgagctgaagctggccctggagaaggagaaggcccgctgtgccgagctggaggaggccctgcagaagacccgcatcgagctgcggagcgcccgggaggaggccgcccacaggaaggccacagaccacccccaccccagcaccccagccacagcccggcagcagatcgccatgtctgccatcgtgcgcagccctgagcaccagcccagcgccatgagcctgctggccccacccagcagcaggaggaaggagagcagcaccccagaggagttcagccggcggctgaaggagaggatgcaccacaacatcccccaccgcttcaacgtgggcctgaacatgagggccaccaagtgtgctgtgtgcctggacacagtgcacttcggccggcaggccagcaagtgcctggagtgccaggtgatgtgccaccccaagtgcagcacctgcctgcctgccacctgtggcctgcctgcagaatatgccacccacttcacagaggccttctgccgggacaagatgaacagccctggcctgcagaccaaggagcccagcagcagcctgcacctggagggctggatgaaggtgcccaggaacaacaagaggggccagcagggctgggacaggaagtacatcgtgctggagggcagcaaggtgctgatctatgacaatgaggcccgggaggccggccagaggcctgtggaggagtttgagctgtgcctgcctgatggagatgtgtccatccatggagctgtgggcgccagcgagctggccaacacagccaaggcagatgtgccctacatcctgaagatggagagccacccccacaccacctgctggccaggccgcaccctgtacctgctggcccccagcttcccagacaagcagcgctgggtgacagccctggagagcgtggtggccggcggccgggtgtcccgggagaaggccgaggctgatgccaagctgctgggcaacagcctgctgaagctggagggagatgaccggctggacatgaactgcaccctgcccttcagtgaccaggtggtgctggtgggcacagaggagggcctgtatgccctgaatgtgctgaagaacagcctgacccacgtgcccggcattggagctgtgttccagatctacatcatcaaggacctggagaagctgctgatgattgctggggaggagcgggccctgtgcctggtggatgtgaagaaggtgaagcagagcctggcccagagccacctgcctgcccagcctgacatcagccccaacatctttgaggccgtgaagggctgccacctgtttggagctgggaagattgaaaatggcctgtgcatctgtgccgccatgcccagcaaggtggtgatcctgcgctacaatgaaaacctgagcaagtactgcatcaggaaggagattgagaccagcgagccctgcagctgcatccacttcaccaactacagcatcctgattggcaccaacaagttctatgaaattgacatgaagcagtacaccctggaggagttcctggacaagaatgaccacagcctggccccagctgtgtttgctgccagcagcaacagcttccctgtgtccatcgtgcaggtgaacagcgctggccagcgggaggagtacctgctgtgcttccatgaatttggagtgtttgtggacagctatggccgccgcagcaggacagatgacctgaagtggagccggctgcccctggcctttgcctaccgggagccctacctgtttgtgacccacttcaacagcctggaggtgattgagatccaggcccggagcagcgctggcaccccagcccgggcctacctggacatccccaacccccgctacctgggccctgccatcagcagcggggccatctacctggccagcagctaccaggacaagctgcgggtcatctgctgcaagggcaacctggtgaaggagagcggcacagagcaccaccggggccccagcaccagccgcagcagccccaacaagaggggcccccccacctacaatgagcacatcaccaagagggtggccagcagccctgcccctcctgagggccccagccacccccgggagcccagcaccccccaccgctaccgggagggccgcacagagctgcggcgggacaagagccctggccggcccctggagcgggagaagagccctggccgcatgctgagcacccggcgggagaggagccctggccgcctgtttgaggacagcagccggggccgcctgcctgctggagctgtgaggacccccctgagccaggtgaacaaggtgtgggaccagagctctgtgtag

SEQ ID NO: 147788 - DNA, 696 bp, Artificial Sequence
  Description of Artificial Sequence: Synthetic coding sequence
atggaccctgagcacgccaagccagagagcagcgaggcccccagcggcaacctgaagcagcctgagacagctgctgccctggccagcagcggctctgtggtgtcctctgtgcccaaggcccagaggaacatcagcgccaagacagcccccaggaagcaccctgctgtgtccatccgcagcgcccagagcgctgctgctgcccggccccagggcagcgagggcacagcccccagcaggaaggccaccacccggcccccacccaagcccaccctgcccccacccaccccatctgcccacacagagagcaagctgctgaatgagatggccatcaaggagcgggtggagggccgggccaaggtgccctacaagttccgggacagcctgaagcgcttctccttcagccccaccggcatgctgaagatcctgcggctgagcctcatcctgggcgccctggcctgcttcatcatcacccaggccaatgaaagcttcatcaccatcaccagcctggagatctgcatcgtggtgttcttcatcctgatctacgtgctgaccctgcaccacctgctgacctacctgcactggcccctgctggacctgaccaacagcatcatcacagctgtgttcctgtctgtggtggccatcctggccatgcaggagaagaagaggaggcacctgctgtatgtgggcggccgctag

SEQ ID NO: 147789 - DNA, 369 bp, Artificial Sequence
  Description of Artificial Sequence: Synthetic coding sequence
atggaccctgagcacgccaagccagagagcagcgaggcccccagcggcaacctgaagcagcctgagacagctgctgccctggccagcagcggctctgtggacctgaccaacagcatcatcacagctgtgttcctgtctgtggtggccatcctggccatgcaggagaagaagaggaggcacctgctgtatgtgggcggcagcctgtgcctgacagctgtgattgtgtgctgcattgatgcctttgtggtgaccaccaagatgaggaccaacctgaagcgcttcctgggcgtggaggtggagaggaagctgagccctgccaaggatgcctacccagagactggaccagatgccccccagaggcctgcctag

SEQ ID NO: 147790 - DNA, 351 bp, Artificial Sequence
  Description of Artificial Sequence: Synthetic coding sequence
atggaccctgagcacgccaagccagagagcagcgaggcccccagcggcaacctgaagcagcctgagacagctgctgccctggacctgaccaacagcatcatcacagctgtgttcctgtctgtggtggccatcctggccatgcaggagaagaagaggaggcacctgctgtatgtgggcggcagcctgtgcctgacagctgtgattgtgtgctgcattgatgcctttgtggtgaccaccaagatgaggaccaacctgaagcgcttcctgggcgtggaggtggagaggaagctgagccctgccaaggatgcctacccagagactggaccagatgccccccagaggcctgcctag

SEQ ID NO: 147791 - DNA, 279 bp, Artificial Sequence
  Description of Artificial Sequence: Synthetic coding sequence
atggaccctgagcacgccaagccagagagcagcgaggcccccagcggcaacctgaagcagcctgagacagctgctgccctggccagcagcggctctgtggtgtcctctgtgcccaaggcccagaggaacatcagcgccaagacagcccccaggaagcaccctgctgtgtccatccgcagcgcccagagcgctgctgctgcccggccccagggcagcgagggcacagcccccagccgcatcctgcccaccgtgtccctgcagctgtgcagcttccagtag

SEQ ID NO: 147792 - DNA, 861 bp, Artificial Sequence
  Description of Artificial Sequence: Synthetic coding sequence
atggaccctgagcacgccaagccagagagcagcgaggcccccagcggcaacctgaagcagcctgagacagctgctgccctggccagcagcggctctgtggtgtcctctgtgcccaaggcccagaggaacatcagcgccaagacagcccccaggaagcaccctgctgtgtccatccgcagcgcccagagcgctgctgctgcccggccccagggcagcgagggcacagcccccagcaggaaggccaccacccggcccccacccaagcccaccctgcccccacccaccccatctgcccacacagagagcaagctgctgaatgagatggccatcaaggagcgggtggagggccgggccaaggtgccctacaagttccgggacagcctgaagcgcttctccttcagccccaccggcatgctgaagatcctgcggctgagcctcatcctgggcgccctggcctgcttcatcatcacccaggccaatgaaagcttcatcaccatcaccagcctggagatctgcatcgtggtgttcttcatcctgatctacgtgctgaccctgcaccacctgctgacctacctgcactggcccctgctggacctgaccaacagcatcatcacagctgtgttcctgtctgtggtggccatcctggccatgcaggagaagaagaggaggcacctgctgtatgtgggcggcagcctgtgcctgacagctgtgattgtgtgctgcattgatgcctttgtggtgaccaccaagatgaggaccaacctgaagcgcttcctgggcgtggaggtggagaggaagctgagccctgccaaggatgcctacccagagactggaccagatgccccccagaggcctgcctag

SEQ ID NO: 147793 - DNA, 510 bp, Artificial Sequence
  Description of Artificial Sequence: Synthetic coding sequence
atggaccctgagcacgccaagccagagagcagcgaggcccccagcggcaacctgaagcagcctgagacagctgctgccctgagcctcatcctgggcgccctggcctgcttcatcatcacccaggccaatgaaagcttcatcaccatcaccagcctggagatctgcatcgtggtgttcttcatcctgatctacgtgctgaccctgcaccacctgctgacctacctgcactggcccctgctggacctgaccaacagcatcatcacagctgtgttcctgtctgtggtggccatcctggccatgcaggagaagaagagaagacacctgctgtatgtgggcggcagcctgtgcctgacagctgtgattgtgtgctgcattgatgcctttgtggtgaccaccaagatgaggaccaacctgaagcgcttcctgggcgtggaggtggagaggaagctgagccctgccaaggatgcctacccagagaccggcccagatgccccccagaggcctgcctag

SEQ ID NO: 147794 - DNA, 345 bp, Artificial Sequence
  Description of Artificial Sequence: Synthetic coding sequence
atggaccctgagcacgccaagccagagagcagcgaggcccccagcggcaacctgaagcagcctgagacagctgctgccctgagcctcatcctgggcgccctggcctgcttcatcatcacccaggccaatgaaagcttcatcaccatcaccagcctggagatctgcatcgtggtgttcttcatcctgatctacgtgctgaccctgcaccacctgctgacctacctgcactggcccctgctggacctgaccaacagcatcatcacagctgtgttcctgtctgtggtggccatcctggccatgcaggagaagaagagaagacacctgctgtatgtgggcggccgctag

SEQ ID NO: 147795 - DNA, 117 bp, Artificial Sequence
  Description of Artificial Sequence: Synthetic coding sequence
atggaccctgagcacgccaagccagagagcagcgaggcccccagcggcaacctgaagcagcctgagacagctgctgccctggaggccgacaaggccaacatgagcaacttcaactag

SEQ ID NO: 147796 - DNA, 87 bp, Artificial Sequence
  Description of Artificial Sequence: Synthetic coding sequence
atggaccctgagcacgccaagccagagagcagcgaggcccccagcggcaacctgaagcagcctgagacagctgctgccctgaggtag

SEQ ID NO: 147797 - DNA, 747 bp, Artificial Sequence
  Description of Artificial Sequence: Synthetic coding sequence
atggcccccaaggccgccaagggggccaagccagagcccgccccagcccctcctcctcctggggccaagccagaggaggacaagaaggatggcaaggagcccagcgacaagccccagaaggctgtgcaggaccacaaggagcccagcgacaagccccagaaggctgtgcagcccaagcatgaggtgggcacccggcggggctgccgccgctaccgctgggagctgaaggacagcaacaaggagttctggctgctgggccacgccgagatcaagatccgcagcctgggctgcctgattgctgccatgatcctgctgagcagcctgactgtgcaccccatcctgcggctcatcatcaccatggagatctccttcttctccttcttcatcctgctgtacagctttgccatccaccgctacatccccttcatcctgtggcccatcagtgacctcttcaatgacctgattgcctgtgccttcctggtgggcgctgtggtgtttgctgtgcgcagcagaagatccatgaacctgcactacctgctggccgtcatcctgattggagctgctggggtgtttgccttcattgatgtgtgcctgcagaggaaccacttccggggcaagaaggccaagaagcacatgctggtgcccccacctgggaaggagaagggcccccagcagggcaaaggacctgagcccgccaagcccccagagcccgggaagcccccaggccctgccaagggcaagaagtag

SEQ ID NO: 147798 - DNA, 588 bp, Artificial Sequence
  Description of Artificial Sequence: Synthetic coding sequence
atggcccccaaggccgccaagggggccaagccagagcccgccccagcccctcctcctcctggggccaagccagaggaggacaagaaggatggcaaggagcccagcgacaagccccagaaggctgtgcaggaccacaaggagcccagcgacaagccccagaaggctgtgcagcccaagcatgaggtgggcacccggcggggctgccgccgctaccgctgggagctgaaggacagcaacaaggagttctggctgctgggccacgccgagatcaagatccgcagcctggacctcttcaatgacctgattgcctgtgccttcctggtgggcgctgtggtgtttgctgtgcgcagccgccgctccatgaacctgcactacctgctggccgtcatcctgattggagctgctggggtgtttgccttcattgatgtgtgcctgcagaggaaccacttccggggcaagaaggccaagaagcacatgctggtgcccccacctgggaaggagaagggcccccagcagggcaagggccctgagcccgccaagcccccagagcccgggaagcccccaggccctgccaagggcaagaagtag

SEQ ID NO: 147799 - DNA, 180 bp, Artificial Sequence
  Description of Artificial Sequence: Synthetic coding sequence
atgtggcccccagaccctgaccctgaccctgaccctgagcctgctgggggcagccggcccggccctgctgtgcccggcctgcgggccctgctgcctgcccgggccttcctgtgcagcctgaagggccctgggggctttgtgtgcacctggtgcagctgcccccaccagcccctgtggtag

SEQ ID NO: 147800 - DNA, 549 bp, Artificial Sequence
  Description of Artificial Sequence: Synthetic coding sequence
atgtggcccccagaccctgaccctgaccctgaccctgagcctgctgggggcagccggcccggccctgctgtgcccggcctgcgggccctgctgcctgcccgggccttcctgtgcagcctgaagggccgcctgctgctggccgagagcggcctgtccttcatcaccttcatctgctacgtggccagcagcgccagcgccttcctgacagcccccctgctggagttcctgctggccctgtacttcctgtttgctgatgccatgcagctgaatgacaagtggcagggcctgtgctggcccatgatggacttcctgcgctgtgtgacagctgccctgatctactttgccatcagcatcacagccatcgccaagtacagtgatggagccagcaaggccgccggcgtgtttggcttctttgccaccatcgtgtttgccacagacttctacctgatcttcaatgatgtggccaagttcctgaagcagggcgacagcgcagatgagaccacagcccacaagacagaggaggagaacagcgacagcgacagcgactag

SEQ ID NO: 147801 - DNA, 549 bp, Artificial Sequence; identical to SEQ ID NO: 147800
  Description of Artificial Sequence: Synthetic coding sequence

SEQ ID NO: 147802 - DNA, 549 bp, Artificial Sequence; identical to SEQ ID NO: 147800
  Description of Artificial Sequence: Synthetic coding sequence

SEQ ID NO: 147803 - DNA, 705 bp, Artificial Sequence
  Description of Artificial Sequence: Synthetic coding sequence
atgaggtctggagaggagctggatggctttgaaggagaggccagcagcacctccatgatcagcggggccagcagcccctaccagcccaccacagagcctgtgtcccagaggcggggcctggccggcctgcgctgtgaccctgactacctgcggggggccctgggccgcctgaaggtggcccaggtgatcctggccctgattgccttcatctgcatcgagaccatcatggcctgcagcccctgtgagggcctgtacttctttgaatttgtgtcctgcagcgcctttgtggtgactggagtgctgctgatcatgttcagcctgaacctgcacatgaggatcccccagatcaactggaacctgacagacctggtgaacacaggcctgagcgccttcctgttcttcatcgccagcatcgtgctggccgccctgaaccacagagctggagctgagattgctgctgtgatcttcggcttcctggccacagctgcctatgctgtgaacaccttcctggccgtgcagaagtggagggtgtctgtgcggcagcagagcaccaatgactacatccgggccaggacagagagcagagatgtggacagcaggcctgagatccagaggctggacaccttctcctacagcaccaacgtgacagtgaggaagaagagccccaccaacctgctgagcctgaaccactggcagctggcctag

SEQ ID NO: 147804 - DNA, 627 bp, Artificial Sequence
  Description of Artificial Sequence: Synthetic coding sequence
atgaggtctggagaggagctggatggctttgaaggagaggccagcagcacctccatgatcagcggggccagcagcccctaccagcccaccacagagcctgtgtcccagaggcggggcctggccggcctgcgctgtgaccctgactacctgcggggggccctgggccgcctgaaggtggcccaggtgatcctggccctgattgccttcatctgcatcgagaccatcatggcctgcagcccctgtgagggcctgtacttctttgaatttgtgtcctgcagcgcctttgtggtgactggagtgctgctgatcatgttcagcctgaacctgcacatgaggatcccccagatcaactggaacctgacagacctggtgaacacaggcctgagcgccttcctgttcttcatcgccagcatcgtgctggccgccctgaaccacagagctggagctgagattgctgctgtgatcttcggcttcctggccacagctgcctatgctgtgaacaccttcctggccgtgcagaagtggagggtgtctgtgcggcagcagagcaccaatgactacatccgggccaggacagagagcagagatgtggacagcaggcctgagatccagaggctggacacctag

SEQ ID NO: 147805 - DNA, 672 bp, Artificial Sequence
  Description of Artificial Sequence: Synthetic coding sequence
atgctgagcgcccgggacagaagagacagacaccctgaggagggcgtggtggccgagctgcagggctttgctgtggacaaggccttcctgaccagccacaagggcatcctgctggagacagagctggccctgaccctcatcatcttcatctgcttcaccgccagcatcagcgcctacatggccgccgccctgctggagttcttcatcaccctggccttcctgttcctgtatgccacccagtactaccagagatttgaccgcatcaactggccctgcctgctgcagggccacggccagagcggcggcccccaccccctggacctgctgagccacagcgccaaggtgcagccccagccctggccaggcctgaccccacctggctggcacaccccagctgctgtgccctgggtgcctgccccagcccctggcttctggagctggctgctgtggttcatctgcttccacagcctgggcagcagtgacttcctgcgctgtgtgtctgccatcatcatcttcctggtggtgtcctttgctgctgtgaccagcagagatggagctgccatcgccgcctttgtgtttggcatcatcctggtgtccatctttgcctatgatgccttcaagatctacagaacagagatggcccctggggccagccagggcgaccagcagtag

SEQ ID NO: 147806 - DNA, 225 bp, Artificial Sequence
  Description of Artificial Sequence: Synthetic coding sequence
atgctgagcgcccgggacagaagagacagacaccctgaggagggcgtggtggccgagctgcagggctttgctgtggacaaggccttcctgaccagccacaagggcatcctgctggagacagagctggtgtttggcatcatcctggtgtccatctttgcctatgatgccttcaagatctacagaacagagatggcccctggggccagccagggcgaccagcagtag

SEQ ID NO: 147807 - DNA, 471 bp, Artificial Sequence
  Description of Artificial Sequence: Synthetic coding sequence
atgctgagcgcccgggacagaagagacagacaccctgaggagggcgtggtggccgagctgcagggctttgctgtggacaaggccttcctgaccagccacaagggcatcctgctggagacagagctggccctgaccctcatcatcttcatctgcttcaccgccagcatcagcgcctacatggccgccgccctgctggagttcttcatcaccctggccttcctgttcctgtatgccacccagtactaccagagatttgaccgcatcaactggccctgcctggacttcctgcgctgtgtgtctgccatcatcatcttcctggtggtgtcctttgctgctgtgaccagcagagatggagctgccatcgccgcctttgtgtttggcatcatcctggtgtccatctttgcctatgatgccttcaagatctacagaacagagatggcccctggggccagccagggcgaccagcagtag

SEQ ID NO: 147808 - DNA, 378 bp, Artificial Sequence
  Description of Artificial Sequence: Synthetic coding sequence
atgctgagcgcccgggacagaagagacagacaccctgaggagggcgtggtggccgagctgcagggctttgctgtggacaaggccttcctgaccagccacaagggcatcctgctggagacagagctggccctgaccctcatcatcttcatctgcttcaccgccagcatcagcgcctacatggccgccgccctgctggagttcttcatcaccctggccttcctgttcctgtatgccacccagtactaccagagatttgaccgcatcaactggccctgcctggtgtttggcatcatcctggtgtccatctttgcctatgatgccttcaagatctacagaacagagatggcccctggggccagccagggcgaccagcagtag

SEQ ID NO: 147809 - DNA, 318 bp, Artificial Sequence
  Description of Artificial Sequence: Synthetic coding sequence
atgctgagcgcccgggacagaagagacagacaccctgaggagggcgtggtggccgagctgcagggctttgctgtggacaaggccttcctgaccagccacaagggcatcctgctggagacagagctggacttcctgcgctgtgtgtctgccatcatcatcttcctggtggtgtcctttgctgctgtgaccagcagagatggagctgccatcgccgcctttgtgtttggcatcatcctggtgtccatctttgcctatgatgccttcaagatctacagaacagagatggcccctggggccagccagggcgaccagcagtag

SEQ ID NO: 147810 - DNA, 1326 bp, Artificial Sequence
  Description of Artificial Sequence: Synthetic coding sequence
cccagccctgccatcggcctgtttgcctccatggctgctgtgctgctgggcggggcccgggccagccggctgctcttccagaggctgctgtgggatgtggtgcgcagccccatctccttctttgagaggacccccatcggccacctgctgaaccgcttcagcaaggagacagacacagtggatgtggacatcccagacaagctgcggagcctgctgatgtatgccttcggcctgctggaggtgtccctggtggtggccgtggccacccccctgcccctgtggcccagctgccactgcttcagcagcaccctgggcttccgctggctggccgccaacgtggagctgctgggcaatggcctggtgtttgctgctgccacctgtgctgtgctgagcaaggcccacctgtctgctggcctggtgggcttctctgtgtctgctgccctgcaggtgacccagaccctgcagtgggtggtgaggaactggacagacctggagaacagcatcgtgtctgtggagaggatgcaggactatgcctggacccccaaggaggccccctggaggctgcccacctgtgccgcccagcccccctggccccagggcggccagatcgagttccgggactttggcctgcgctacagacctgagctgcccctggccgtgcagggcgtgtccttcaagatccatgctggggagaaggtgggcatcgtgggccgcactggagctgggaagagcagcctggccagcggcctgctgcggctgcaggaggccgctgagggcggcatctggattgatggagtgcccatcgcccacgtgggcctgcacaccctgcggagccgcatcagcatcatcccccaggaccccatcctcttccctggcagcctgaggatgaacctggacctgctgcaggagcacagtgatgaggccatctgggccgccctggagaccgtgcagctgaaggccctggtggccagcctgcccggccagctgcagtacaagtgtgccgacagaggagaggacctgtctgtgggccagaagcagctgctgtgcctggcccgggccctgctgaggaagacccagatcctgatcctggatgaggccacagctgctgtggaccccggcacagagctgcagatgcaggccatgctgggctcctggtttgcccagtgcaccgtgctgctgattgcccaccggctgcggtctgtgatggactgtgcccgggtgctggtgatggacaagggccaggtggccgagagcggcagccctgcccagctgctggcccagaagggcctcttctaccgcctggcccaggagagcggcctggtgtag

SEQ ID NO: 147811 - DNA, 528 bp, Artificial Sequence
  Description of Artificial Sequence: Synthetic coding sequence
atgagccatggagctggcctggtgaggaccacctgcagcagcggcagcgccctgggccctggggccggggccgcccagcccagcgccagccccctggagggcctgctggacctgagctaccccaggacccatgctgccctgctgaaggtggcccagatggtgaccctgctgattgccttcatctgtgtgcgcagcagcctgtggaccaactacagcgcctacagctactttgaggtggtgaccatctgtgacctgatcatgatcctggccttctacctggtgcacctgttccgcttctacagagtgctgacctgcatctcctggcccctgtctgagctgctgcactacctgattggcaccctgctgctgctgattgccagcatcgtggccgccagcaagagctacaaccagagcggcctggtggccggggccatcttcggcttcatggccaccttcctgtgcatggccagcatctggctgagctacaagatcagctgtgtgacccagagcacagatgctgctgtgtag

SEQ ID NO: 147812 - DNA, 429 bp, Artificial Sequence
  Description of Artificial Sequence: Synthetic coding sequence
atgagccatggagctggcctggtgaggaccacctgcagcagcggcagcgccctgggccctggggccggggccgcccagcccagcgccagccccctggagggcctgctggacctgagctaccccaggacccatgctgccctgctgaaggtggcccagatggtgaccctgctgattgccttcatctgtgtgcgcagcagcctgtggaccaactacagcgcctacagctactttgaggtggtgaccatctgtgacctgatcatgatcctggccttctacctggtgcacctgttccgcttctacagagtgctgacctgcatctcctggcccctgagcatcttcggcttcatggccaccttcctgtgcatggccagcatctggctgagctacaagatcagctgtgtgacccagagcacagatgctgctgtgtag

SEQ ID NO: 147813 - DNA, 522 bp, Artificial Sequence
  Description of Artificial Sequence: Synthetic coding sequence
atggaggagccccagagggcccggagccacacagtgaccaccacagccagcagctttgctgagaacttcagcaccagcagcagcagctttgcctatgaccgggagttcctgcggaccctgcccggcttcctgattgtggccgagatcgtgctgggcctgctggtgtggaccctgattgctggaacagagtacttccgggtgcctgccttcggctgggtgatgtttgtggccgtgttctactgggtgctgaccgtcttcttcctgatcatctacatcaccatgacctacacccgcatcccccaggtgccctggaccaccgtgggcctgtgcttcaacggcagcgcctttgtgctgtacctgtctgctgctgtggtggatgccagctctgtgtccccagagcgggacagccacaacttcaacagctgggccgccagcagcttctttgccttcctggtgaccatctgctacgccggcaacacctacttctccttcatcgcctggaggagcaggaccatccagtag

SEQ ID NO: 147814 - DNA, 363 bp, Artificial Sequence
  Description of Artificial Sequence: Synthetic coding sequence
atgcaggccctgcagcagcagcccgtcttcccagacctgctgaaggccatccctgtgtccatccacgtgaatgtcatcctcttcagcgccatcctgattgtgctgaccatggtgggcacagccttcttcatgtacaatgccttcggcaagccctttgagaccctgcacggccccctgggcctgtacctgctgtccttcatcagcggcagctgtggctgcctggtgatgatcctgtttgccagcgaggtgaagatccaccacctgtctgagaagatcgccaactacaaggagggcacctacgtgtacaagacccagagcgagaagtacaccaccagcttctggctgaccaagggccacagctag

SEQ ID NO: 147815 - DNA, 699 bp, Artificial Sequence
  Description of Artificial Sequence: Synthetic coding sequence
atgcccagccagcagaagaagatcatcttctgcatggccggggtcttctcctttgcctgtgccctgggcgtggtgacagccctgggcacccccctgtggatcaaggccaccgtgctgtgcaagacaggagccctgctggtgaatgccagcggccaggagctggacaagttcatgggagagatgcagtatggcctcttccatggagagggcgtgcggcagtgtggcctgggcgcccggcccttccgcttctccttcttcccagacctgctgaaggccatccctgtgtccatccacgtgaatgtcatcctcttcagcgccatcctgattgtgctgaccatggtgggcacagccttcttcatgtacaatgccttcggcaagccctttgagaccctgcacggccccctgggcctgtacctgctgtccttcatcagcggcagctgtggctgcctggtgatgatcctgtttgccagcgaggtgaagatccaccacctgtctgagaagatcgccaactacaaggagggcacctacgtgtacaagacccagagcgagaagtacaccaccagcttctgggtgatcttcttctgcttctttgtgcacttcctgaatggcctgctgatccggctggccggcttccagttcccctttgccaagagcaaggatgctgagaccaccaacgtggccgctgacctgatgtactag

SEQ ID NO: 147816 - DNA, 738 bp, Artificial Sequence
  Description of Artificial Sequence: Synthetic coding sequence
atgcccagccagcagaagaagatcatcttctgcatggccggggtcttctcctttgcctgtgccctgggcgtggtgacagccctgggcacccccctgtggatcaaggccaccgtgctgtgcaagacaggagccctgctggtgaatgccagcggccaggagctggacaagttcatgggagagatgcagtatggcctcttccatggagagggcgtgcggcagtgtggcctgggcgcccggcccttccgcttctccttcttcccagacctgctgaaggccatccctgtgtccatccacgtgaatgtcatcctcttcagcgccatcctgattgtgctgaccatggtgggcacagccttcttcatgtacaatgccttcggcaagccctttgagaccctgcacggccccctgggcctgtacctgctgtccttcatctctgtggccctgtggctgcctgccaccaggcaccaggcccagggcagctgtggctgcctggtgatgatcctgtttgccagcgaggtgaagatccaccacctgtctgagaagatcgccaactacaaggagggcacctacgtgtacaagacccagagcgagaagtacaccaccagcttctgggtgatcttcttctgcttctttgtgcacttcctgaatggcctgctgatccggctggccggcttccagttcccctttgccaagagcaaggatgctgagaccaccaacgtggccgctgacctgatgtactag

SEQ ID NO: 147817 - DNA, 348 bp, Artificial Sequence
  Description of Artificial Sequence: Synthetic coding sequence
atgcaggccctgcagcagcagcccgtcttcccagacctgctgaaggccatccctgtgtccatccacgtgaatgtcatcctcttcagcgccatcctgattgtgctgaccatggtgggcacagccttcttcatgtacaatgccttcggcaagccctttgagaccctgcacggccccctgggcctgtacctgctgtccttcatcagcggcagctgtggctgcctggtgatgatcctgtttgccagcgaggtgaagatccaccacctgtctgagaagatcgccaactacaaggagggcacctacgtgtacaagacccagagcgagaagtacaccaccagcttctgggtgtag

SEQ ID NO: 147818 - DNA, 1878 bp, Artificial Sequence
  Description of Artificial Sequence: Synthetic coding sequence
atgaactacagcgagattgagagcaaggtgcgggaggccaccaatgatgacccctggggccccagcggccagctgatgggagaaattgccaaggccaccttcatgtatgagcagtttcctgagctgatgaacatgctgtggagcaggatgctgaaggacaacaagaagaactggaggagagtgtacaagagcctgctgctgctggcctacctgatcagaaatggcagcgagcgggtggtgaccagcgcccgggagcacatctatgacctgcggagcctggagaactaccactttgtggatgagcacggcaaggaccagggcatcaacatccggcagaaggtgaaggagctggtggagtttgcccaggatgatgaccggctgcgggaggagaggaagaaggccaagaagaacaaggacaagtatgtgggcgtgtccagtgacagcgtgggcggcttccgctacagcgagagatatgaccctgagcccaagagcaagtgggatgaggagtgggacaagaacaagagcgccttccccttcagtgacaagctgggggagctgagtgacaagattggcagcaccattgatgacaccatcagcaagttccggaggaaggaccgggaggacagccctgagcgctgcagcgacagtgatgaggagaagaaggcccggcggggccgcagccccaagggggagttcaaggatgaggaggagaccgtgaccaccaagcacatccacatcacccaggccacagagaccaccaccaccaggcacaagaggacagccaaccccagcaagaccatcgacctgggcgccgccgcccactacaccggggacaaggccagcccagaccagaatgccagcacccacaccccccagagctctgtgaagacctctgtgcccagcagcaagagcagcggggacctggtggacctgtttgatggcaccagccagagcactggaggcagcgctgacctgtttggaggctttgctgactttggcagcgctgctgccagcggcagcttccccagccaggtgacagccaccagcggaaatggagactttggagactggagcgccttcaaccaggcccccagcggccctgtggccagcagtggagagttctttggaagtgccagccagcctgctgtggagctggtgtctggcagccagagcgccctgggccccccacctgctgccagcaacagcagtgacctgtttgacctgatgggcagcagccaggccaccatgaccagcagccagagcatgaacttctccatgatgagcaccaacacagtgggcctgggcctgcccatgagccgcagccagcccctgcagaatgtgtccacagtgctgcagaagcccaaccccctgtacaaccagaacacagacatggtgcagaagtctgtgtccaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaatgtgatgacccagagctttggagctgtgaacctgagcagccccagcaacatgctgcctgtgcggccccagaccaatgccctgattggaggccccatgcccatgtccatgcccaacgtgatgacaggcaccatgggcatggcccccctgggcaacacccccatgatgaaccagagcatgatgggcatgaacatgaacatcggcatgtctgctgctggcatgggcctgaccggcaccatgggcatgggcatgcccaacatcgccatgaccagcggcaccgtgcagcccaagcaggatgcctttgccaactttgccaacttcagcaagtag

SEQ ID NO: 147819 - DNA, 1878 bp, Artificial Sequence
  Description of Artificial Sequence: Synthetic coding sequence
atgctgaacatgtggaaggtgcgggagctggtggacaaggccaccaacgtggtgatgaactacagcgagattgagagcaaggtgcgggaggccaccaatgatgacccctggggccccagcggccagctgatgggagaaattgccaaggccaccttcatgtatgagcagtttcctgagctgatgaacatgctgtggagcaggatgctgaaggacaacaagaagaactggaggagagtgtacaagagcctgctgctgctggcctacctgatcagaaatggcagcgagcgggtggtgaccagcgcccgggagcacatctatgacctgcggagcctggagaactaccactttgtggatgagcacggcaaggaccagggcatcaacatccggcagaaggtgaaggagctggtggagtttgcccaggatgatgaccggctgcgggaggagaggaagaaggccaagaagaacaaggacaagtatgtgggcgtgtccagtgacagcgtgggcggcttccgctacagcgagagatatgaccctgagcccaagagcaagtgggatgaggagtgggacaagaacaagagcgccttccccttcagtgacaagctgggggagctgagtgacaagattggcagcaccattgatgacaccatcagcaagttccggaggaaggaccgggaggacagccctgagcgctgcagcgacagtgatgaggagaagaaggcccggcggggccgcagccccaagggggagttcaaggatgaggaggagaccgtgaccaccaagcacatccacatcacccaggccacagagaccaccaccaccaggcacaagaggacagccaaccccagcaagaccatcgacctgggcgccgccgcccactacaccggggacaaggccagcccagaccagaatgccagcacccacaccccccagagctctgtgaagacctctgtgcccagcagcaagagcagcggggacctggtggacctgtttgatggcaccagccagagcactggaggcagcgctgacctgtttggaggctttgctgactttggcagcgctgctgccagcggcagcttccccagccaggtgacagccaccagcggaaatggagactttggagactggagcgccttcaaccaggcccccagcggccctgtggccagcagtggagagttctttggaagtgccagccagcctgctgtggagctggtgtctggcagccagagcgccctgggccccccacctgctgccagcaacagcagtgacctgtttgacctgatgggcagcagccaggccaccatgaccagcagccagagcatgaacttctccatgatgagcaccaacacagtgggcctgggcctgcccatgagccgcagccagaacacagacatggtgcagaagtctgtgtccaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaatgtgatgacccagagctttggagctgtgaacctgagcagccccagcaacatgctgcctgtgcggccccagaccaatgccctgattggaggccccatgcccatgtccatgcccaacgtgatgacaggcaccatgggcatggcccccctgggcaacacccccatgatgaaccagagcatgatgggcatgaacatgaacatcggcatgtctgctgctggcatgggcctgaccggcaccatgggcatgggcatgcccaacatcgccatgaccagcggcaccgtgcagcccaagcaggatgcctttgccaactttgccaacttcagcaagtag

SEQ ID NO: 147820 - DNA, 1878 bp, Artificial Sequence; identical to SEQ ID NO: 147818
  Description of Artificial Sequence: Synthetic coding sequence

SEQ ID NO: 147821 - DNA, 1878 bp, Artificial Sequence; identical to SEQ ID NO: 147818
  Description of Artificial Sequence: Synthetic coding sequence

SEQ ID NO: 147822 - DNA, 1932 bp, Artificial Sequence
  Description of Artificial Sequence: Synthetic coding sequence
atgctgaacatgtggaaggtgcgggagctggtggacaaggccaccaacgtggtgatgaactacagcgagattgagagcaaggtgcgggaggccaccaatgatgacccctggggccccagcggccagctgatgggagaaattgccaaggccaccttcatgtatgagcagtttcctgagctgatgaacatgctgtggagcaggatgctgaaggacaacaagaagaactggaggagagtgtacaagagcctgctgctgctggcctacctgatcagaaatggcagcgagcgggtggtgaccagcgcccgggagcacatctatgacctgcggagcctggagaactaccactttgtggatgagcacggcaaggaccagggcatcaacatccggcagaaggtgaaggagctggtggagtttgcccaggatgatgaccggctgcgggaggagaggaagaaggccaagaagaacaaggacaagtatgtgggcgtgtccagtgacagcgtgggcggcttccgctacagcgagagatatgaccctgagcccaagagcaagtgggatgaggagtgggacaagaacaagagcgccttccccttcagtgacaagctgggggagctgagtgacaagattggcagcaccattgatgacaccatcagcaagttccggaggaaggaccgggaggacagccctgagcgctgcagcgacagtgatgaggagaagaaggcccggcggggccgcagccccaagggggagttcaaggatgaggaggagaccgtgaccaccaagcacatccacatcacccaggccacagagaccaccaccaccaggcacaagaggacagccaaccccagcaagaccatcgacctgggcgccgccgcccactacaccggggacaaggccagcccagaccagaatgccagcacccacaccccccagagctctgtgaagacctctgtgcccagcagcaagagcagcggggacctggtggacctgtttgatggcaccagccagagcactggaggcagcgctgacctgtttggaggctttgctgactttggcagcgctgctgccagcggcagcttccccagccaggtgacagccaccagcggaaatggagactttggagactggagcgccttcaaccaggcccccagcggccctgtggccagcagtggagagttctttggaagtgccagccagcctgctgtggagctggtgtctggcagccagagcgccctgggccccccacctgctgccagcaacagcagtgacctgtttgacctgatgggcagcagccaggccaccatgaccagcagccagagcatgaacttctccatgatgagcaccaacacagtgggcctgggcctgcccatgagccgcagccagcccctgcagaatgtgtccacagtgctgcagaagcccaaccccctgtacaaccagaacacagacatggtgcagaagtctgtgtccaagaccctgcccagcacctggagcgaccccagcgtgaacatcagcctggacaacctgctgcccggcatgcagcccagcaagccccagcagcccagcctgaacaccatgatccagcagcagaacatgcagcagcccatgaatgtgatgacccagagctttggagctgtgaacctgagcagccccagcaacatgctgcctgtgcggccccagaccaatgccctgattggaggccccatgcccatgtccatgcccaacgtgatgacaggcaccatgggcatggcccccctgggcaacacccccatgatgaaccagagcatgatgggcatgaacatgaacatcggcatgtctgctgctggcatgggcctgaccggcaccatgggcatgggcatgcccaacatcgccatgaccagcggcaccgtgcagcccaagcaggatgcctttgccaactttgccaacttcagcaagtag

SEQ ID NO: 147823 - DNA, 5028 bp, Artificial Sequence
  Description of Artificial Sequence: Synthetic coding sequence
atggcccagatcctgcccatccgcttccaggagcacctgcagctgcagaacctgggcatcaacccagccaacatcggcttcagcaccctgaccatggagagtgacaagttcatctgcatccgggagaaggtgggggagcaggcccaggtggtgatcatcgacatgaatgaccccagcaaccccatcagaagacccatctctgctgacagcgccatcatgaacccagccagcaaggtgattgccctgaaggccggcaagaccctgcagatcttcaacatcgagatgaagagcaagatgaaggcccacaccatgacagatgatgtgaccttctggaagtggatcagcctgaacacagtggccctggtgacagacaatgctgtgtaccactggagcatggagggggagagccagcctgtgaagatgtttgacagacacagcagcctggccggctgccagatcatcaactacagaacagatgccaagcagaagtggctgctgctgaccggcatcagcgcccagcagaacagagtggtgggcgccatgcagctgtacagcgtggacaggaaggtgtcccagcccatcgagggccacgccgccagctttgcccagttcaagatggagggcaatgctgaggagagcaccctcttctgctttgctgtgcggggccaggccggcggcaagctgcacatcatcgaggtgggcaccccacccaccggcaaccagcccttccccaagaaggctgtggatgtgttcttccccccagaggcccagaatgacttccctgtggccatgcagatcagcgagaagcatgatgtggtgttcctgatcaccaagtatggctacatccacctgtatgacctggagaccggcacctgcatctacatgaaccgcatctctggagagaccatctttgtgacagcccctcatgaggccacagctggcatcatcggcgtgaacaggaagggccaggtgctgtctgtgtgtgtggaggaggagaacatcatcccctacatcaccaacgtgctgcagaacccagacctggccctgaggatggctgtgaggaacaacctggccggggctgaggagctgtttgccaggaagttcaatgccctgtttgcccagggcaactacagcgaggccgccaaggtggccgccaatgcccccaagggcatcctgcggaccccagacaccatccgccgcttccagagcgtgcctgcccagcccggccagaccagccccctgctgcagtacttcggcatcctgctggaccagggccagctgaacaagtatgagagcctggagctgtgcaggcctgtgctgcagcagggcaggaagcagctgctggagaagtggctgaaggaggacaagctggagtgcagcgaggagctgggggacctggtgaagtctgtggaccccaccctggccctgtctgtgtacctgcgggccaacgtgcccaacaaggtgatccagtgctttgctgagaccggccaggtgcagaagatcgtgctgtatgccaagaaggtgggctacaccccagactggatcttcctgctgagaaatgtgatgaggatcagcccagaccagggccagcagtttgcccagatgctggtgcaggatgaggagcccctggccgacatcacccagatcgtggatgtgttcatggagtacaacctgatccagcagtgcacagccttcctgctggatgccctgaagaacaaccggcccagcgagggccccctgcagacccggctgctggagatgaacctgatgcacgccccccaggtggctgatgccatcctgggcaaccagatgttcacccactatgaccgggcccacatcgcccagctgtgtgagaaggccggcctgctgcagagggccctggagcacttcacagacctgtatgacatcaagagagctgtggtgcacacccacctgctgaaccctgagtggctggtgaactacttcggcagcctgtctgtggaggacagcctggagtgcctgcgggccatgctgagcgccaacatccggcagaacctgcagatctgtgtgcaggtggccagcaagtaccacgagcagctgagcacccagagcctgattgagctgtttgagagcttcaagagctttgagggcctcttctacttcctgggcagcatcgtgaacttcagccaggaccctgatgtgcacttcaagtacatccaggccgcctgcaagacaggccagatcaaggaggtggagcgcatctgccgggagagcaactgctatgaccctgagcgggtgaagaacttcctgaaggaggccaagctgacagaccagctgcccctcatcatcgtgtgtgacagatttgattttgtgcatgacctggtgctgtacctgtacagaaacaacctgcagaagtacatcgagatctacgtgcagaaggtgaaccccagccggctgcctgtggtgattggaggcctgctggatgtggactgcagtgaagatgtgatcaagaacctgatcctggtggtgcggggccagttcagcacagatgagctggtggccgaggtggagaagaggaaccggctgaagctgctgctgccctggctggaggcccgcatccacgagggctgtgaggagcccgccacccacaatgccctggccaagatctacatcgacagcaacaacaaccctgagcgcttcctgcgggagaacccctactatgacagccgggtggtgggcaagtactgtgagaagagggacccccacctggcctgtgtggcctatgagcggggccagtgtgacctggagctgatcaacgtgtgcaatgaaaacagcctcttcaagagcctgagccgctacctggtgcggaggaaggaccctgagctgtggggctctgtgctgctggagagcaacccctacagaagacccctgattgaccaggtggtgcagacagccctgtctgagacccaggaccctgaggaggtgtctgtgacagtgaaggccttcatgacagctgacctgcccaatgagctgattgagctgctggagaagatcgtgctggacaacagcgtcttcagcgagcacaggaacctgcagaacctgctgatcctgacagccatcaaggctgacaggaccagggtgatggagtacatcaaccggctggacaactatgatgccccagacatcgccaacatcgccatcagcaatgagctgtttgaggaggcctttgccatcttcaggaagtttgatgtgaacaccagcgctgtgcaggtgctgattgagcacatcggcaacctggaccgggcctatgaatttgctgagcgctgcaatgaacctgctgtgtggagccagctggccaaggcccagctgcagaagggcatggtgaaggaggccatcgacagctacatcaaggcagatgaccccagcagctacatggaggtggtgcaggccgccaacaccagcggcaactgggaggagctggtgaagtacctgcagatggccaggaagaaggcccgggagagctatgtggagacagagctgatctttgccctggccaagaccaaccggctggccgagctggaggagttcatcaatggccccaacaatgcccacatccagcaggtgggggaccgctgctatgatgagaagatgtatgatgctgccaagctgctgtacaacaacgtgagcaactttggccgcctggccagcaccctggtgcacctgggggagtaccaggccgctgtggatggagccaggaaggccaacagcaccaggacctggaaggaggtgtgctttgcctgtgtggatggcaaggagttccggctggcccagatgtgtggcctgcacatcgtggtgcatgctgatgagctggaggagctgatcaactactaccaggaccggggctactttgaggagctgatcaccatgctggaggccgccctgggcctggagcgggcccacatgggcatgttcacagagctggccatcctgtacagcaagttcaagccccagaagatgagggagcacctggagctgttctggagccgggtgaacatccccaaggtgctgcgggctgctgagcaggcccacctgtgggccgagctggtgttcctgtatgacaagtatgaggagtatgacaatgccatcatcaccatgatgaaccaccccacagatgcctggaaggagggccagttcaaggacatcatcaccaaggtggccaacgtggagctgtactaccgggccatccagttctacctggagttcaagcccctgctgctgaatgacctgctgatggtgctgagcccccggctggaccacaccagggctgtgaactacttcagcaaggtgaagcagctgcccctggtgaagccctacctgcggtctgtgcagaaccacaacaacaagtctgtgaatgaaagcctgaacaacctcttcatcacagaggaggactaccaggccctgcggaccagcattgatgcctatgacaactttgacaacatcagcctggcccagaggctggagaagcatgagctgattgagttcagaagaattgctgcctacctgttcaagggcaacaaccgctggaagcagagcgtggagctgtgcaagaaggacagcctgtacaaggatgccatgcagtatgccagcgagagcaaggacacagagctggccgaggagctgctgcagtggttcctgcaggaggagaagcgggagtgcttcggggcctgcctcttcacctgctatgacctgctgcggccagatgtggtgctggagacagcctggaggcacaacatcatggactttgccatgccctacttcatccaggtgatgaaggagtacctgaccaaggtggacaagctggatgccagcgagagcctgaggaaggaggaggagcaggccacagagacccagcccatcgtgtatggccagccccagctgatgctgacagctggccccagcgtggccgtgcccccccaggcccccttcggctacggctacacagccccaccctacggccagccccagcccggcttcggctacagcatgtag

SEQ ID NO: 147824 - DNA, 4923 bp, Artificial Sequence
  Description of Artificial Sequence: Synthetic coding sequence
atggcccagatcctgcctgtgcgcttccaggagcacttccagctgcagaacctgggcatcaacccagccaacatcggcttcagcaccctgaccatggagagtgacaagttcatctgcatccgggagaaggtgggggagcaggcccaggtgaccatcatcgacatgtctgaccccatggcccccatcagaagacccatctctgctgagagcgccatcatgaacccagccagcaaggtgattgccctgaaggccggcaagaccctgcagatcttcaacatcgagatgaagagcaagatgaaggcccacaccatggccgaggaggtgatcttctggaagtgggtgtctgtgaacacagtggccctggtgacagaaacagctgtgtaccactggagcatggagggggacagccagcccatgaagatgtttgacagacacaccagcctggtgggctgccaggtgatccactacagaacagatgagtaccagaagtggctgctgctggtgggcatcagcgcccagcagaacagagtggtgggcgccatgcagctgtacagcgtggacaggaaggtgtcccagcccatcgagggccacgccgccgcctttgctgagttcaagatggagggcaatgccaagccagccaccctcttctgctttgctgtgaggaaccccaccggcggcaagctgcacatcatcgaggtgggccagcctgctgctggcaaccagccctttgtgaagaaggctgtggatgtgttcttccccccagaggcccagaatgacttccctgtggccatgcagatcggggccaagcacggcgtcatctacctgatcaccaagtatggctacctgcacctgtatgacctggagagcggcgtgtgcatctgcatgaaccgcatctctgctgacaccatctttgtgacagccccccacaagcccaccagcggcatcatcggcgtgaacaagaagggccaggtgctgtctgtgtgtgtggaggaggacaacatcgtgaactatgccaccaacgtgctgcagaacccagacctgggcctgcggctggccgtgcgcagcaacctggccggggctgagaagctgtttgtgaggaagttcaacaccctgtttgcccagggcagctatgcagaggccgccaaggtggccgccagcgcccccaagggcatcctgcggacccgggagaccgtgcagaagttccagagcatcccagcccagagcggccaggccagccccctgctgcagtacttcggcatcctgctggaccagggccagctgaacaagctggagagcctggagctgtgccacctggtgctgcagcagggcaggaagcagctgctggagaagtggctgaaggaggacaagctggagtgcagcgaggagctgggggacctggtgaagaccacagaccccatgctggccctgtctgtgtacctgcgggccaacgtgcccagcaaggtgatccagtgctttgctgagaccggccagttccagaagatcgtgctgtatgccaagaaggtgggctacaccccagactggatcttcctgctgcggggcgtgatgaagatcagccctgagcagggcctgcagttcagcaggatgctggtgcaggatgaggagcccctggccaacatcagccagatcgtggacatcttcatggagaacagcctcatccagcagtgcaccagcttcctgctggatgccctgaagaacaacagacctgctgagggcctgctgcagacctggctgctggagatgaacctggtgcacgccccccaggtggctgatgccatcctgggcaacaagatgttcacccactatgaccgggcccacatcgcccagctgtgtgagaaggccggcctgctgcagcaggccctggagcactacacagacctgtatgacatcaagagagctgtggtgcacacccacctgctgaaccctgagtggctggtgaacttcttcggcagcctgtctgtggaggacagcgtggagtgcctgcacgccatgctgagcgccaacatccggcagaacctgcagctgtgtgtgcaggtggccagcaagtaccacgagcagctgggcacccaggccctggtggagctgtttgagagcttcaagagctacaagggcctcttctacttcctgggcagcatcgtgaacttcagccaggaccctgatgtgcacctgaagtacatccaggccgcctgcaagacaggccagatcaaggaggtggagcgcatctgccgggagagcagctgctacaaccctgagcgggtgaagaacttcctgaaggaggccaagctgacagaccagctgcccctcatcatcgtgtgtgacagatttggatttgtgcatgacctggtgctgtacctgtacagaaacaacctgcagcgctacatcgagatctacgtgcagaaggtgaaccccagcaggaccccagctgtgattggaggcctgctggatgtggactgcagcgaggaggtgatcaagcacctgatcatggctgtgcggggccagttcagcacagatgagctggtggccgaggtggagaagaggaaccggctgaagctgctgctgccctggctggagagccagatccaggagggctgtgaggagcccgccacccacaatgccctggccaagatctacatcgacagcaacaacagccctgagtgcttcctgcgggagaatgcctactatgacagctctgtggtgggccgctactgtgagaagagggacccccacctggcctgtgtggcctatgagcggggccagtgtgacctggagctgatcaaggtgtgcaatgaaaacagcctcttcaagtctgaggcccgctacctggtgtgcaggaaggaccctgagctgtgggcccacgtgctggaggagaccaaccccagccggcggcagctgattgaccaggtggtgcagacagccctgtctgagacccgggaccctgaggagatctctgtgacagtgaaggccttcatgacagctgacctgcccaatgagctgattgagctgctggagaagatcgtgctggacaacagcgtcttcagcgagcacaggaacctgcagaacctgctgatcctgacagccatcaaggctgacaggaccagggtgatggagtacatcagccggctggacaactatgatgccctggacatcgccagcattgctgtgagcagcgccctgtatgaggaggccttcaccgtcttccacaagtttgacatgaatgccagcgccatccaggtgctgattgagcacatcggcaacctggaccgggcctatgaatttgctgagcgctgcaatgaacctgctgtgtggagccagctggcccaggcccagctgcagaaggacctggtgaaggaggccatcaacagctacatcagaggagatgaccccagcagctacctggaggtggtgcagagcgccagccgcagcaacaactgggaggacctggtgaagttcctgcagatggccaggaagaagggccgggagagctacattgaaacagagctgatctttgccctggccaagaccagccgggtgtctgagctggaggacttcatcaatggccccaacaatgcccacatccagcaggtgggggaccgctgctatgaggagggcatgtatgaagctgccaagctgctgtacagcaatgtgagcaactttgcccggctggccagcaccctggtgcacctgggggagtaccaggccgctgtggacaacagcaggaaggccagcagcaccaggacctggaaggaggtgtgctttgcctgcatggatggccaggagttccgctttgcccagctgtgtggcctgcacatcgtcatccacgcagatgagctggaggagctgatgtgctactaccaggaccggggctactttgaggagctgatcctgctgctggaggccgccctgggcctggagcgggcccacatgggcatgttcacagagctggccatcctgtacagcaagttcaagccccagaagatgctggagcacctggagctgttctggagccgggtgaacatccccaaggtgctgcgggctgctgagcaggcccacctgtgggccgagctggtgttcctgtatgacaagtatgaggagtatgacaatgctgtgctgaccatgatgagccaccccacagaggcctggaaggagggccagttcaaggacatcatcaccaaggtggccaacgtggagctgtgctaccgggccctgcagttctacctggactacaagcccctgctgatcaatgacctgctgctggtgctgagcccccggctggaccacacctggacagtgtccttcttcagcaaggccggccagctgcccctggtgaagccctacctgcggtctgtgcagagccacaacaacaagtctgtgaatgaggccctgaaccacctgctgacagaggaggaggactaccagggcctgcgggccagcattgatgcctatgacaactttgacaacatcagcctggcccagcagctggagaagcaccagctgatggagttccgctgcatcgccgcctacctgtacaagggcaacaactggtgggcccagagcgtggagctgtgcaagaaggaccacctgtacaaggatgccatgcagcacgccgctgagagcagagatgctgagctggcccagaagctgctgcagtggttcctggaggagggcaagcgggagtgctttgctgcctgcctcttcacctgctatgacctgctgcggccagacatggtgctggagctggcctggaggcacaacctggtggacctggccatgccctacttcatccaggtgatgagggagtacctgagcaaggtggacaagctggatgccctggagagcctgaggaagcaggaggagcacgtgacagagcccgcccccctggtgtttgattttgatggccatgaatag

SEQ ID NO: 147825 - DNA, 4752 bp, Artificial Sequence
  Description of Artificial Sequence: Synthetic coding sequence
atggcccagatcctgcctgtgcgcttccaggagcacttccagctgcagaacctgggcatcaacccagccaacatcggcttcagcaccctgaccatggagagtgacaagttcatctgcatccgggagaaggtgggggagcaggcccaggtgaccatcatcgacatgtctgaccccatggcccccatcagaagacccatctctgctgagagcgccatcatgaacccagccagcaaggtgattgccctgaaggccggcaagaccctgcagatcttcaacatcgagatgaagagcaagatgaaggcccacaccatggccgaggaggtgatcttctggaagtgggtgtctgtgaacacagtggccctggtgacagaaacagctgtgtaccactggagcatggagggggacagccagcccatgaagatgtttgacagacacaccagcctggtgggctgccaggtgatccactacagaacagatgagtaccagaagtggctgctgctggtgggcatcagcgcccagcagaacagagtggtgggcgccatgcagctgtacagcgtggacaggaaggtgtcccagcccatcgagggccacgccgccgcctttgctgagttcaagatggagggcaatgccaagccagccaccctcttctgctttgctgtgaggaaccccaccggcggcaagctgcacatcatcgaggtgggccagcctgctgctggcaaccagccctttgtgaagaaggctgtggatgtgttcttccccccagaggcccagaatgacttccctgtggccatgcagatcggggccaagcacggcgtcatctacctgatcaccaagtatggctacctgcacctgtatgacctggagagcggcgtgtgcatctgcatgaaccgcatctctgctgacaccatctttgtgacagccccccacaagcccaccagcggcatcatcggcgtgaacaagaagggccaggtgctgtctgtgtgtgtggaggaggacaacatcgtgaactatgccaccaacgtgctgcagaacccagacctgggcctgcggctggccgtgcgcagcaacctggccggggctgagaagctgtttgtgaggaagttcaacaccctgtttgcccagggcagctatgcagaggccgccaaggtggccgccagcgcccccaagggcatcctgcggacccgggagaccgtgcagaagttccagagcatcccagcccagagcggccaggccagccccctgctgcagtacttcggcatcctgctggaccagggccagctgaacaagctggagagcctggagctgtgccacctggtgctgcagcagggcaggaagcagctgctggagaagtggctgaaggaggacaagctggagtgcagcgaggagctgggggacctggtgaagaccacagaccccatgctggccctgtctgtgtacctgcgggccaacgtgcccagcaaggtgatccagtgctttgctgagaccggccagttccagaagatcgtgctgtatgccaagaaggtgggctacaccccagactggatcttcctgctgcggggcgtgatgaagatcagccctgagcagggcctgcagttcagcaggatgctggtgcaggatgaggagcccctggccaacatcagccagatcgtggacatcttcatggagaacagcctcatccagcagtgcaccagcttcctgctggatgccctgaagaacaacagacctgctgagggcctgctgcagacctggctgctggagatgaacctggtgcacgccccccaggtggctgatgccatcctgggcaacaagatgttcacccactatgaccgggcccacatcgcccagctgtgtgagaaggccggcctgctgcagcaggccctggagcactacacagacctgtatgacatcaagagagctgtggtgcacacccacctgctgaaccctgagtggctggtgaacttcttcggcagcctgtctgtggaggacagcgtggagtgcctgcacgccatgctgagcgccaacatccggcagaacctgcagctgtgtgtgcaggtggccagcaagtaccacgagcagctgggcacccaggccctggtggagctgtttgagagcttcaagagctacaagggcctcttctacttcctgggcagcatcgtgaacttcagccaggaccctgatgtgcacctgaagtacatccaggccgcctgcaagacaggccagatcaaggaggtggagcgcatctgccgggagagcagctgctacaaccctgagcgggtgaagaacttcctgaaggaggccaagctgacagaccagctgcccctcatcatcgtgtgtgacagatttggatttgtgcatgacctggtgctgtacctgtacagaaacaacctgcagcgctacatcgagatctacgtgcagaaggtgaaccccagcaggaccccagctgtgattggaggcctgctggatgtggactgcagcgaggaggtgatcaagcacctgatcatggctgtgcggggccagttcagcacagatgagctggtggccgaggtggagaagaggaaccggctgaagctgctgctgccctggctggagagccagatccaggagggctgtgaggagcccgccacccacaatgccctggccaagatctacatcgacagcaacaacagccctgagtgcttcctgcgggagaatgcctactatgacagctctgtggtgggccgctactgtgagaagagggacccccacctggcctgtgtggcctatgagcggggccagtgtgacctggagctgatcaaggtgtgcaatgaaaacagcctcttcaagtctgaggcccgctacctggtgtgcaggaaggaccctgagctgtgggcccacgtgctggaggagaccaaccccagccggcggcagctgattgaccaggtggtgcagacagccctgtctgagacccgggaccctgaggagatctctgtgacagtgaaggccttcatgacagctgacctgcccaatgagctgattgagctgctggagaagatcgtgctggacaacagcgtcttcagcgagcacaggaacctgcagaacctgctgatcctgacagccatcaaggctgacaggaccagggtgatggagtacatcagccggctggacaactatgatgccctggacatcgccagcattgctgtgagcagcgccctgtatgaggaggccttcaccgtcttccacaagtttgacatgaatgccagcgccatccaggtgctgattgagcacatcggcaacctggaccgggcctatgaatttgctgagcgctgcaatgaacctgctgtgtggagccagctggcccaggcccagctgcagaaggacctggtgaaggaggccatcaacagctacatcagaggagatgaccccagcagctacctggaggtggtgcagagcgccagccgcagcaacaactgggaggacctggtgaagttcctgcagatggccaggaagaagggccgggagagctacattgaaacagagctgatctttgccctggccaagaccagccgggtgtctgagctggaggacttcatcaatggccccaacaatgcccacatccagcaggtgggggaccgctgctatgaggagggcatgtatgaagctgccaagctgctgtacagcaatgtgagcaactttgcccggctggccagcaccctggtgcacctgggggagtaccaggccgctgtggacaacagcaggaaggccagcagcaccaggacctggaaggaggtgtgctttgcctgcatggatggccaggagttccgctttgcccagctgtgtggcctgcacatcgtcatccacgcagatgagctggaggagctgatgtgctactaccaggaccggggctactttgaggagctgatcctgctgctggaggccgccctgggcctggagcgggcccacatgggcatgttcacagagctggccatcctgtacagcaagttcaagccccagaagatgctggagcacctggagctgttctggagccgggtgaacatccccaaggtgctgcgggctgctgagcaggcccacctgtgggccgagctggtgttcctgtatgacaagtatgaggagtatgacaatgctgtgctgaccatgatgagccaccccacagaggcctggaaggagggccagttcaaggacatcatcaccaaggtggccaacgtggagctgtgctaccgggccctgcagttctacctggactacaagcccctgctgatcaatgacctgctgctggtgctgagcccccggctggaccacacctggacagtgtccttcttcagcaaggccggccagctgcccctggtgaagccctacctgcggtctgtgcagagccacaacaacaagtctgtgaatgaggccctgaaccacctgctgacagaggaggaggactaccaggatgccatgcagcacgccgctgagagcagagatgctgagctggcccagaagctgctgcagtggttcctggaggagggcaagagagaatgttttgctgcctgcctcttcacctgctatgacctgctgcggccagacatggtgctggagctggcctggaggcacaacctggtggacctggccatgccctacttcatccaggtgatgagggagtacctgagcaaggtggacaagctggatgccctggagagcctgaggaagcaggaggagcacgtgacagagcccgcccccctggtgtttgattttgatggccacgagtag

SEQ ID NO: 147826 - DNA, 4923 bp, Artificial Sequence; identical to SEQ ID NO: 147824
  Description of Artificial Sequence: Synthetic coding sequence

SEQ ID NO: 147827 - DNA, 747 bp, Artificial Sequence
  Description of Artificial Sequence: Synthetic coding sequence
atggccgagctggacccctttggagccccagctggggcccctgggggccctgccctgggcaatggagtggccggggccggggaggaggaccctgctgctgccttcctggcccagcaggagagcgagattgctggcattgaaaatgatgaggcctttgccatcctggatggaggagcccctggcccccagccccatggagagcccccaggcggcccagatgctgtggatggagtgatgaatggagagtactaccaggagagcaatggccccacagacagctatgctgccatcagccaggtggaccggctgcagagcgagcctgagagcatcaggaagtggagggaggagcagatggagcggctggaggccctggatgccaacagcaggaagcaggaggccgagtggaaggagaaggccatcaaggagctggaggagtggtacgcccggcaggatgagcagctgcagaagaccaaggccaacaacagagtggctgatgaggccttctacaagcagccctttgctgatgtgattggctacgtgaccaacatcaaccacccctgctacagcctggagcaggccgctgaggaggcctttgtgaatgacattgatgagagcagccctggaacagagtgggagcgggtggcccggctgtgtgacttcaaccccaagagcagcaagcaggccaaggatgtgtccaggatgaggtctgtgctgatcagcctgaagcaggcccccctggtgcactag

SEQ ID NO: 147828 - DNA, 657 bp, Artificial Sequence
  Description of Artificial Sequence: Synthetic coding sequence
atggccgagctggacccctttggagccccagctggggcccctgggggccctgccctgggcaatggagtggccggggccggggaggaggaccctgctgctgccttcctggcccagcaggagagcgagattgctggcattgaaaatgatgaggcctttgccatcctggatggaggagcccctggcccccagccccatggagagcccccaggcggcccagatgctgtggatggagtgatgaatggagagtactaccaggagagcaatggccccacagacagctatgctgccatcagccaggtggaccggctgcagagcgagcctgagagcatcaggaagtggagggaggagcagatggagcggctggaggccctggatgccaacagcaggaagcaggaggccgagtggaaggagaaggccatcaaggagctggaggagtggtacgcccggcaggatgagcagctgcagaagaccaaggccaacaacagagctgctgaggaggcctttgtgaatgacattgatgagagcagccctggaacagagtgggagcgggtggcccggctgtgtgacttcaaccccaagagcagcaagcaggccaaggatgtgtccaggatgaggtctgtgctgatcagcctgaagcaggcccccctggtgcactag

SEQ ID NO: 147829 - DNA, 711 bp, Artificial Sequence
  Description of Artificial Sequence: Synthetic coding sequence
atggccgagctggacccctttggagccccagctggggcccctgggggccctgccctgggcaatggagtggccggggccggggaggaggaccctgctgctgccttcctggcccagcaggagagcgagattgctggcattgaaaatgatgaggcctttgccatcctggatggaggagcccctggcccccagccccatggagagcccccaggcggcccagatgctgtggatggagtgatgaatggagagtactaccaggagagcaatggccccacagacagctatgctgccatcagccaggtggaccggctgcagagcgagcctgagagcatcaggaagtggagggaggagcagatggagcggctggaggccctggatgccaacagcaggaagcaggaggccgagtggaaggagaaggccatcaaggagctggaggagtggtacgcccggcaggatgagcagctgcagaagaccaaggccaacaacagagtggctgatgaggccttctacaagcagccctttgctgatgtgattggctacgtggccgctgaggaggcctttgtgaatgacattgatgagagcagccctggaacagagtgggagcgggtggcccggctgtgtgacttcaaccccaagagcagcaagcaggccaaggatgtgtccaggatgaggtctgtgctgatcagcctgaagcaggcccccctggtgcactag

SEQ ID NO: 147830 - DNA, 747 bp, Artificial Sequence; identical to SEQ ID NO: 147827
  Description of Artificial Sequence: Synthetic coding sequence

SEQ ID NO: 147831 - DNA, 693 bp, Artificial Sequence
  Description of Artificial Sequence: Synthetic coding sequence
atggccgagctggacccctttggagccccagctggggcccctgggggccctgccctgggcaatggagtggccggggccggggaggaggaccctgctgctgccttcctggcccagcaggagagcgagattgctggcattgaaaatgatgaggcctttgccatcctggatggaggagcccctggcccccagccccatggagagcccccaggcggcccagatgctgtggatggagtgatgaatggagagtactaccaggagagcaatggccccacagacagctatgctgccatcagccaggtggaccggctgcagagcgagcctgagagcatcaggaagtggagggaggagcagatggagcggctggaggccctggatgccaacagcaggaagcaggaggccgagtggaaggagaaggccatcaaggagctggaggagtggtacgcccggcaggatgagcagctgcagaagaccaaggccaacaacagcaccaacatcaaccacccctgctacagcctggagcaggccgctgaggaggcctttgtgaatgacattgatgagagcagccctggaacagagtgggagcgggtggcccggctgtgtgacttcaaccccaagagcagcaagcaggccaaggatgtgtccaggatgaggtctgtgctgatcagcctgaagcaggcccccctggtgcactag

SEQ ID NO: 147832 - DNA, 693 bp, Artificial Sequence; identical to SEQ ID NO: 147831
  Description of Artificial Sequence: Synthetic coding sequence

SEQ ID NO: 147833 - DNA, 501 bp, Artificial Sequence
  Description of Artificial Sequence: Synthetic coding sequence
atggccgagctggacccctttggagccccagctggggcccctgggggccctgccctgggcaatggagtggccggggccggggaggaggaccctgctgctgccttcctggcccagcaggagagcgagattgctggcattgaaaatgatgaggcctttgccatcctggatggaggagcccctggcccccagccccatggagagcccccaggcggcccagatgccaacagcaggaagcaggaggccgagtggaaggagaaggccatcaaggagctggaggagtggtacgcccggcaggatgagcagctgcagaagaccaaggccaacaacagagctgctgaggaggcctttgtgaatgacattgatgagagcagccctggaacagagtgggagcgggtggcccggctgtgtgacttcaaccccaagagcagcaagcaggccaaggatgtgtccaggatgaggtctgtgctgatcagcctgaagcaggcccccctggtgcactag

SEQ ID NO: 147834 - DNA, 690 bp, Artificial Sequence
  Description of Artificial Sequence: Synthetic coding sequence
atggctgatgactttggcttcttcagcagcagcgagagcggggcccctgaggccgcagaagaagatcctgctgctgccttcctggcccagcaggagagcgagattgctggcattgaaaatgatgagggctttggagccccagctggcagccacgccgccccagcccagcccggccccaccagcggggccggcagcgaggacatgggcaccaccgtgaatggagatgtgttccaggaggccaatggaccagcagatggctacgccgccatcgcccaggccgaccggctgacccaggagcctgagagcatcaggaagtggagggaggagcagaggaagaggctgcaggagctggatgctgccagcaaggtgacagagcaggagtggagggagaaggccaagaaggacctggaggagtggaaccagaggcagagcgagcaggtggagaagaacaagatcaacaacagaattgctgacaaggccttctaccagcagccagatgctgacatcatcggctacgtggccagcgaggaggcctttgtgaaggagagcaaggaggagaccccaggcacagagtgggagaaggtggcccagctgtgtgacttcaaccccaagagcagcaagcagtgcaaggatgtgtcccggctgcggtctgtgctgatgagcctgaagcagacccccctgagcaggtag

SEQ ID NO: 147835 - DNA, 636 bp, Artificial Sequence
  Description of Artificial Sequence: Synthetic coding sequence
atggctgatgactttggcttcttcagcagcagcgagagcggggcccctgaggccgcagaagaagatcctgctgctgccttcctggcccagcaggagagcgagattgctggcattgaaaatgatgagggctttggagccccagctggcagccacgccgccccagcccagcccggccccaccagcggggccggcagcgaggacatgggcaccaccgtgaatggagatgtgttccaggaggccaatggaccagcagatggctacgccgccatcgcccaggccgaccggctgacccaggagcctgagagcatcaggaagtggagggaggagcagaggaagaggctgcaggagctggatgctgccagcaaggtgacagagcaggagtggagggagaaggccaagaaggacctggaggagtggaaccagaggcagagcgagcaggtggagaagaacaagatcaacaacagagccagcgaggaggcctttgtgaaggagagcaaggaggagaccccaggcacagagtgggagaaggtggcccagctgtgtgacttcaaccccaagagcagcaagcagtgcaaggatgtgtcccggctgcggtctgtgctgatgagcctgaagcagacccccctgagcaggtag

SEQ ID NO: 147836 - DNA, 405 bp, Artificial Sequence
  Description of Artificial Sequence: Synthetic coding sequence
atggctgatgactttggcttcttcagcagcagcgagagcggggcccctgaggccgcagaagaagatcctgctgctgccttcctggcccagcaggagagcgagattgctggcattgaaaatgatgagggctttggagccccagctggcagccacgccgccccagcccagcccggccccaccagcggggccggcagcgaggacatgggcaccaccgtgaatggagatgtgttccagcctgtgcaccaccagagggtgcagctgcagacccagctgcccatccagcccaaggatgagcccgcccacaactacagcagcagcatctggcacagccagggccagggccagaagggccctgctggcctgcggctgcccaccagcgcccagatcctgagccccttcccctag

SEQ ID NO: 147837 - DNA, 636 bp, Artificial Sequence
  Description of Artificial Sequence: Synthetic coding sequence
atggccaatgccggcctgcagctgctgggcttcatcctggccttcctgggctggattggagccatcgtgtccacagccctgccccagtggaggatctacagctatgctggggacaacatcgtgacagcccaggccatgtatgagggcctgtggatgagctgtgtgtcccagagcacaggccagatccagtgcaaggtgtttgacagcctgctgaacctgagcagcaccctgcaggccacccgggccctgatggtggtgggcatcctgctgggcgtgattgccatctttgtggccaccgtgggcatgaagtgcatgaagtgcctggaggatgatgaggtgcagaagatgaggatggctgtgattggaggagccatcttcctgctggccggcctggccatcctggtggccacagcctggtacggcaaccgcatcgtgcaggagttctatgaccccatgacccctgtgaatgcccgctatgaatttggccaggccctcttcaccggctgggccgccgccagcctgtgcctgctgggcggggccctgctgtgctgcagctgccccaggaagaccaccagctaccccaccccccggccctaccccaagccagcccccagcagcggcaaggactatgtgtag

SEQ ID NO: 147838 - DNA, 501 bp, Artificial Sequence
  Description of Artificial Sequence: Synthetic coding sequence
atgtatgagggcctgtggatgagctgtgtgtcccagagcacaggccagatccagtgcaaggtgtttgacagcctgctgaacctgagcagcaccctgcaggccacccgggccctgatggtggtgggcatcctgctgggcgtcatcgccatctttgtggccaccgtgggcatgaagtgcatgaagtgcctggaggatgatgaggtgcagaagatgaggatggccgtcatcggcggggccatcttcctgctggccggcctggccatcctggtggccacagcctggtacggcaacagaattgtgcaggagttctatgaccccatgacccctgtgaatgcccgctatgaatttggccaggccctcttcaccggctgggccgccgccagcctgtgcctgctgggcggggccctgctgtgctgcagctgccccaggaagaccaccagctaccccaccccccggccctaccccaagccagcccccagcagcggcaaggactatgtgtag

SEQ ID NO: 147839 - DNA, 624 bp, Artificial Sequence
  Description of Artificial Sequence: Synthetic coding sequence
atggtggccacctgcctgcaggtggtgggctttgtgaccagctttgtgggctggattggagtcatcgtgaccaccagcaccaatgactgggtggtgacctgtggctacaccatccccacctgcaggaagctggatgagctgggcagcaagggcctgtgggccgactgtgtgatggccaccggcctgtaccactgcaagcccctggtggacatcctgatcctgcccggctacgtgcaggcctgccgggccctgatgattgctgcctctgtgctgggcctgcctgccatcctgctgctgctgactgtgctgccctgcatccgcatgggccaggagcccggggtggccaagtaccgccgggcccagctggccggcgtgctgctgatcctgctggccctgtgtgccctggtggccaccatctggttccctgtgtgtgcccaccgggagaccaccatcgtgtcctttggctacagcctgtatgccggctggattggagctgtgctgtgcctggtgggcggctgtgtgatcctgtgctgtgctggagatgcccaggcctttggagaaaatcgcttctactacacagctggcagcagcagccccacccacgccaagagcgcccacgtgtag

SEQ ID NO: 147840 - DNA, 498 bp, Artificial Sequence
  Description of Artificial Sequence: Synthetic coding sequence
atggtggccacctgcctgcaggtggtgggctttgtgaccagctttgtgggctggattggagtcatcgtgaccaccagcaccaatgactgggtggtgacctgtggctacaccatccccacctgcaggaagctggatgagctgggcagcaagggcctgtgggccgactgtgtgatggccaccggcctgtaccactgcaagcccctggtggacatcctgatcctgcccggctacgtgcaggcctgccgggccctgatgattgctgcctctgtgctgggcctgcctgccatcctgctgctgctgactgtgctgccctgcatccgcatgggccaggagcccggggtggccaagtaccgccgggcccagctggccggcgtgctgctgatcctgctgggctgccagctgctgtgggccaagacagagagcagcctgcacagccagcacctggtgcagttcaagcagaagtacctggaggacttctcctacctgcagggcgactag

SEQ ID NO: 147841 - DNA, 498 bp, Artificial Sequence; identical to SEQ ID NO: 147840
  Description of Artificial Sequence: Synthetic coding sequence

SEQ ID NO: 147842 - DNA, 720 bp, Artificial Sequence
  Description of Artificial Sequence: Synthetic coding sequence
atggccagcacagctgtgcagctgctgggcttcctgctgtccttcctgggcatggtgggcaccctcatcaccaccatcctgccccactggaggagaacagcccacgtgggcaccaacatcctgacagctgtgtcctacctgaagggcctgtggatggagtgtgtgtggcacagcacaggcatctaccagtgccagatctaccgcagcctgctggccctgccccaggacctgcaggccgcccgggccctgatggtgatcagctgcctgctgtctggaattgcctgtgcctgtgccgtcatcggcatgaagtgcacccgctgtgccaagggcaccccagccaagaccacctttgccatcctgggcggcaccctcttcatcctggccggcctgctgtgcatggtggccgtgtcctggaccaccaatgatgtggtgcagaacttctacaaccccctgctgcccagcggcatgaagtttgagatcggccaggccctgtacctgggcttcatcagcagcagcctgagcctcatcggcggcaccctgctgtgcctgagctgccaggatgaggccccctaccggccctaccaggccccaccccgggccaccaccaccacagccaacacagccccagcctaccagcccccagctgcctacaaggacaacagagcccccagcgtgaccagcgccacccacagcggctaccgcctgaatgactatgtgtag

SEQ ID NO: 147843 - DNA, 720 bp, Artificial Sequence; identical to SEQ ID NO: 147842
  Description of Artificial Sequence: Synthetic coding sequence

SEQ ID NO: 147844 - DNA, 720 bp, Artificial Sequence; identical to SEQ ID NO: 147842
  Description of Artificial Sequence: Synthetic coding sequence

SEQ ID NO: 147845 - DNA, 720 bp, Artificial Sequence; identical to SEQ ID NO: 147842
  Description of Artificial Sequence: Synthetic coding sequence

SEQ ID NO: 147846 - DNA, 720 bp, Artificial Sequence; identical to SEQ ID NO: 147842
  Description of Artificial Sequence: Synthetic coding sequence

SEQ ID NO: 147847 - DNA, 918 bp, Artificial Sequence
  Description of Artificial Sequence: Synthetic coding sequence
atgaccagcaggacccccctgctggtgacagcctgcctgtactacagctactgcaacagccgccacctgcagcagggcgtgaggaagagcaagaggcctgtgttcagccactgccaggtgcctgagacccagaagacagacaccaggcacctgagcggggcccgggccggcgtgtgcccctgctgccacccagatggcctgctggccaccatgagggacctgctgcagtacatcgcctgcttctttgccttcttctctgctggcttcctgattgtggccacctggacagactgctggatggtgaatgctgatgacagcctggaggtgtccaccaagtgccggggcctgtggtgggagtgtgtgaccaatgcctttgatggcatccgcacctgtgatgaatatgacagcatcctggccgagcaccccctgaagctggtggtgacccgggccctgatgatcacagctgacatcctggccggcttcggcttcctgaccctgctgctgggcctggactgtgtgaagttcctgcctgatgagccctacatcaaggtgcgcatctgctttgtggccggggccaccctgctgattgctggcaccccaggcatcatcggctctgtgtggtatgctgtggatgtgtatgtggagaggagcaccctggtgctgcacaacatcttcctgggcatccagtacaagtttggctggagctgctggctgggcatggccggcagcctgggctgcttcctggccggggctgtgctgacctgctgcctgtacctgttcaaggatgtgggccctgagaggaactacccctacagcctgaggaaggcctacagcgctgctggggtgtccatggccaagagctacagcgcccccaggacagaaacagccaagatgtatgctgtggacaccagggtgtag

SEQ ID NO: 147848 - DNA, 360 bp, Artificial Sequence
  Description of Artificial Sequence: Synthetic coding sequence
atgaccagcaggacccccctgctggtgacagcctgcctgtactacagctactgcaacagccgccacctgcagcagggcgtgaggaagagcaagaggcctgtgttcagccactgccaggtgcctgagacccagaagacagacaccaggcacctgagcggggcccgggccggcgtgtgcccctgctgccacccagatggcctgctggccaccatgagggacctgctgcagtacatcgcctgcttctttgccttcttctctgctggcttcctgattgtggccacctggacagactgctggatggtgaatgctgatgacagcctggagatgctggacctgcgggagaccatcctgatcccctag

SEQ ID NO: 147849 - DNA, 675 bp, Artificial Sequence
  Description of Artificial Sequence: Synthetic coding sequence
atggccaacagcggcctgcagctgctgggctacttcctggccctgggcggctgggtgggcatcatcgccagcacagccctgccccagtggaagcagagcagctatgctggagatgccatcatcacagctgtgggcctgtatgagggcctgtggatgagctgtgccagccagagcacaggccaggtgcagtgcaagctgtatgacagcctgctggccctggatggccacatccagagcgcccgggccctgatggtggtggccgtgctgctgggctttgtggccatggtgctgtctgtggtgggcatgaagtgcaccagggtgggggacagcaaccccatcgccaagggccgggtggccatcgccggcggggccctcttcatcctggccggcctgtgcaccctgacagctgtgtcctggtacgccaccctggtgacccaggagttcttcaaccccagcacccctgtgaatgcccgctatgaatttggacctgccctgtttgtgggctgggccagcgctggcctggccgtgctgggcggcagcttcctgtgctgcacctgcccagagcctgagcggcccaacagcagcccccagccctacagacctggccccagcgctgctgcccgggagcctgtggtgaagctgcctgccagcgccaagggccccctgggcgtgtag

SEQ ID NO: 147850 - DNA, 636 bp, Artificial Sequence
  Description of Artificial Sequence: Synthetic coding sequence
atggccaacagcggcctgcagctgctgggctacttcctggccctgggcggctgggtgggcatcatcgccagcacagccctgccccagtggaagcagagcagctatgctggagatgccatcatcacagctgtgggcctgtatgagggcctgtggatgagctgtgccagccagagcacaggccaggtgcagtgcaagctgtatgacagcctgctggccctggatggccacatccagagcgcccgggccctgatggtggtggccgtgctgctgggctttgtggccatggtgctgtctgtggtgggcatgaagtgcaccagggtgggggacagcaaccccatcgccaagggccgggtggccatcgccggcggggccctcttcatcctggccggcctgtgcaccctgacagctgtgtcctggtacgccaccctggtgacccaggagttcttcaaccccagcacccctgtgaatgcccgctatgaatttggacctgccctgtttgtgggctgggccagcgctggcctggccgtgctgggcggcagcttcctgtgctgcacctgcccagagcctgagcggcccaacagcagcccccagccctacagacctggccccagcgctgctgcccgggagtatgtgtag

SEQ ID NO: 147851 - DNA, 657 bp, Artificial Sequence
  Description of Artificial Sequence: Synthetic coding sequence
atggccaacagcggcctgcagctgctgggctacttcctggccctgggcggctgggtgggcatcatcgccagcacagccctgccccagtggaagcagagcagctatgctggagatgccatcatcacagctgtgggcctgtatgagggcctgtggatgagctgtgccagccagagcacaggccaggtgcagtgcaagctgtatgacagcctgctggccctggatggccacatccagagcgcccgggccctgatggtggtggccgtgctgctgggctttgtggccatggtgctgtctgtggtgggcatgaagtgcaccagggtgggggacagcaaccccatcgccaagggccgggtggccatcgccggcggggccctcttcatcctggccggcatgaacctggcccagccctgctcctgggccggcccccagctggcctggccctgctgggccgcccccagcagcgctgcccacgcccggagccagagggaccccacagctgcccacagccccatcggcctggaccccctgctgctgcctgagagcaccagcgagctgcggctgccctggccagccccccaccctgtggcccccctgcccagcatccagcctgccagccagcaccctggccagggccactggggcatcggctgggcctag

SEQ ID NO: 147852 - DNA, 663 bp, Artificial Sequence
  Description of Artificial Sequence: Synthetic coding sequence
atgtccatgggcctggagatcaccggcacagccctggccgtgctgggctggctgggcaccatcgtgtgctgtgccctgcccatgtggagggtgtctgccttcatcggcagcaacatcatcaccagccagaacatctgggagggcctgtggatgaactgtgtggtgcagagcacaggccagatgcagtgcaaggtgtatgacagcctgctggccctgccccaggacctgcaggccgcccgggccctgattgtggtggccatcctgctggccgccttcggcctgctggtggccctggtgggcgcccagtgcaccaactgtgtgcaggatgacacagccaaggccaagatcaccatcgtggccggcgtgctcttcctgctggccgccctgctgaccctggtgcctgtgtcctggagcgccaacaccatcatccgggacttctacaaccctgtggtgcctgaggcccagaagcgggagatgggcgccggcctgtatgtgggctgggccgccgccgccctgcagctgctgggcggggccctgctgtgctgcagctgccccccccgggagaagaagtacacagccaccaaggtggtgtacagcgcccccaggagcacaggccctggggccagcctgggcaccggctatgacaggaaggactatgtgtag

SEQ ID NO: 147853 - DNA, 630 bp, Artificial Sequence
  Description of Artificial Sequence: Synthetic coding sequence
atggcctccatgggcctgcaggtgatgggcatcgccctggccgtgctgggctggctggccgtgatgctgtgctgtgccctgcccatgtggagggtgacagccttcatcggcagcaacatcgtgaccagccagaccatctgggagggcctgtggatgaactgtgtggtgcagagcacaggccagatgcagtgcaaggtgtatgacagcctgctggccctgccccaggacctgcaggccgcccgggccctggtgatcatcagcatcatcgtggccgccctgggcgtgctgctgtctgtggtgggcggcaagtgcaccaactgcctggaggatgagagcgccaaggccaagaccatgattgtggccggcgtggtgttcctgctggccggcctgatggtgattgtgcctgtgtcctggacagcccacaacatcatccaggacttctacaaccccctggtggccagcggccagaagcgggagatgggcgccagcctgtatgtgggctgggccgccagcggcctgctgctgctgggcggcggcctgctgtgctgcaactgcccccccaggacagacaagccctacagcgccaagtacagcgctgcccggtctgctgctgccagcaactacgtgtag

SEQ ID NO: 147854 - DNA, 630 bp, Artificial Sequence; identical to SEQ ID NO: 147853
  Description of Artificial Sequence: Synthetic coding sequence

SEQ ID NO: 147855 - DNA, 630 bp, Artificial Sequence; identical to SEQ ID NO: 147853
  Description of Artificial Sequence: Synthetic coding sequence

SEQ ID NO: 147856 - DNA, 591 bp, Artificial Sequence
  Description of Artificial Sequence: Synthetic coding sequence
atggcctccatgggcctgcaggtgatgggcatcgccctggccgtgctgggctggctggccgtgatgctgtgctgtgccctgcccatgtggagggtgacagccttcatcggcagcaacatcgtgaccagccagagcacaggccagatgcagtgcaaggtgtatgacagcctgctggccctgccccaggacctgcaggccgcccgggccctggtgatcatcagcatcatcgtggccgccctgggcgtgctgctgtctgtggtgggcggcaagtgcaccaactgcctggaggatgaaagtgccaaggccaagaccatgattgtggccggcgtggtgttcctgctggccggcctgatggtgattgtgcctgtgtcctggacagcccacaacatcatccaggacttctacaaccccctggtggccagcggccagaagcgggagatgggcgccagcctgtatgtgggctgggccgccagcggcctgctgctgctgggcggcggcctgctgtgctgcaactgcccccccaggacagacaagccctacagcgccaagtacagcgctgcccggtctgctgctgccagcaactacgtgtag

SEQ ID NO: 147857 - DNA, 912 bp, Artificial Sequence
  Description of Artificial Sequence: Synthetic coding sequence
atgacccgggcccgcatcggctgctttggacctgggggccgggcccggggcacagagagcgcccctgagcccagcaagagggtgcccccaggccgctcctggcagacccaggaggtgcggcagaccaggggggccaacggcctgggcccccgggccggcagcgctggggccaaggcccctggccctgcccagggcgccgcccagcacggcctgggcggcagcgctggcctgcgggtgcgggtgagccccctggccatgggcagcgctgccctggagatcctgggcctggtgctgtgcctggtgggctggggcggcctcatcctggcctgtggcctgcccatgtggcaggtgacagccttcctggaccacaacatcgtgacagcccagaccacctggaagggcctgtggatgagctgtgtggtgcagagcacaggccacatgcagtgcaaggtgtatgacagcgtgctggccctgagcacagaggtgcaggccgcccgggccctgactgtgtctgctgtgctgctggcctttgtggccctgtttgtgaccctggccggggcccagtgcaccacctgtgtggcccctggccctgccaaggcccgggtggccctgactggaggagtgctgtacctgttctgtggcctgctggccctggtgcccctgtgctggtttgccaacatcgtggtgcgggagttctatgaccccagcgtgcctgtgtcccagaagtatgagctgggcgccgccctgtacatcggctgggccgccacagccctgctgatggtgggcggctgcctgctgtgctgcggggcctgggtgtgcaccggccgcccagacctgtccttccctgtgaagtacagcgccccccggcggcccacagccaccggggactatgacaagaagaactacgtgtag

SEQ ID NO: 147858 - DNA, 912 bp, Artificial Sequence; identical to SEQ ID NO: 147857
  Description of Artificial Sequence: Synthetic coding sequence

SEQ ID NO: 147859 - DNA, 912 bp, Artificial Sequence; identical to SEQ ID NO: 147857
  Description of Artificial Sequence: Synthetic coding sequence

SEQ ID NO: 147860 - DNA, 1086 bp, Artificial Sequence
  Description of Artificial Sequence: Synthetic coding sequence
atgggagaggaggccaatgatgacaagaagcccaccaccaagtttgagctggagcgggagacagagctgcgctttgaggtggaggccagccagagcgtgcagctggagctgctgaccggcatggccgagatctttggaacagagctgaccaggaacaagaagttcacctttgatgctggggccaaggtggccgtgttcacctggcacggctgcagcgtgcagctgagcggccgcacagaggtggcctacgtgtccaaggacacccccatgctgctgtacctgaacacccacacagccctggagcagatgaggcggcaggccgagaaggaggaggagcggggcccccgggtgatggtggtgggccccacagatgtgggcaagagcacagtgtgccgcctgctgctgaactatgccatcaccagccggctggctgatgtgttcaaccagagatgtgaggtgaacagaagagcctctgtgtctggctgcgtcatcaacacctgtggctgggtgaagggcagcggctaccaggccctggtgcatgctgccagcgcctttgaggtggatgtggtggtggtgctggaccaggagcggctgtacaatgagctgaagagggacctgccccactttgtgaggacagtgctgctgcccaagagcggcggcgtggtggagaggagcaaggacttcagaagagaatgtagagatgagcgcatccgggagtacttctacggcttccggggctgcttctacccccacgccttcaacgtgaagttcagtgatgtgaagatctacaaggtgggcgcccccaccatcccagacagctgcctgcccctgggcatgagccaggaggacaaccagctgaagctggtgcctgtgaccccaggccgggacatggtgcaccacctgctgtctgtgtccacagctgagggcacagaggagaacctgtctgagacctctgtggccggcttcatcgtggtgacctctgtggacctggagcaccaggtgttcaccgtgctgagccctgccccccggcccctgcccaagaacttcctgctgatcatggacatccgcttcatggacctgaagtag

SEQ ID NO: 147861 - DNA, 810 bp, Artificial Sequence
  Description of Artificial Sequence: Synthetic coding sequence
atgcaggagatcatcgcctctgtggaccacatcaagtttgacctggagattgctgtggagcagcagctgggcgcccagcccctgcccttccctggcatggacaagagcggggctgctgtgtgtgagttcttcctgaaggccgcctgtgggaaaggaggcatgtgccccttccgccacatctctggagagaagacagtggtgtgcaagcactggctgcggggcctgtgcaagaagggggaccagtgtgagttcctgcacgagtatgacatgaccaagatgcctgagtgctacttctacagcaagtttggagagtgcagcaacaaggaatgtcccttcctgcacattgatcctgagagcaagatcaaggactgcccctggtatgaccggggcttctgcaagcacggccccctgtgccgccaccgccacacccggcgggtcatctgtgtgaactacctggtgggcttctgcccagagggccccagctgcaagttcatgcaccccaggtttgagctgcccatgggcaccacagagcagccccccctgccccagcagacccagcccccagccaagcagagcaacaacccccccctgcagaggagcagcagcctcatccagctgaccagccagaacagcagccccaaccagcagaggaccccccaggtgattggagtgatgcagagccagaacagcagcgctggcaacagaggcccccggcccctggagcaggtgacctgctacaagtgtggggagaagggccactacgccaaccgctgcaccaagggccacctggccttcctgagcggccagtag

SEQ ID NO: 147862 - DNA, 735 bp, Artificial Sequence
  Description of Artificial Sequence: Synthetic coding sequence
atgcaggagatcatcgcctctgtggaccacatcaagtttgacctggagattgctgtggagcagcagctgggcgcccagcccctgcccttccctggcatggacaagagcggggctgctgtgtgtgagttcttcctgaaggccgcctgtgggaaaggaggcatgtgccccttccgccacatctctggagagaagacagtggtgtgcaagcactggctgcggggcctgtgcaagaagggggaccagtgtgagttcctgcacgagtatgacatgaccaagatgcctgagtgctacttctacagcaagtttggagagtgcagcaacaaggaatgtcccttcctgcacattgatcctgagagcaagatcaaggactgcccctggtatgaccggggcttctgcaagcacggccccctgtgccgccaccgccacacccggcgggtcatctgtgtgaactacctggtgggcttctgcccagagggccccagctgcaagttcatgcaccccaggtttgagctgcccatgggcaccacagagcagccccccctgccccagcagacccagcccccagccaagcagaggaccccccaggtgattggagtgatgcagagccagaacagcagcgctggcaacagaggcccccggcccctggagcaggtgacctgctacaagtgtggggagaagggccactacgccaaccgctgcaccaagggccacctggccttcctgagcggccagtag

SEQ ID NO: 147863 - DNA, 636 bp, Artificial Sequence
  Description of Artificial Sequence: Synthetic coding sequence
atgcaggagatcatcgcctctgtggaccacatcaagtttgacctggagattgctgtggagcagcagctgggcgcccagcccctgcccttccctggcatggacaagagcggggctgctgtgtgtgagttcttcctgaaggccgcctgtgggaaaggaggcatgtgccccttccgccacatctctggagagaagacagtggtgtgcaagcactggctgcggggcctgtgcaagaagggggaccagtgtgagttcctgcacgagtatgacatgaccaagatgcctgagtgctacttctacagcaagtttggccccctgtgccgccaccgccacacccggcgggtcatctgtgtgaactacctggtgggcttctgcccagagggccccagctgcaagttcatgcaccccaggtttgagctgcccatgggcaccacagagcagccccccctgccccagcagacccagcccccagccaagaggaccccccaggtgattggagtgatgcagagccagaacagcagcgctggcaacagaggcccccggcccctggagcaggtgacctgctacaagtgtggggagaagggccactacgccaaccgctgcaccaagggccacctggccttcctgagcggccagtag

SEQ ID NO: 147864 - DNA, 1767 bp, Artificial Sequence
  Description of Artificial Sequence: Synthetic coding sequence
atggctgatggagtggaccacatcgacatctatgcagatgtgggggaggagttcaaccaggaggccgagtatggaggccatgaccagattgacctgtatgatgatgtgatcagccccagcgccaacaatggagatgcccctgaggaccgggactacatggacaccctgcccccaacagtgggagatgatgtgggcaagggggccgccccaaatgtggtgtacacctacacaggcaagagaattgccctgtacatcggcaacctgacctggtggaccacagatgaggacctgacagaggccgtgcacagcctgggcgtgaatgacatcctggagatcaagttctttgagaacagagccaacggccagagcaagggctttgccctggtgggcgtgggcagcgaggccagcagcaagaagctgatggacctgctgcccaagcgggagctgcacggccagaaccctgtggtgaccccctgcaacaagcagttcctgagccagtttgagatgcagagcaggaagaccacccagagcggccagatgtctggagagggcaaggccggccccccaggcggcagcagcagagctgccttcccccagggcggccggggccggggccgcttccctggagctgtgcctggaggagaccgcttccctggccctgctggccctgggggccccccaccacccttccctggcaacctgatcaagcacctggtgaagggcacccggcccctcttcctggagacccgcatcccctggcacatgggccacagcattgaggagatccccatcttcggcctgaaggccggccagaccccaccccggccccccctgggccccccaggccccccaggccccccaggccccccacctcctggccaggtgctgcccccacccctggccggcccccccaacagaggagaccggcccccacctcctgtgctcttccctggccagcccttcggccagccccccctgggccccctgcccccaggccccccacctcctgtgcccggctacggccccccacctggccccccaccaccccagcagggccccccacctcctcctggccccttccccccccggcccccaggccccctgggcccccccctgaccctggcccccccaccccacctgcccggccccccacctggggcccctcctccagcccctcatgtgaacccagccttcttccccccacccaccaacagcggcatgcccaccagtgacagccggggccccccacccacagacccctacggccggcccccaccctatgacagaggagactatggccccccaggccgggagatggacacagcccggacccccctgtctgaggccgagtttgaggagatcatgaacagaaacagagccatcagcagcagcgccatcagcagagctgtgtctgatgccagcgctggggactatggcagcgccatcgagaccctggtgacagccatcagcctcatcaagcagagcaaggtgtctgcagatgaccgctgcaaggtgctgatcagcagcctgcaggactgcctgcatggaattgagagcaagagctatggcagcggcagcagaagagagaggagccgggagcgggaccacagccgcagccgggagaagagccgccgccacaagagccgcagccgggacagacatgatgactactaccgggagaggagccgggagcgggagcggcaccgggaccgggaccgggaccgggaccgggagcgggaccgggagcgggagtaccgccacaggtag

SEQ ID NO: 147865 - DNA, 1656 bp, Artificial Sequence
  Description of Artificial Sequence: Synthetic coding sequence
atggctgatggagtggaccacatcgacatctatgcagatgtgggggaggagttcaaccaggaggccgagtatggaggccatgaccagattgacctgtatgatgatgtgatcagccccagcgccaacaatggagatgcccctgaggaccgggactacatggacaccctgcccccaacagtgggagatgatgtgggcaagggggccgccccaaatgtggtgtacacctacacaggcaagagaattgccctgtacatcggcaacctgacctggtggaccacagatgaggacctgacagaggccgtgcacagcctgggcgtgaatgacatcctggagatcaagttctttgagaacagagccaacggccagagcaagggctttgccctggtgggcgtgggcagcgaggccagcagcaagaagctgatggacctgctgcccaagcgggagctgcacggccagaaccctgtggtgaccccctgcaacaagcagttcctgagccagtttgagatgcagagcaggaagaccacccagagcggccagatgtctggagagggcaaggccggccccccaggcggcagcagcagagctgccttcccccagggcggccggggccggggccgcttccctggagctgtgcctggaggagaccgcttccctggccctgctggccctgggggccccccaccacccttccctgctggccagaccccacccaggcctcccctgggccccccaggccccccaggccccccaggccccccacctcctggccaggtgctgcccccacccctggccggcccccccaacagaggagacaggcctcctcctcctgtgctcttccctggccagcccttcggccagccccccctgggccccctgcccccaggccccccacctcctgtgcccggctacggccccccacctggccccccaccaccccagcagggccccccacctcctcctggccccttcccccccaggcctcctggccccctgggcccccccctgaccctggcccccccaccccacctgcccggccccccacctggggcccctcctccagccccccacgtgaacccagccttcttccccccacccaccaacagcggcatgcccaccagtgacagccggggccccccacccacagacccctacggccggcccccaccctatgacagaggagactatggccccccaggccgggagatggacacagcccggacccccctgtctgaggccgagtttgaggagatcatgaacagaaacagagccatcagcagcagcgccatcagcagagctgtgtctgatgccagcgctggggactatggcagcgccatcgagaccctggtgacagccatcagcctcatcaagcagagcaaggtgtctgcagatgaccgctgcaaggtgctgatcagcagcctgcaggactgcctgcacggcatcgagagcaagagctatggcagcggcagccggcgggagaggagccgggagcgggaccacagccgcagccgggagaagagcagaagacacaagagccgcagccgggacagacatgatgactactaccgggagaggagccgggagcgggagcggcaccgggaccgggaccgggaccgggaccgggagcgggaccgggagcgggagtaccgccacaggtag

SEQ ID NO: 147866 - DNA, 1437 bp, Artificial Sequence
  Description of Artificial Sequence: Synthetic coding sequence
atggctgatggagtggaccacatcgacatctatgcagatgtgggggaggagttcaaccaggaggccgagtatggaggccatgaccagattgacctgtatgatgatgtgatcagccccagcgccaacaatggagatgcccctgaggaccgggactacatggacaccctgcccccaacagtgggagatgatgtgggcaagggggccgccccaaatgtggtgtacacctacacaggcaagagaattgccctgtacatcggcaacctgacctggtggaccacagatgaggacctgacagaggccgtgcacagcctgggcgtgaatgacatcctggagatcaagttctttgagaacagagccaacggccagagcaagggctttgccctggtgggcgtgggcagcgaggccagcagcaagaagctgatggacctgctgcccaagcgggagctgcacggccagaaccctgtggtgaccccctgcaacaagcagttcctgagccagtttgagatgcagagcaggaagaccacccagagcggccagatgtctggagagggcaaggccggccccccaggagctggcccccccaacagaggagaccggcccccacctcctgtgctcttccctggccagcccttcggccagccccccctgggccccctgcccccaggccccccacctcctgtgcccggctacggccccccacctggccccccaccaccccagcagggccccccacctcctcctggccccttccccccccggcccccaggccccctgggcccccccctgaccctggcccccccaccccacctgcccggccccccacctggggcccctcctccagcccctcatgtgaacccagccttcttccccccacccaccaacagcggcatgcccaccagtgacagccggggccccccacccacagacccctacggccggcccccaccctatgacagaggagactatggccccccaggccgggagatggacacagcccggacccccctgtctgaggccgagtttgaggagatcatgaacagaaacagagccatcagcagcagcgccatcagcagagctgtgtctgatgccagcgctggggactatggcagcgccatcgagaccctggtgacagccatcagcctcatcaagcagagcaaggtgtctgcagatgaccgctgcaaggtgctgatcagcagcctgcaggactgcctgcatggaattgagagcaagagctatggcagcggcagcagaagagagaggagccgggagcgggaccacagccgcagccgggagaagagccgccgccacaagagccgcagccgggacagacatgatgactactaccgggagaggagccgggagcgggagcggcaccgggaccgggaccgggaccgggaccgggagcgggaccgggagcgggagtaccgccacaggtag

SEQ ID NO: 147867 - DNA, 1851 bp, Artificial Sequence
  Description of Artificial Sequence: Synthetic coding sequence
atgagcagcctggccgtgcgggaccctgccatggacaggagcctgcggtctgtgtttgtgggcaacatcccctatgaggccacagaggagcagctgaaggacatcttcagcgaggtgggctctgtggtgtccttccggctggtgtatgaccgggagaccgggaagcccaagggctacggcttctgtgagtaccaggaccaggagacagccctgagcgccatgaggaacctgaatggccgggagttcagcggccgggccctgcgggtggacaatgctgccagcgagaagaacaaggaggagctgaagagcctgggccctgctgcccccatcatcgacagcccctatggagaccccattgatcctgaagatgcccctgagagcatcaccagggctgtggccagcctgcccccagagcagatgtttgagctgatgaagcagatgaagctgtgtgtgcagaacagccaccaggaggccaggaacatgctgctgcagaacccccagctggcctatgccctgctgcaggcccaggtggtgatgaggatcatggaccctgagatcgccctgaagatcctgcacaggaagatccacgtgacccccctcatccctgggaagagccagagcgtgtctgtgtctggccctggccctggccctggccctggcctgtgccccggccccaacgtgctgctgaaccagcagaaccccccagccccccagccccagcacctggcccggcggcctgtgaaggacatcccccccctgatgcagacccccatccagggcggcatcccagcccctggccccatcccagctgctgtgcctggagctggccctggcagcctgacccctgggggcgccatgcagccccagctgggcatgcctggggtgggccctgtgcccctggagcggggccaggtgcagatgtctgacccccgggcccccatcccccggggccctgtgaccccaggcggcctgcccccccggggcctgctgggagatgccccaaatgacccccggggcggcaccctgctgtctgtgactggagaggtggagccccggggctacctgggccccccccaccagggcccccccatgcaccacgccagcggccatgacacccggggccccagcagccatgagatgaggggcggccccctgggggacccccggctgctgattggagagccccggggccccatgattgaccagaggggcctgcccatggatggccggggcggccgggacagccgggccatggagacccgggccatggagacagaggtgctggagaccagggtgatggagcggcggggcatggagacctgtgccatggagacccggggcatggaggcccggggcatggatgcccggggcctggagatgaggggccctgtgcccagcagccggggccccatgactggaggcatccagggccctggccccatcaacattggagctgggggccccccccagggcccccggcaggtgcccggcatctctggagtgggcaaccctggggccggcatgcagggcaccggcatccagggcaccggcatgcagggcgccggcatccagggcggcggcatgcagggcgccggcatccagggcgtgtccatccagggcggcggcatccagggcggcggcatccagggcgccagcaagcagggcggcagccagcccagcagcttcagccctggccagagccaggtgaccccccaggaccaggagaaggccgccctgatcatgcaggtgctgcagctgacagctgaccagatcgccatgctgcccccagagcagaggcagagcatcctgatcctgaaggagcagatccagaagagcactggagccagctag

SEQ ID NO: 147868 - DNA, 2541 bp, Artificial Sequence
  Description of Artificial Sequence: Synthetic coding sequence
atgctgttcaccgtgtcctgcagcaagatgagcagcatcgtggacagagatgacagcagcatctttgatggcctggtggaggaggatgacaaggacaaggccaagagggtgtccaggaacaagtctgagaagaagaggcgggaccagttcaacgtgctgatcaaggagctgggctccatgctgcctggaaatgccaggaagatggacaagagcacagtgctgcagaagagcattgacttcctgaggaagcacaaggagatcacagcccagagtgatgccagcgagatccggcaggactggaagcccaccttcctgagcaatgaggagttcacccagctgatgctggaggccctggatggcttcttcctggccatcatgacagatggcagcatcatctacgtgtctgagagcgtgaccagcctgctggagcacctgcccagcgacctggtggaccagagcatcttcaacttcatccctgagggggagcacagcgaggtgtacaagatcctgagcacccacctgctggagagtgacagcctgaccccagagtacctgaagagcaagaaccagctggagttctgctgccacatgctgcggggcaccatcgaccccaaggagcccagcacctatgaatatgtgaagttcatcggcaacttcaagagcctgaacagcgtgagcagcagcgcccacaatggatttgagggcaccatccagaggacccaccggcccagctatgaggacagagtgtgctttgtggccaccgtgcggctggccaccccccagttcatcaaggagatgtgcaccgtggaggagcccaatgaggagttcaccagccgccacagcctggagtggaagttcctgttcctggaccaccgggccccacccatcatcggctacctgccctttgaggtgctgggcaccagcggctatgactactaccacgtggatgacctggagaacctggccaagtgccacgagcacctgatgcagtatggcaagggcaagagctgctactaccgcttcctgaccaagggccagcagtggatctggctgcagacccactactacatcacctaccaccagtggaacagcaggcctgagttcatcgtgtgcacccacacagtggtgtcctatgcagaggtgcgggcagagcggcggcgggagctgggcatcgaggagagcctgcctgagacagctgctgacaagagccaggacagcggcagtgacaaccgcatcaacacagtgtccctgaaggaggccctggagagatttgaccacagccccaccccatctgccagcagccgcagcagcaggaagagcagccacacagctgtgtctgaccccagcagcacccccaccaagatccccacagacaccagcaccccaccccggcagcacctgcctgcccacgagaagatggtgcagaggaggagcagcttcagcagccagagcatcaacagccagagcgtgggcagcagcctgacccagcctgtgatgagccaggccaccaacctgcccatcccccagggcatgagccagttccagttcagcgcccagctgggcgccatgcagcacctgaaggaccagctggagcagaggaccaggatgattgaggccaacatccaccggcagcaggaggagctgaggaagatccaggagcagctgcagatggtgcacggccagggcctgcagatgttcctgcagcagagcaaccctggcctgaactttggatctgtgcagctgagcagcggcaacagcagcaacatccagcagctggcccccatcaacatgcagggccaggtggtgcccaccaaccagatccagagcggcatgaacacaggccacatcggcaccacccagcacatgatccagcagcagaccctgcagagcaccagcacccagagccagcagaatgtgctgagcggccacagccagcagaccagcctgcccagccagacccagagcaccctgacagcccccctgtacaacaccatggtgatcagccagcctgctgctggctccatggtgcagatccccagctccatgccccagaacagcacccagagcgctgctgtgaccaccttcacccaggaccggcagatccgcttcagccagggccagcagctggtgaccaagctggtgacagcccctgtggcctgtggggctgtgatggtgcccagcaccatgctgatgggccaggtggtgacagcctaccccacctttgccacccagcagcagcagagccagaccctgtctgtgacccagcagcagcagcagcagagcagccaggagcagcagctgacctctgtgcagcagcccagccaggcccagctgacccagcccccccagcagttcctgcagaccagccggctgctgcacggcaaccccagcacccagctgatcctgtctgctgccttccccctgcagcagagcaccttcccccagagccaccaccagcagcaccagagccagcagcagcagcagctgagccgccacaggacagacagcctgcctgaccccagcaaggtgcagccccagtag

SEQ ID NO: 147869 - DNA, 1278 bp, Artificial Sequence
  Description of Artificial Sequence: Synthetic coding sequence
atgggagaggaggccaatgatgacaagaagcccaccaccaagtttgagctggagcgggagacagagctgcgctttgaggtggaggccagccagagcgtgcagctggagctgctgaccggcatggccgagatctttggaacagagctgaccaggaacaagaagttcacctttgatgctggggccaaggtggccgtgttcacctggcacggctgcagcgtgcagctgagcggccgcacagaggtggcctacgtgtccaaggacacccccatgctgctgtacctgaacacccacacagccctggagcagatgaggcggcaggccgagaaggaggaggagcggggcccccgggtgatggtggtgggccccacagatgtgggcaagagcacagtgtgccgcctgctgctgaactatgctgtgcggctgggcagaagacccacctacgtggagctggatgtgggccagggctctgtgtccatccctggcaccatgggcgccctgtacatcgagaggcctgcagatgtggaggagggcttcagcatccaggcccccctggtgtaccacttcggcagcaccaccccaggcaccaacatcaagctgtacaacaagatcaccagccggctggctgatgtgttcaaccagagatgtgaggtgaacagaagagcctctgtgtctggctgcgtcatcaacacctgtggctgggtgaagggcagcggctaccaggccctggtgcatgctgccagcgcctttgaggtggatgtggtggtggtgctggaccaggagcggctgtacaatgagctgaagagggacctgccccactttgtgaggacagtgctgctgcccaagagcggcggcgtggtggagaggagcaaggacttcagaagagaatgtagagatgagcgcatccgggagtacttctacggcttccggggctgcttctacccccacgccttcaacgtgaagttcagtgatgtgaagatctacaaggtgggcgcccccaccatcccagacagctgcctgcccctgggcatgagccaggaggacaaccagctgaagctggtgcctgtgaccccaggccgggacatggtgcaccacctgctgtctgtgtccacagctgagggcacagaggagaacctgtctgagacctctgtggccggcttcatcgtggtgacctctgtggacctggagcaccaggtgttcaccgtgctgagccctgccccccggcccctgcccaagaacttcctgctgatcatggacatccgcttcatggacctgaagtag

SEQ ID NO: 147870 - DNA, 1311 bp, Artificial Sequence
  Description of Artificial Sequence: Synthetic coding sequence
atgacagacctgcacagcagctacacagaggagatgggagaggaggccaatgatgacaagaagcccaccaccaagtttgagctggagcgggagacagagctgcgctttgaggtggaggccagccagagcgtgcagctggagctgctgaccggcatggccgagatcttcggcacagagctgaccaggaacaagaagttcacctttgatgctggggccaaggtggccgtgttcacctggcacggctgcagcgtgcagctgagcggccgcacagaggtggcctacgtgtccaaggacacccccatgctgctgtacctgaacacccacacagccctggagcagatgaggcggcaggccgagaaggaggaggagcggggcccccgggtgatggtggtgggccccacagatgtgggcaagagcacagtgtgccgcctgctgctgaactatgctgtgcggctgggccggcggcccacctacgtggagctggatgtgggccagggctctgtgtccatccctggcaccatgggcgccctgtacatcgagaggcctgcagatgtggaggagggcttcagcatccaggcccccctggtgtaccacttcggcagcaccaccccaggcaccaacatcaagctgtacaacaagatcaccagccggctggctgatgtgttcaaccagagatgtgaggtgaacagaagagcctctgtgtctggctgtgtgatcaacacctgtggctgggtgaagggcagcggctaccaggccctggtgcacgccgccagcgcctttgaggtggatgtggtggtggtgctggaccaggagcggctgtacaatgagctgaagagggacctgccccactttgtgaggacagtgctgctgcccaagtctggaggagtggtggagaggagcaaggacttccggcgggagtgcagagatgagcgcatccgggagtacttctacggcttccggggctgcttctacccccacgccttcaacgtgaagttcagtgatgtgaagatctacaaggtgggcgcccccaccatcccagacagctgcctgcccctgggcatgagccaggaggacaaccagctgaagctggtgcctgtgaccccaggccgggacatggtgcaccacctgctgtctgtgtccacagctgagggcacagaggagaacctgtctgagacctctgtggccggcttcatcgtggtgacctctgtggacctggagcaccaggtgttcaccgtgctgagccctgccccccggcccctgcccaagaacttcctgctgatcatggacatccgcttcatggacctgaagtag

SEQ ID NO: 147871 - DNA, 279 bp, Artificial Sequence
  Description of Artificial Sequence: Synthetic coding sequence
atgggagaggaggccaatgatgacaagaagcccaccaccaagtttgagctggagcgggagacagagctgcgctttgaggtggaggccagccagagcgtgcagctggagctgctgaccggcatggccgagatctttggaacagagctgaccaggaacaagaagttcacctttgatgctggggccaaggtggccgtgttcacctggcacggctgcagcgtgcagctgagcggccgcacagaggtggcctacgtgtccaaggacacccccatgctgctgtag

SEQ ID NO: 147872 - DNA, 1278 bp, Artificial Sequence; identical to SEQ ID NO: 147869
  Description of Artificial Sequence: Synthetic coding sequence

SEQ ID NO: 147873 - DNA, 399 bp, Artificial Sequence
  Description of Artificial Sequence: Synthetic coding sequence
atgggagaggaggccaatgatgacaagaagcccaccaccaagtttgagctggagcgggagacagagctgcgctttgaggtggaggccagccagagcgtgcagctggagctgctgaccggcatggccgagatctttggaacagagctgaccaggaacaagaagttcacctttgatgctggggccaaggtggccgtgttcacctggcacggctgcagcgtgcagctgagcggccgcacagaggtggcctacgtgtccaaggacacccccatgctgctgtacctgaacacccacacagccctggagcagatgaggcggcaggccgagaaggaggaggagcggggcccccgggtgatggtggtgggccccacagatgtgggcaagagcacagtgtgcaggtag

SEQ ID NO: 147874 - DNA, 834 bp, Artificial Sequence
  Description of Artificial Sequence: Synthetic coding sequence
atgtggccaggcatcctggtgggcggggcccgggtggccagctgccgctacccagccctgggcccccggctggccgcccacttccctgcccagaggcctccccagaggaccctgcagaatggcctggccctgcagcgctgcctgcacgccacagccacccgggccctgcccctcatccccatcgtggtggagcagacaggccgcggggagcgggcctatgacatctacagccggctgctgcgggagcgcatcgtgtgtgtgatgggccccattgatgacagcgtggccagcctggtgattgcccagctgctcttcctgcagagcgagagcaacaagaagcccatccacatgtacatcaacagccctgggggcgtggtgacagctggcctggccatctatgacaccatgcagtacatcctgaaccccatctgcacctggtgtgtgggccaggccgcctccatgggcagcctgctgctggccgccggcaccccaggcatgaggcacagcctgcccaacagccgcatcatgatccaccagcccagcggcggggcccggggccaggccacagacatcgccatccaggccgaggagatcatgaagctgaagaagcagctgtacaacatctatgccaagcacaccaagcagagcctgcaggtgattgagagcgccatggagcgggaccgctacatgagccccatggaggcccaggagtttggcatcctggacaaggtgctggtgcaccccccccaggatggagaagatgagcccaccctggtgcagaaggagcctgtggaggccgccccagctgctgagcctgtgcctgccagcacctag

SEQ ID NO: 147875 - DNA, 1617 bp, Artificial Sequence
  Description of Artificial Sequence: Synthetic coding sequence
atgtggagcggccgcagcagcttcaccagcctggtggtgggcgtgtttgtggtgtatgtggtgcacacctgctgggtgatgtatggcatcgtgtacacccggccctgcagcggagatgccaactgcatccagccctacctggcccggcggcccaagctgcagctgtctgtgtacaccaccaccaggagccacctgggcgctgagaacaacatcgacctggtgctgaatgtggaggactttgatgtggagagcaagtttgagaggacagtgaatgtgtctgtgcccaagaagaccagaaataatggcaccctgtatgcctacatcttcctgcaccacgccggcgtgctgccctggcatgatggcaagcaggtgcacctggtgagccccctgaccacctacatggtgcccaagccagaggagatcaacctgctgactggagagagtgacacccagcagattgaagctgagaagaagcccaccagcgccctggatgagcctgtgagccactggaggccccggctggccctgaatgtgatggctgacaactttgtgtttgatggcagcagcctgcctgcagatgtgcaccgctacatgaagatgatccagctgggcaagacagtgcactacctgcccatcctcttcatcgaccagctgagcaacagagtgaaggacctgatggtgatcaacagaagcaccacagagctgcccctgactgtgtcctatgacaaggtgtccctgggccgcctgcgcttctggatccacatgcaggatgctgtgtacagcctgcagcagtttggcttcagcgagaaggatgctgatgaggtgaagggcatctttgtggacaccaacctgtacttcctggccctgaccttctttgtggccgccttccacctgctgtttgacttcctggccttcaagaatgacatctccttctggaagaagaagaagtccatgattggcatgagcaccaaggctgtgctgtggcgctgcttcagcacagtggtgatcttcctgttcctgctggatgagcagaccagcctgctggtgctggtgcctgctggggtgggcgccgccatcgagctgtggaaggtgaagaaggccctgaagatgaccatcttctggaggggcctgatgcctgagttccagtttggcacctacagcgagagcgagaggaagacagaggagtatgacacccaggccatgaagtacctgagctacctgctgtaccccctgtgtgtgggcggcgctgtgtacagcctgctgaacatcaagtacaagtcctggtacagctggctgatcaacagctttgtgaatggagtgtatgccttcggcttcctgttcatgctgccccagctgtttgtgaactacaagctgaagtctgtggcccacctgccctggaaggccttcacctacaaggccttcaacaccttcattgatgatgtgtttgccttcatcatcaccatgcccaccagccaccggctggcctgcttcagagatgatgtggtgttcctggtgtacctgtaccagcgctggctgtaccctgtggacaagagaagagtgaatgaatttggagagagctatgaggagaaggccacccgggccccccacacagactag

SEQ ID NO: 147876 - DNA, 1509 bp, Artificial Sequence
  Description of Artificial Sequence: Synthetic coding sequence
atgtggagcggccgcagcagcttcaccagcctggtggtgggcgtgtttgtggtgtatgtggtgcacacctgctgggtgatgtatggcatcgtgtacacccggccctgcagcggagatgccaactgcatccagccctacctggcccggcggcccaagctgcagctgtctgtgtacaccaccaccaggagccacctgggcgctgagaacaacatcgacctggtgctgaatgtggaggactttgatgtggagagcaagtttgagaggacagtgaatgtgtctgtgcccaagaagaccagaaataatggcaccctgtatgcctacatcttcctgcaccacgccggcgtgctgccctggcatgatggcaagcaggtgcacctggtgagccccctgaccacctacatggtgcccaagccagaggagatcaacctgctgactggagagagtgacacccagcagattgaagctgagaagaagcccaccagcgccctggatgagcctgtgagccactggaggccccggctggccctgaatgtgatggctgacaactttgtgtttgatggcagcagcctgcctgcagatgtgcaccgctacatgaagatgatccagctgggcaagacagtgcactacctgcccatcctcttcatcgaccagctgagcaacagagtgaaggacctgatggtgatcaacagaagcaccacagagctgcccctgactgtgtcctatgacaaggtgtccctgggccgcctgcgcttctggatccacatgcaggatgctgtgtacagcctgcagcagtttggcttcagcgagaaggatgctgatgaggtgaagggcatctttgtggacaccaacctgtacttcctggccctgaccttctttgtggccgccttccacctgctgtttgacttcctggccttcaagaatgacatctccttctggaagaagaagaagtccatgattggcatgagcaccaagctgtggaaggtgaagaaggccctgaagatgaccatcttctggaggggcctgatgcctgagttccagtttggcacctacagcgagagcgagaggaagacagaggagtatgacacccaggccatgaagtacctgagctacctgctgtaccccctgtgtgtgggcggcgctgtgtacagcctgctgaacatcaagtacaagtcctggtacagctggctgatcaacagctttgtgaatggagtgtatgccttcggcttcctgttcatgctgccccagctgtttgtgaactacaagctgaagtctgtggcccacctgccctggaaggccttcacctacaaggccttcaacaccttcattgatgatgtgtttgccttcatcatcaccatgcccaccagccaccggctggcctgcttcagagatgatgtggtgttcctggtgtacctgtaccagcgctggctgtaccctgtggacaagagaagagtgaatgaatttggagagagctatgaggagaaggccacccgggccccccacacagactag

SEQ ID NO: 147877 - DNA, 1350 bp, Artificial Sequence
  Description of Artificial Sequence: Synthetic coding sequence
atgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctcatcgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggaccgcttcttcacccgggagccccaggacacctaccactacctgcccttcagcctgccccaccggcggccccacttcttcttccccaagagcagaattgtgcgcagcctgatgcccttcagcccctatgagcccctgaacttccacgccatgttccagcccttcctggagatgatccacgaggcccagcaggccatggacatccacttccacagccctgccttccagcaccccccaacagagttcatccgggagggagatgatgacagaacagtgtgccgggagatccgccacaacagcacaggctgcctgaggatgaaggaccagtgtgacaagtgccgggagatcctgtctgtggactgcagcaccaacaaccccagccaggccaagctgcggcgggagctggatgagagcctgcaggtggccgagcggctgaccaggaagtacaatgagctgctgaagagctaccagtggaagatgctgaacaccagcagcctgctggagcagctgaatgagcagttcaactgggtgtcccggctggccaacctgacccagggcgaggaccagtactacctgcgggtgaccaccgtggccagccacaccagtgacagtgatgtgcccagcggcgtgacagaggtggtggtgaagctgtttgacagcgaccccatcaccgtgacagtgcctgtggaggtgtccaggaagaaccccaagttcatggagaccgtggccgagaaggccctgcaggagtacaggaagaagcaccgggaggagtag

SEQ ID NO: 147878 - DNA, 825 bp, Artificial Sequence
  Description of Artificial Sequence: Synthetic coding sequence
atgcaggaccacttcagccgggccagcagcatcattgatgagctgttccaggaccgcttcttcacccgggagccccaggacacctaccactacctgcccttcagcctgccccacagaagaccccacttcttcttccccaagagccgcatcgtgcgcagcctgatgcccttcagcccctatgagcccctgaacttccacgccatgttccagcccttcctggagatgattcatgaggcccagcaggccatggacatccacttccacagccctgccttccagcaccccccaacagagttcatccgggagggagatgatgacagaacagtgtgccgggagatccgccacaacagcacaggctgcctgaggatgaaggaccagtgtgacaagtgccgggagatcctgtctgtggactgcagcaccaacaaccccagccaggccaagctgcggcgggagctggatgagagcctgcaggtggccgagcggctgaccaggaagtacaatgagctgctgaagagctaccagtggaagatgctgaacaccagcagcctgctggagcagctgaatgagcagttcaactgggtgtcccggctggccaacctgacccagggcgaggaccagtactacctgcgggtgaccaccgtggccagccacaccagtgacagtgatgtgcccagcggcgtgacagaggtggtggtgaagctgtttgacagcgaccccatcaccgtgacagtgcctgtggaggtgtccaggaagaaccccaagttcatggagaccgtggccgagaaggccctgcaggagtacaggaagaagcaccgggaggagtag

SEQ ID NO: 147879 - DNA, 1350 bp, Artificial Sequence; identical to SEQ ID NO: 147877
  Description of Artificial Sequence: Synthetic coding sequence

SEQ ID NO: 147880 - DNA, 615 bp, Artificial Sequence
  Description of Artificial Sequence: Synthetic coding sequence
atgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctcatcgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggaccgcttcttcacccgggagccccaggacacctactag

SEQ ID NO: 147881 - DNA, 1350 bp, Artificial Sequence; identical to SEQ ID NO: 147877
  Description of Artificial Sequence: Synthetic coding sequence

SEQ ID NO: 147882 - DNA, 816 bp, Artificial Sequence
  Description of Artificial Sequence: Synthetic coding sequence
atgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctcatcgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggacagcctgatgcccttcagcccctatgagcccctgaacttccacgccatgttccagcccttcctggagatgatccacgaggcccagcaggccatggacatccacttccacagccctgccttccagcaccccccaacagagttcatccgggagggagatgatgacagaacagtgtgccgggagatccgccacaacagcacaggctgcctgaggatgaaggaccagtgtgacaagtgctag

SEQ ID NO: 147883 - DNA, 1383 bp, Artificial Sequence
  Description of Artificial Sequence: Synthetic coding sequence
atggaggcctgcaaggacagcagaattggaggcatgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctgattgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggaccgcttcttcacccgggagccccaggacacctaccactacctgcccttcagcctgccccacagaagaccccacttcttcttccccaagagccgcatcgtgcgcagcctgatgcccttcagcccctatgagcccctgaacttccacgccatgttccagcccttcctggagatgattcatgaggcccagcaggccatggacatccacttccacagccctgccttccagcaccccccaacagagttcatccgggagggagatgatgacagaacagtgtgccgggagatccgccacaacagcacaggctgcctgaggatgaaggaccagtgtgacaagtgccgggagatcctgtctgtggactgcagcaccaacaaccccagccaggccaagctgcggcgggagctggatgagagcctgcaggtggccgagcggctgaccaggaagtacaatgagctgctgaagagctaccagtggaagatgctgaacaccagcagcctgctggagcagctgaatgagcagttcaactgggtgtcccggctggccaacctgacccagggcgaggaccagtactacctgcgggtgaccaccgtggccagccacaccagtgacagtgatgtgcccagcggcgtgacagaggtggtggtgaagctgtttgacagcgaccccatcaccgtgacagtgcctgtggaggtgtccaggaagaaccccaagttcatggagaccgtggccgagaaggccctgcaggagtacaggaagaagcaccgggaggagtag

SEQ ID NO: 147884 - DNA, 1506 bp, Artificial Sequence
  Description of Artificial Sequence: Synthetic coding sequence
atgcaggtgtgcagccagccccagaggggctgtgtgcgggagcagagcgccatcaacacagccccacccagcgcccacaatgctgccagccctggaggagcccggggccaccgggtgcccctgacagaggcctgcaaggacagccgcatcggcggcatgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctcatcgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggaccgcttcttcacccgggagccccaggacacctaccactacctgcccttcagcctgccccaccggcggccccacttcttcttccccaagagcagaattgtgcgcagcctgatgcccttcagcccctatgagcccctgaacttccacgccatgttccagcccttcctggagatgatccacgaggcccagcaggccatggacatccacttccacagccctgccttccagcaccccccaacagagttcatccgggagggagatgatgacagaacagtgtgccgggagatccgccacaacagcacaggctgcctgaggatgaaggaccagtgtgacaagtgccgggagatcctgtctgtggactgcagcaccaacaaccccagccaggccaagctgcggcgggagctggatgagagcctgcaggtggccgagcggctgaccaggaagtacaatgagctgctgaagagctaccagtggaagatgctgaacaccagcagcctgctggagcagctgaatgagcagttcaactgggtgtcccggctggccaacctgacccagggcgaggaccagtactacctgcgggtgaccaccgtggccagccacaccagtgacagtgatgtgcccagcggcgtgacagaggtggtggtgaagctgtttgacagcgaccccatcaccgtgacagtgcctgtggaggtgtccaggaagaaccccaagttcatggagaccgtggccgagaaggccctgcaggagtacaggaagaagcaccgggaggagtag

SEQ ID NO: 147885 - DNA, 894 bp, Artificial Sequence
  Description of Artificial Sequence: Synthetic coding sequence
atggaggcctgcaaggacagcagaattggaggcatgatgaagaccctgctgctgtttgtgggcctgctgctgacctgggagagcggccaggtgctgggggaccagacagtgtctgacaatgagctgcaggagatgagcaaccagggcagcaaatatgtgaacaaggagatccagaatgctgtgaatggagtgaagcagatcaagaccctgattgagaagaccaatgaggagaggaagaccctgctgagcaacctggaggaggccaagaagaagaaggaggatgccctgaatgagacccgggagagcgagaccaagctgaaggagctgcccggggtgtgcaatgagaccatgatggccctgtgggaggagtgcaagccctgcctgaagcagacctgcatgaagttctacgcccgggtgtgccgcagcggcagcggcctggtgggccggcagctggaggagttcctgaaccagagcagccccttctacttctggatgaatggagacagaattgacagcctgctggagaatgaccggcagcagacccacatgctggatgtgatgcaggaccacttcagccgggccagcagcatcattgatgagctgttccaggaccgcttcttcacccgggagccccaggacacctaccactacctgcccttcagcctgccccacagaagaccccacttcttcttccccaagagccgcatcgtgcgcagcctgatgcccttcagcccctatgagcccctgaacttccacgccatgttccagcccttcctggagatgattcatgaggcccagcaggccatggacatccacttccacagccctgccttccagcaccccccaacagagttcatccgggagggagatgatgacagaacagtgtgcaggtag

SEQ ID NO: 147886 - DNA, 2040 bp, Artificial Sequence
  Description of Artificial Sequence: Synthetic coding sequence
ctgggccagtttgagcagcccaccggctacatggagaacagcgtgtcctacagcgccattgaagatgtgcagctgctgtcctgggagaatgcccccaagtactgcctgcagctgaccatccctgggggcaccgtgctgctgcaggccgccaacagctacctgcgggaccagtggttccacagcctgcagtggaagaagaagatctacaagtacaagaaggtgctgagcaaccccagccgctgggaggtggtgctgaaggagatccgcaccctggtggacatggccctgaccagccccctgcaggatgacagcatcaaccaggcccccctggagatcgtgtccaagctgctgtctgagaacaccaacctgaccacccaggagcacgagaacatcatcgtggccatcgcccccctgctggagaacaaccaccccccaccagacctgtgtgagttcttctgcaagcactgccgggagcggcccaggtccatggtggtgattgaggtgttcacccctgtggtgcagaggatcctgaagcacaacatggactttggaaaatgtccccggctgcggctcttcacccaggagtacatcctggccctgaatgagctgaatgccggcatggaggtggtgaagaagttcatccagagcatgcacggccccaccggccactgcccccacccccgggtgctgcccaacctggtggccgtgtgcctggccgccatctacagctgctatgaggagttcatcaacagccgggacaacagccccagcctgaaggagatcagaaatggctgccagcagccctgtgacaggaagcccaccctgcccctgcggctgctgcaccccagcccagacctggtgtcccaggaggccaccctgtctgaggcccggctgaagtctgtggtggtggccagcagcgagatccacgtggaggtggagaggaccagcacagccaagccagccctgacagccagcgctggaaatgacagcgagcccaacctgattgactgcctgatggtgtccccagcctgcagcaccatgagcattgagctgggcccccaggccgacaggaccctgggctgctacgtggagatcctgaagctgctgagtgactatgatgactggaggcccagcctggccagcctgctgcagcccatccccttccccaaggaggccctggcccacgagaagttcaccaaggagctgaagtatgtgatccagagatttgctgaggacccccggcaggaggtgcacagctgcctgctgtctgtgcgggccggcaaggatggctggttccagctgtacagccctggaggagtggcctgtgatgatgatggagagctgtttgcctccatggtgcacatcctgatgggcagctgctacaagaccaagaagttcctgctgagcctggccgagaacaagctgggcccctgcatgctgctggccctgcggggcaaccagaccatggtggagatcctgtgcctgatgctggagtacaacatcatcgacaacaatgacacccagctgcagatcatcagcaccctggagagcacagatgtgggcaagaggatgtatgagcagctgtgtgaccggcagcgggagctgaaggagctgcagaggaaaggaggccccacccggctgaccctgcccagcaagagcacagatgctgacctggcccggctgctgagcagcggcagctttggaaacctggagaacctgagcctggccttcaccaacgtgaccagcgcctgtgccgagcacctgatcaagctgcccagcctgaagcagctgaacctgtggagcacccagtttggagatgctggcctgcggctgctgtctgagcacctgaccatgctgcaggtgctgaacctgtgtgagacccctgtgacagatgctggcctgctggccctgagctccatgaagagcctgtgcagcctgaacatgaacagcaccaagctgtctgctgacacctatgaggacctgaaggccaagctgcccaacctgaaggaggtggatgtgcgctacacagaggcctggtag

SEQ ID NO: 147887 - DNA, 2322 bp, Artificial Sequence
  Description of Artificial Sequence: Synthetic coding sequence
atggatgtgaccagcagcagcggcggcggcggggacccccggcagatcgaggagaccaagcccctgctgggcggagatgtgtctgcccctgagggcaccaagatgggcgctgtgccctgcagaagagccctgctgctgtgcaatggcatgagatacaagctgctgcaggagggggacatccaggtgtgtgtgatccgccaccccaggaccttcctgagcaagatcctgaccagcaagttcctgcggcgctgggagccccaccacctgaccctggccgacaacagcctggccagcgccacccccaccggctacatggagaacagcgtgtcctacagcgccattgaagatgtgcagctgctgtcctgggagaatgcccccaagtactgcctgcagctgaccatccctgggggcaccgtgctgctgcaggccgccaacagctacctgcgggaccagtggttccacagcctgcagtggaagaagaagatctacaagtacaagaaggtgctgagcaaccccagccgctgggaggtggtgctgaaggagatccgcaccctggtggacatggccctgaccagccccctgcaggatgacagcatcaaccaggcccccctggagatcgtgtccaagctgctgtctgagaacaccaacctgaccacccaggagcacgagaacatcatcgtggccatcgcccccctgctggagaacaaccaccccccaccagacctgtgtgagttcttctgcaagcactgccgggagcggcccaggtccatggtggtgattgaggtgttcacccctgtggtgcagaggatcctgaagcacaacatggactttggaaaatgtccccggctgcggctcttcacccaggagtacatcctggccctgaatgagctgaatgccggcatggaggtggtgaagaagttcatccagagcatgcacggccccaccggccactgcccccacccccgggtgctgcccaacctggtggccgtgtgcctggccgccatctacagctgctatgaggagttcatcaacagccgggacaacagccccagcctgaaggagatcagaaatggctgccagcagccctgtgacaggaagcccaccctgcccctgcggctgctgcaccccagcccagacctggtgtcccaggaggccaccctgtctgaggcccggctgaagtctgtggtggtggccagcagcgagatccacgtggaggtggagaggaccagcacagccaagccagccctgacagccagcgctggaaatgacagcgagcccaacctgattgactgcctgatggtgtccccagcctgcagcaccatgagcattgagctgggcccccaggccgacaggaccctgggctgctacgtggagatcctgaagctgctgagtgactatgatgactggaggcccagcctggccagcctgctgcagcccatccccttccccaaggaggccctggcccacgagaagttcaccaaggagctgaagtatgtgatccagagatttgctgaggacccccggcaggaggtgcacagctgcctgctgtctgtgcgggccggcaaggatggctggttccagctgtacagccctggaggagtggcctgtgatgatgatggagagctgtttgcctccatggtgcacatcctgatgggcagctgctacaagaccaagaagttcctgctgagcctggccgagaacaagctgggcccctgcatgctgctggccctgcggggcaaccagaccatggtggagatcctgtgcctgatgctggagtacaacatcatcgacaacaatgacacccagctgcagatcatcagcaccctggagagcacagatgtgggcaagaggatgtatgagcagctgtgtgaccggcagcgggagctgaaggagctgcagaggaaaggaggccccacccggctgaccctgcccagcaagagcacagatgctgacctggcccggctgctgagcagcggcagctttggaaacctggagaacctgagcctggccttcaccaacgtgaccagcgcctgtgccgagcacctgatcaagctgcccagcctgaagcagctgaacctgtggagcacccagtttggagatgctggcctgcggctgctgtctgagcacctgaccatgctgcaggtgctgaacctgtgtgagacccctgtgacagatgctggcctgctggccctgagctccatgaagagcctgtgcagcctgaacatgaacagcaccaagctgtctgctgacacctatgaggacctgaaggccaagctgcccaacctgaaggaggtggatgtgcgctacacagaggcctggtag

SEQ ID NO: 147888 - DNA, 2040 bp, Artificial Sequence
  Description of Artificial Sequence: Synthetic coding sequence
atgggccaggccgctgagcccaccggctacatggagaacagcgtgtcctacagcgccattgaagatgtgcagctgctgtcctgggagaatgcccccaagtactgcctgcagctgaccatccctgggggcaccgtgctgctgcaggccgccaacagctacctgcgggaccagtggttccacagcctgcagtggaagaagaagatctacaagtacaagaaggtgctgagcaaccccagccgctgggaggtggtgctgaaggagatccgcaccctggtggacatggccctgaccagccccctgcaggatgacagcatcaaccaggcccccctggagatcgtgtccaagctgctgtctgagaacaccaacctgaccacccaggagcacgagaacatcatcgtggccatcgcccccctgctggagaacaaccaccccccaccagacctgtgtgagttcttctgcaagcactgccgggagcggcccaggtccatggtggtgattgaggtgttcacccctgtggtgcagaggatcctgaagcacaacatggactttggaaaatgtccccggctgcggctcttcacccaggagtacatcctggccctgaatgagctgaatgccggcatggaggtggtgaagaagttcatccagagcatgcacggccccaccggccactgcccccacccccgggtgctgcccaacctggtggccgtgtgcctggccgccatctacagctgctatgaggagttcatcaacagccgggacaacagccccagcctgaaggagatcagaaatggctgccagcagccctgtgacaggaagcccaccctgcccctgcggctgctgcaccccagcccagacctggtgtcccaggaggccaccctgtctgaggcccggctgaagtctgtggtggtggccagcagcgagatccacgtggaggtggagaggaccagcacagccaagccagccctgacagccagcgctggaaatgacagcgagcccaacctgattgactgcctgatggtgtccccagcctgcagcaccatgagcattgagctgggcccccaggccgacaggaccctgggctgctacgtggagatcctgaagctgctgagtgactatgatgactggaggcccagcctggccagcctgctgcagcccatccccttccccaaggaggccctggcccacgagaagttcaccaaggagctgaagtatgtgatccagagatttgctgaggacccccggcaggaggtgcacagctgcctgctgtctgtgcgggccggcaaggatggctggttccagctgtacagccctggaggagtggcctgtgatgatgatggagagctgtttgcctccatggtgcacatcctgatgggcagctgctacaagaccaagaagttcctgctgagcctggccgagaacaagctgggcccctgcatgctgctggccctgcggggcaaccagaccatggtggagatcctgtgcctgatgctggagtacaacatcatcgacaacaatgacacccagctgcagatcatcagcaccctggagagcacagatgtgggcaagaggatgtatgagcagctgtgtgaccggcagcgggagctgaaggagctgcagaggaaaggaggccccacccggctgaccctgcccagcaagagcacagatgctgacctggcccggctgctgagcagcggcagctttggaaacctggagaacctgagcctggccttcaccaacgtgaccagcgcctgtgccgagcacctgatcaagctgcccagcctgaagcagctgaacctgtggagcacccagtttggagatgctggcctgcggctgctgtctgagcacctgaccatgctgcaggtgctgaacctgtgtgagacccctgtgacagatgctggcctgctggccctgagctccatgaagagcctgtgcagcctgaacatgaacagcaccaagctgtctgctgacacctatgaggacctgaaggccaagctgcccaacctgaaggaggtggatgtgcgctacacagaggcctggtag

SEQ ID NO: 147889 - DNA, 1761 bp, Artificial Sequence
  Description of Artificial Sequence: Synthetic coding sequence
atggccctgaccagccccctgcaggatgacagcatcaaccaggcccccctggagatcgtgtccaagctgctgtctgagaacaccaacctgaccacccaggagcacgagaacatcatcgtggccatcgcccccctgctggagaacaaccaccccccaccagacctgtgtgagttcttctgcaagcactgccgggagcggcccaggtccatggtggtgattgaggtgttcacccctgtggtgcagaggatcctgaagcacaacatggactttgggaagtgcccccggctgcggctcttcacccaggagtacatcctggccctgaatgagctgaatgccggcatggaggtggtgaagaagttcatccagagcatgcacggccccaccggccactgcccccacccccgggtgctgcccaacctggtggccgtgtgcctggccgccatctacagctgctatgaggagttcatcaacagccgggacaacagccccagcctgaaggagatcagaaatggctgccagcagccctgtgacaggaagcccaccctgcccctgcggctgctgcaccccagcccagacctggtgtcccaggaggccaccctgtctgaggcccggctgaagtctgtggtggtggccagcagcgagatccacgtggaggtggagaggaccagcacagccaagccagccctgacagccagcgctggaaatgattctgagcccaacctgattgactgcctgatggtgtccccagcctgcagcaccatgagcattgagctgggcccccaggccgacaggaccctgggctgctacgtggagatcctgaagctgctgagtgactatgatgactggaggcccagcctggccagcctgctgcagcccatccccttccccaaggaggccctggcccacgagaagttcaccaaggagctgaagtatgtgatccagagatttgctgaggacccccggcaggaggtgcacagctgcctgctgtctgtgcgggccggcaaggatggctggttccagctgtacagccctgggggcgtggcctgtgatgatgatggagagctgtttgcctccatggtgcacatcctgatgggcagctgctacaagaccaagaagttcctgctgagcctggccgagaacaagctgggcccctgcatgctgctggccctgcggggcaaccagaccatggtggagatcctgtgcctgatgctggagtacaacatcatcgacaacaatgacacccagctgcagatcatcagcaccctggagagcacagatgtgggcaagaggatgtatgagcagctgtgtgaccggcagcgggagctgaaggagctgcagaggaagggcggccccacccggctgaccctgcccagcaagagcacagatgctgacctggcccggctgctgagcagcggcagctttggaaacctggagaacctgagcctggccttcaccaacgtgaccagcgcctgtgccgagcacctgatcaagctgcccagcctgaagcagctgaacctgtggagcacccagtttggagatgctggcctgcggctgctgtctgagcacctgaccatgctgcaggtgctgaacctgtgtgagacccctgtgacagatgctggcctgctggccctgagctccatgaagagcctgtgcagcctgaacatgaacagcaccaagctgtctgctgacacctatgaggacctgaaggccaagctgcccaacctgaaggaggtggatgtgcgctacacagaggcctggtag

SEQ ID NO: 147890 - DNA, 312 bp, Artificial Sequence
  Description of Artificial Sequence: Synthetic coding sequence
atggcccactacaaggctgctgacagcaagcgggagcagttccgccgctacctggagaagtctggagtgctggacaccctgaccaaggtgctggtggccctgtatgaggagcctgagaagcccaacagcgccctggacttcctgaagcaccacctgggcgccgccaccccagagaaccctgagattgagctgctgcggctggagctggccgagatgaaggagaagtatgaggccatcgtggaggagaacaagaagctgaaggccaagctggcccagtatgagcccccccaggaggagaagagagctgagtag

SEQ ID NO: 147891 - DNA, 1695 bp, Artificial Sequence
  Description of Artificial Sequence: Synthetic coding sequence
atggctgtgttccgcagcggcctgctggtgctgaccacccccctggccagcctggccccccggctggccagcatcctgaccagcgctgcccggctggtgaaccacaccctgtatgtgcacctgcagcccggcatgagcctggagggccctgcccagccccagagcagccctgtgcaggccacctttgaggtgctggacttcatcacccacctgtatgctggagcagatgtgcaccgccacctggatgtgcgcatcctgctgaccaacatccgcaccaagagcaccttcctgccccccctgcccacctctgtgcagaacctggcccaccccccagaggtggtgctgacagacttccagaccctggatggcagccagtacaaccctgtgaagcagcagctggtgcgctatgccaccagctgctacagctgctgcccccggctggcctctgtgctgctgtacagcgactatggcatcggggaggtgcctgtggagcccctggatgtgcccctgcccagcaccatccggcctgccagccctgtggccggcagccccaagcagcctgtgcggggctactacagaggagctgtgggcggcacctttgaccggctgcacaatgcccacaaggtgctgctgtctgtggcctgcatcctggcccaggagcagctggtggtgggcgtggccgacaaggacctgctgaagagcaagctgctgcctgagctgctgcagccctacacagagcgggtggagcacctgtctgagttcctggtggacatcaagcccagcctgacctttgatgtgatccccctgctggacccctacggccctgctggcagtgaccccagcctggagttcctggtggtgtctgaggagacctaccggggcggcatggccatcaaccgcttccggctggagaatgacctggaggagctggccctgtaccagatccagctgctgaaggacctgcggcacacagaaaatgaggaggacaaggtgagcagcagcagcttccggcagaggatgctgggcaacctgctgcggcccccctatgaaagacctgagctgcccacctgcctgtatgtgattggcctgaccggcatcagcggcagcggcaagagcagcatcgcccagaggctgaagggcctgggcgccttcgtcatcgacagcgaccacctgggccaccgggcctatgcccctgggggccctgcctaccagcctgtggtggaggccttcggcacagacatcctgcacaaggatggcatcatcaacaggaaggtgctgggcagccgggtgtttggaaacaagaagcagctgaagatcctgacagacatcatgtggcccatcatcgccaagctggcccgggaggagatggacagagctgtggccgagggcaagagggtgtgtgtgattgatgctgctgtgctgctggaggccggctggcagaacctggtgcatgaggtgtggacagctgtgattcctgagacagaggccgtgcggcgcatcgtggagagagatggcctgtctgaggccgccgcccagagccggctgcagagccagatgagcggccagcagctggtggagcagagccacgtggtgctgagcaccctgtgggagccccacatcacccagaggcaggtggagaaggcctgggccctgctgcagaagaggatccccaagacccaccaggccctggactag

SEQ ID NO: 147892 - DNA, 1695 bp, Artificial Sequence; identical to SEQ ID NO: 147891
  Description of Artificial Sequence: Synthetic coding sequence

SEQ ID NO: 147893 - DNA, 1782 bp, Artificial Sequence
  Description of Artificial Sequence: Synthetic coding sequence
atgaggaccccccggctgcgggcccagcccagaggagctgtgtaccaggcccccagccccccaccagcccctgtgggcctgggctccatggctgtgttccgcagcggcctgctggtgctgaccacccccctggccagcctggccccccggctggccagcatcctgaccagcgctgcccggctggtgaaccacaccctgtatgtgcacctgcagcccggcatgagcctggagggccctgcccagccccagagcagccctgtgcaggccacctttgaggtgctggacttcatcacccacctgtatgctggagcagatgtgcaccgccacctggatgtgcgcatcctgctgaccaacatccgcaccaagagcaccttcctgccccccctgcccacctctgtgcagaacctggcccaccccccagaggtggtgctgacagacttccagaccctggatggcagccagtacaaccctgtgaagcagcagctggtgcgctatgccaccagctgctacagctgctgcccccggctggcctctgtgctgctgtacagcgactatggaattggagaggtgcctgtggagcccctggatgtgcccctgcccagcaccatccggcctgccagccctgtggccggcagccccaagcagcctgtgcggggctactacagaggagctgtgggcggcacctttgaccggctgcacaatgcccacaaggtgctgctgtctgtggcctgcatcctggcccaggagcagctggtggtgggcgtggccgacaaggacctgctgaagagcaagctgctgcctgagctgctgcagccctacacagagcgggtggagcacctgtctgagttcctggtggacatcaagcccagcctgacctttgatgtgatccccctgctggacccctacggccctgctggcagtgaccccagcctggagttcctggtggtgtctgaggagacctacagaggaggcatggccatcaaccgcttccggctggagaatgacctggaggagctggccctgtaccagatccagctgctgaaggacctgcggcacacagaaaatgaggaggacaaggtgagcagcagcagcttccggcagaggatgctgggcaacctgctgcggcccccctatgaaagacctgagctgcccacctgcctgtatgtgattggcctgaccggcatcagcggcagcggcaagagcagcatcgcccagaggctgaagggcctgggcgcctttgtgattgacagcgaccacctgggccaccgggcctatgcccctgggggccctgcctaccagcctgtggtggaggcctttggaacagacatcctgcacaaggatggcatcatcaacaggaaggtgctgggcagccgggtgtttggaaacaagaagcagctgaagatcctgacagacatcatgtggcccatcatcgccaagctggcccgggaggagatggacagagctgtggccgagggcaagagggtgtgtgtgattgatgctgctgtgctgctggaggccggctggcagaacctggtgcatgaggtgtggacagctgtgattcctgagacagaagctgtgagaagaattgtggagagagatggcctgtctgaggccgccgcccagagccggctgcagagccagatgagcggccagcagctggtggagcagagccacgtggtgctgagcaccctgtgggagccccacatcacccagaggcaggtggagaaggcctgggccctgctgcagaagaggatccccaagacccaccaggccctggactag

SEQ ID NO: 147894 - DNA, 528 bp, Artificial Sequence
  Description of Artificial Sequence: Synthetic coding sequence
atggctgtgttccgcagcggcctgctggtgctgaccacccccctggccagcctggccccccggctggccagcatcctgaccagcgctgcccggctggtgaaccacaccctgtatgtgcacctgcagcccggcatgagcctggagggccctgcccagccccagagcagccctgtgcaggccacctttgaggtgctggacttcatcacccacctgagccccagccctgcccacctgagccctgagagccggcccccagcccggagccgggtggaccgcttcccagaccccggctggaagcctgtgcagcccggccagacagctgccagcgccctgcggcaccagctgctgcagctgctgagcgccaccggcctgggcgccgccatcctgcggctgtgggaccggcgcagcgcccggggggcccctggctgccccctgaccctgcatgaccaggccagcttcccccggggccgggtgtccaaggccgccggggcctggctgctgccctggcgctgccgctggcacgtgtag

SEQ ID NO: 147895 - DNA, 810 bp, Artificial Sequence
  Description of Artificial Sequence: Synthetic coding sequence
atggccatcaaccgcttccggctggagaatgacctggaggagctggccctgtaccagatccagctgctgaaggacctgcggcacacagaaaatgaggaggacaaggtgagcagcagcagcttccggcagaggatgctgggcaacctgctgcggcccccctatgaaagacctgagctgcccacctgcctgtatgtgattggcctgaccggcatcagcggcagcggcaagagcagcatcgcccagaggctgaagggcctgggcgcctttgtgattgacagcgaccacctgggccaccgggcctatgcccctgggggccctgcctaccagcctgtggtggaggcctttggaacagacatcctgcacaaggatggcatcatcaacaggaaggtgctgggcagccgggtgtttggaaacaagaagcagctgaagatcctgacagacatcatgtggcccatcatcgccaagctggcccgggaggagatggacagagctgtggccgagggcaagagggtgtgtgtgattgatgctgctgtgctgctggaggccggctggcagaacctggtgcatgaggtgtggacagctgtgattcctgagacagaagctgtgagaagaattgtggagagagatggcctgtctgaggccgccgcccagagccggctgcagagccagatgagcggccagcagctggtggagcagagccacgtggtgctgagcaccctgtgggagccccacatcacccagaggcaggtggagaaggcctgggccctgctgcagaagaggatccccaagacccaccaggccctggactag

SEQ ID NO: 147896 - DNA, 1782 bp, Artificial Sequence; identical to SEQ ID NO: 147893
  Description of Artificial Sequence: Synthetic coding sequence

SEQ ID NO: 147897 - DNA, 429 bp, Artificial Sequence
  Description of Artificial Sequence: Synthetic coding sequence
atggccaccaagattgacaaggaggcctgccgggccgcctacaacctggtgagagatgatggcagcgctgtgatctgggtgaccttcaagtatgatggcagcaccatcgtgcctggagagcagggcgctgagtaccagcacttcatccagcagtgcacagatgatgtgcggctgtttgcctttgtgcgcttcaccactggagatgccatgagcaagaggagcaagtttgccctgatcacctggattggagaaaatgtgtctggcctgcagagggccaagacaggaacagacaagaccctggtgaaggaggtggtgcagaactttgccaaggagtttgtgatcagtgacaggaaggagctggaggaggacttcatcaagtctgagctgaagaaggccggcggggccaactatgatgcccagacagaatag

SEQ ID NO: 147898 - DNA, 1731 bp, Artificial Sequence
  Description of Artificial Sequence: Synthetic coding sequence
atgaggggccccaacagcggcacagagaagggccgcctggtgattcctgagaagcagggctttgacttcctgtgcatgcctgtgttccacccccgcttcaagcgggagttcatccaggagcccgccaagaaccggcccggcccccagaccaggagtgacctgctgctgagcggccgggccttcctgctgcccctgaaccaggaggacaacaccaacctggcccgggtgctgaccaaccacatccacacaggccaccacagctccatgttctggatgagggtgcccctggtggcccctgaggacctgagagatgacatcattgaaaatgcccccaccacccacacagaggagtacagcggggaggagaagacctggatgtggtggcacaacttccgcaccctgtgtgactacagcaagagaattgctgtggccctggagattggagctgacctgcccagcaaccacgtgattgaccgctggctgggggagcccatcaaggccgccatcctgcccaccagcatcttcctgaccaacaagaagggcttccctgtgctgagcaagatgcaccagaggctcatcttccggctgctgaagctggaggtgcagttcatcatcaccggcaccaaccaccacagcgagaaggagttctgcagctacctgcagtacctggagtacctgagccagaacagacctcctccaaatgcctatgagctgtttgccaagggctatgaggactacctgcagagccccctgcagcccctgatggacaacctggagagccagacctatgaggtgtttgagaaggaccccatcaagtacagccagtaccagcaggccatctacaagtgcctgctggacagagtgcctgaggaggagaaggacaccaacgtgcaggtgctgatggtgctgggcgccggccggggccccctggtgaatgccagcctgcgggccgccaagcaggccgaccggcgcatcaagctgtatgctgtggagaagaaccccaatgctgtggtgaccctggagaactggcagtttgaggagtggggcagccaggtgacagtggtgtccagtgacatgagggagtgggtggcccctgagaaggctgacatcatcgtgtctgagctgctgggcagctttgctgacaatgagctgagcccagaatgtctggatggagcccagcacttcctgaaggatgatggagtgtccatccctggagagtacaccagcttcctggcccccatcagcagcagcaagctgtacaatgaggtgcgggcctgccgggagaaggaccgggaccctgaggcccagtttgagatgccctacgtggtgcggctgcacaacttccaccagctgagcgccccccagccctgcttcaccttcagccaccccaacagagaccccatgattgacaacaaccgctactgcaccctggagttccctgtggaggtgaacacagtgctgcacggctttgctggctactttgagaccgtgctgtaccaggacatcaccctgagcatccggcctgagacccacagccctggcatgttctcctggttccccatcctcttccccatcaagcagcccatcaccgtgcgggagggccagaccatctgtgtgcgcttctggcgctgcagcaacagcaagaaggtgtggtatgagtgggccgtgacagcccctgtgtgcagcgccatccacaaccccaccggccgcagctacaccatcggcctgtag

SEQ ID NO: 147899 - DNA, 1206 bp, Artificial Sequence
  Description of Artificial Sequence: Synthetic coding sequence
atgctgggcatcggcacagagggcccccacgtgggcctggtgcaggccagcgagcaccccaagattgagttctacctgaagaacttcaccagcgccaaggatgtgctgtttgccatcaaggaggtgggcttccggggcggcaacagcaacacagacatcaccctggagaagtacctgtttgtgatgctgaagagaagtgagaaccagcagacctacctgatgaatgctgatgtggccgagaggatgagcagcaccaccgtggacagcgaggagcggctgctgcggggcaaggccctgaagcacacagcccagaagttcttcaccgtggatgctggggtgaggaagggcatccccaaggtggtggtggtgttcattgatggctggcccagtgatgacatcgaggaggccggcatcgtggcccgggagtttggagtgaatgtgttcatcgtgtctgtggccaagcccatccctgaggagctgggcatggtgcaggatgtgacctttgtggacaaggctgtgtgcagaaataatggcttcttctcctaccacatgcccaactggtttggcaccaccaagtatgtgaagcccctggtgcagaagctgtgcacccatgagcagatgatgtgcagcaagacctgctacaacagcgtgaacatcgccttcctgattgatggcagcagctctgtgggggacagcaacttccggctgatgctggagtttgtgagcaacatcgccaagacctttgagatcagtgacattggagccaagattgctgctgtgcagttcacctatgaccagaggacagagttctccttcacagactacagcaccaaggaaaatgtgctggccgtcatccggaacatccgctacatgtctgggggcacagccactggagatgccatctccttcaccgtgagaaatgtgtttggccccatccgggagagccccaacaagaacttcctggtgattgtgacagatggccagagctatgatgatgtgcagggccctgctgctgctgcccatgatgctggcatcaccatcttctctgtgggcgtggcctgggcccccctggatgacctgaaggacatggccagcaagcccaaggagagccacgccttcttcacccgggagttcaccggcctggagcccatcgtgtctgatgtgatccggggcatctgccgggacttcctggagagccagcagtag

SEQ ID NO: 147900 - DNA, 1653 bp, Artificial Sequence; identical to SEQ ID NO: 142756
  Description of Artificial Sequence: Synthetic coding sequence

SEQ ID NO: 147901 - DNA, 732 bp, Artificial Sequence
  Description of Artificial Sequence: Synthetic coding sequence
atgctgagccgctggagcgccagcttcaccgtgaccaagggcaagagcagcacccaggaggccaccggccaggccgtgtccacagcccaccccccaacaggcaagaggctgaagaagaccccagagaagaagacaggcaacaaggactgcaaggctgacatcgccttcctgattgatggcagcttcaacatcggccagaggcgcttcaacctgcagaagaactttgtgggcaaggtggccctgatgctgggcattggaacagagggcccccacgtgggcctggtgcaggccagcgagcaccccaagattgagttctacctgaagaacttcaccagcgccaaggatgtgctgtttgccatcaaggaggtgggcttccggggcggcaacagcaacacaggcaaggccctgaagcacacagcccagaagttcttcaccgtggatgctggggtgaggaagggcatccccaaggtggtggtggtgttcattgatggctggcccagtgatgacatcgaggaggccggcatcgtggcccgggagtttggagtgaatgtgttcatcgtgtctgtggccaagcccatccctgaggagctgggcatggtgcaggatgtgacctttgtggacaaggctgtgtgcaggaacaacggcttcttctcctaccacatgcccaactggtttggcaccaccaagtatgtgtccctgtggtaccgcagctgtgccctgatgaacaagtag

SEQ ID NO: 147902 - DNA, 1278 bp, Artificial Sequence
  Description of Artificial Sequence: Synthetic coding sequence
atgggcccccggcggctgctgctggtggccgcctgcttcagcctgtgtggccccctgctgagcgcccggacccgggcccggcggcctgagagcaaggccaccaatgccaccctggaccccaggagcttcctgctgaggaaccccaatgacaagtatgagcccttctgggaggatgaggagaagaatgaaagtggcctgacagagtaccgcctggtgtccatcaacaagagcagccccctgcagaagcagctgcctgccttcatcagtgaagatgccagcggctacctgaccagctcctggctgaccctgtttgtgcccagcgtgtacacaggagtgtttgtggtgtccctgcccctgaacatcatggccatcgtggtgttcatcctgaagatgaaggtgaagaagccagctgtggtgtacatgctgcacctggccacagcagatgtgctgtttgtgtctgtgctgcccttcaagatctcctactacttcagcggcagtgactggcagtttggcagcgagctgtgccgctttgtgacagctgccttctactgcaacatgtatgccagcatcctgctgatgaccgtcatcagcattgaccgcttcctggccgtggtgtaccccatgcagagcctgtcctggaggaccctgggccgggccagcttcacctgcctggccatctgggccctggccatcgccggcgtggtgcccctgctgctgaaggagcagaccatccaggtgcccggcctgaacatcaccacctgccatgatgtgctgaatgagaccctgctggagggctactatgcctactacttcagcgccttctctgctgtgttcttctttgtgcccctcatcatcagcacagtgtgctacgtgtccatcatccgctgcctgagcagcagcgctgtggccaacagaagcaagaagagccgggccctcttcctgtctgctgctgtgttctgcatcttcatcatctgcttcggccccaccaacgtgctgctgattgcccactacagcttcctgagccacaccagcaccacagaggccgcctactttgcctacctgctgtgtgtgtgtgtgagcagcatcagctgctgcatcgaccccctcatctactactatgccagcagcgagtgccagagatatgtgtacagcatcctgtgctgcaaggagagcagtgaccccagcagctacaacagcagcggccagctgatggccagcaagatggacacctgcagcagcaacctgaacaacagcatctacaagaagctgctgacctag

SEQ ID NO: 147903 - DNA, 1194 bp, Artificial Sequence
  Description of Artificial Sequence: Synthetic coding sequence
atgaggagccccagcgctgcctggctgctgggcgccgccatcctgctggccgccagcctgagctgcagcggcaccatccagggcaccagccgcagcagcaagggccgcagcctgattggcaaggtggatggcaccagccacgtgactggaaaaggagtgacagtggagaccgtcttctctgtggatgagttcagcgcctctgtgctgaccgggaagctgaccaccgtcttcctgcccatcgtgtacaccatcgtgtttgtggtgggcctgcccagcaatggcatggccctgtgggtgttcctgttccgcaccaagaagaagcaccctgctgtgatctacatggccaacctggccctggccgacctgctgagcgtcatctggttccccctgaagatcgcctaccacatccacggcaacaactggatctatggagaggccctgtgcaatgtgctgattggcttcttctacggcaacatgtactgcagcatcctcttcatgacctgcctgtctgtgcagcgctactgggtgattgtgaaccccatgggccacagcaggaagaaggccaacatcgccatcggcatcagcctggccatctggctgctgatcctgctggtgaccatccccctgtatgtggtgaagcagaccatcttcatcccagccctgaacatcaccacctgccatgatgtgctgcctgagcagctgctggtgggggacatgttcaactacttcctgagcctggccatcggggtcttcctgtttcctgccttcctgacagccagcgcctacgtgctgatgatccgcatgctgcggagcagcgccatggatgagaacagcgagaagaagaggaagagggccatcaagctgattgtgacagtgctggccatgtacctgatctgcttcacccccagcaacctgctgctggtggtgcactacttcctgatcaagagccagggccagagccacgtgtatgccctgtacatcgtggccctgtgcctgagcaccctgaacagctgcatcgacccctttgtgtactactttgtgtcccatgacttccgggaccacgccaagaatgccctgctgtgccgctctgtgaggacagtgaagcagatgcaggtgtccctgaccagcaagaagcacagcaggaagagcagcagctacagcagcagcagcaccaccgtgaagaccagctactag

SEQ ID NO: 147904 - DNA, 1125 bp, Artificial Sequence
  Description of Artificial Sequence: Synthetic coding sequence
atgaaggccctgatctttgctgctgctggcctgctgctgctgctgcccaccttctgccagagcggcatggagaatgacaccaacaacctggccaagcccaccctgcccatcaagaccttccggggggccccacccaacagctttgaggagttccccttcagcgccctggagggctggacaggagccaccatcaccgtgaagatcaagtgcccagaggagagcgccagccacctgcacgtgaagaatgccaccatgggctacctgaccagcagcctgagcaccaagctgatcccagccatctacctgctggtgtttgtggtgggcgtgcctgccaatgctgtgaccctgtggatgctgttcttccgcaccaggagcatctgcaccaccgtcttctacaccaacctggccatcgctgacttcctgttctgtgtgaccctgcccttcaagatcgcctaccacctgaatggaaacaactgggtgtttggagaggtgctgtgccgggccaccaccgtcatcttctacggcaacatgtactgcagcatcctgctgctggcctgcatcagcatcaaccgctacctggccatcgtgcaccccttcacctaccggggcctgcccaagcacacctacgccctggtgacctgtggcctggtgtgggccaccgtcttcctgtacatgctgcccttcttcatcctgaagcaggagtactacctggtgcagcctgacatcaccacctgccatgatgtgcacaacacctgtgagagcagcagccccttccagctgtactacttcatcagcctggccttcttcggcttcctgatcccctttgtgctgatcatctactgctatgctgccatcatccgcaccctgaatgcctatgaccaccgctggctgtggtacgtgaaggccagcctgctgatcctggtgatcttcaccatctgctttgcccccagcaacatcatcctgatcatccaccacgccaactactactacaacaacacagatggcctgtacttcatctacctgattgccctgtgcctgggcagcctgaacagctgcctggaccccttcctgtacttcctgatgagcaagaccaggaaccacagcacagcctacctgaccaagtag

SEQ ID NO: 147905 - DNA, 1059 bp, Artificial Sequence
  Description of Artificial Sequence: Synthetic coding sequence
atggagaatgacaccaacaacctggccaagcccaccctgcccatcaagaccttccggggggccccacccaacagctttgaggagttccccttcagcgccctggagggctggacaggagccaccatcaccgtgaagatcaagtgcccagaggagagcgccagccacctgcacgtgaagaatgccaccatgggctacctgaccagcagcctgagcaccaagctgatcccagccatctacctgctggtgtttgtggtgggcgtgcctgccaatgctgtgaccctgtggatgctgttcttccgcaccaggagcatctgcaccaccgtcttctacaccaacctggccatcgctgacttcctgttctgtgtgaccctgcccttcaagatcgcctaccacctgaatggaaacaactgggtgtttggagaggtgctgtgccgggccaccaccgtcatcttctacggcaacatgtactgcagcatcctgctgctggcctgcatcagcatcaaccgctacctggccatcgtgcaccccttcacctaccggggcctgcccaagcacacctacgccctggtgacctgtggcctggtgtgggccaccgtcttcctgtacatgctgcccttcttcatcctgaagcaggagtactacctggtgcagcctgacatcaccacctgccatgatgtgcacaacacctgtgagagcagcagccccttccagctgtactacttcatcagcctggccttcttcggcttcctgatcccctttgtgctgatcatctactgctatgctgccatcatccgcaccctgaatgcctatgaccaccgctggctgtggtacgtgaaggccagcctgctgatcctggtgatcttcaccatctgctttgcccccagcaacatcatcctgatcatccaccacgccaactactactacaacaacacagatggcctgtacttcatctacctgattgccctgtgcctgggcagcctgaacagctgcctggaccccttcctgtacttcctgatgagcaagaccaggaaccacagcacagcctacctgaccaagtag

SEQ ID NO: 147906 - DNA, 1158 bp, Artificial Sequence
  Description of Artificial Sequence: Synthetic coding sequence
atgtggggccgcctgctgctgtggcccctggtgctgggcttcagcctgagcggcggcacccagacccccagcgtgtatgatgaaagtggcagcactggaggaggagatgacagcacccccagcatcctgcctgccccccggggctacccaggccaggtgtgtgccaatgacagcgacaccctggagctgcctgacagcagccgggccctgctgctgggctgggtgcccacccggctggtgcctgccctgtatggcctggtgctggtggtgggcctgcctgccaacggcctggccctgtgggtgctggccacccaggccccccggctgcccagcaccatgctgctgatgaacctggccgctgctgacctgctgctggccctggccctgcccccaagaattgcctaccacctgcggggccagcgctggccctttggagaggccgcctgccgcctggccacagctgccctgtatggccacatgtatggctctgtgctgctgctggccgctgtgtccctggaccgctacctggccctggtgcaccccctgcgggcccgggccctgcggggccggcggctggccctgggcctgtgcatggccgcctggctgatggctgctgccctggccctgcccctgaccctgcagaggcagaccttccggctggcccggagtgacagagtgctgtgccatgatgccctgcccctggatgcccaggccagccactggcagcctgccttcacctgcctggccctgctgggctgcttcctgcccctgctggccatgctgctgtgctacggggccaccctgcacaccctggccgccagcggccgccgctatggccacgccctgcggctgacagctgtggtgctggccagcgctgtggccttctttgtgcccagcaacctgctgctgctgctgcactacagcgaccccagccccagcgcctggggcaacctgtatggagcctacgtgcccagcctggccctgagcaccctgaacagctgtgtggaccccttcatctactactacgtgtctgctgagttccgggacaaggtgcgggccggcctcttccagaggagccctggggacacagtggccagcaaggccagcgctgagggcggcagccggggcatgggcacccacagcagcctgctgcagtag

SEQ ID NO: 147907 - DNA, 1848 bp, Artificial Sequence
  Description of Artificial Sequence: Synthetic coding sequence
atgagggccctgctgctgctgggcttcctgctggtgtccctggagagcaccctgagcatccccccctgggaggcccccaaggagcacaagtacaaggccgaggagcacacagtggtgctgactgtgactggagagccctgccacttccccttccagtaccaccggcagctgtaccacaagtgcacccacaagggccggcccggcccccagccctggtgtgccaccacccccaactttgaccaggaccagcgctggggctactgcctggagcccaagaaggtgaaggaccactgcagcaagcacagcccctgccagaagggcggcacctgtgtgaacatgcccagcggcccccactgcctgtgcccccagcacctgaccggcaaccactgccagaaggagaagtgctttgagccccagctgctgcgcttcttccacaagaatgagatctggtacagaacagagcaggccgctgtggcccgctgccagtgcaagggcccagatgcccactgccagaggctggccagccaggcctgcaggaccaacccctgcctgcatggaggccgctgcctggaggtggagggccaccggctgtgccactgccctgtgggctacacaggagccttctgtgatgtggacaccaaggccagctgctatgatggccggggcctgagctaccggggcctggcccggaccaccctgagcggggccccctgccagccctgggccagcgaggccacctacagaaatgtgacagctgagcaggccaggaactggggcctgggcggccacgccttctgcagaaatccagacaatgacatccggccctggtgctttgtgctgaacagagaccggctgtcctgggagtactgtgacctggcccagtgccagacccccacccaggccgccccacccacccctgtgagcccccggctgcacgtgcccctgatgcctgcccagcctgccccacccaagccccagcccaccaccaggaccccaccccagagccagacccctggggccctgcctgccaagcgggagcagccccccagcctgaccagaaatggccccctgagctgtggccagaggctgaggaagagcctgagctccatgaccagggtggtgggcggcctggtggccctgcggggggcccacccctacatcgccgccctgtactggggccacagcttctgtgccggcagcctcatcgccccctgctgggtgctgacagctgcccactgcctgcaggacaggcctgcccctgaggacctgactgtggtgctgggccaggagaggaggaaccacagctgtgagccctgccagaccctggccgtgcgcagctaccgcctgcacgaggccttcagccctgtgtcctaccagcacgacctggccctgctgcggctgcaggaggatgctgatggcagctgtgccctgctgagcccctacgtgcagcctgtgtgcctgcccagcggggccgcccggcccagcgagaccaccctgtgccaggtggccggctggggccaccagtttgaaggagctgaggagtatgccagcttcctgcaggaggcccaggtgcccttcctgagcctggagcgctgcagcgccccagatgtgcacggcagcagcatcctgcccggcatgctgtgtgccggcttcctggagggcggcacagatgcctgccagggcgacagcggcggccccctggtgtgtgaggaccaggccgctgagcggcggctgaccctgcagggcatcatctcctggggcagcggctgtggggacaggaacaagccaggagtgtacacagatgtggcctactacctggcctggatccgggagcacacagtgtcctag

SEQ ID NO: 147908 - DNA, 1986 bp, Artificial Sequence
  Description of Artificial Sequence: Synthetic coding sequence
atgaggctgaagaacctgaccttcatcatcatcctgatcatctctggagagctgtatgcagaggagaagccctgtggcttcccccacgtggagaatggaagaattgcccagtactactacaccttcaagagcttctacttccccatgagcattgacaagaagctgtccttcttctgcctggccggctacaccacagaaagtggccggcaggaggagcagaccacctgcaccacagagggctggagccctgagccccgctgcttcaagaagtgcaccaagccagacctgagcaatggctacatcagtgatgtgaagctgctgtacaagatccaggagaacatgagatatggctgtgccagcggctacaagaccactggaggcaaggatgaggaggtggtgcagtgcctgagtgatggctggagcagccagcccacctgcaggaaggagcacgagacctgcctggcccctgagctgtacaacggcaactacagcaccacccagaagaccttcaaggtgaaggacaaggtgcagtatgaatgtgccaccggctactacacagctgggggcaagaagacagaggaggtggagtgcctgacctacggctggagcctgacccccaagtgcaccaagctgaagtgcagcagcctgcggctgattgaaaatggctacttccaccctgtgaagcagacctatgaggagggagatgtggtgcagttcttctgccacgagaactactacctgagcggcagtgacctgatccagtgctacaactttggctggtacccagagagccctgtgtgtgagggcagaagaaaccgctgccccccaccacccctgcccatcaacagcaagatccagacccacagcaccacctaccgccacggggagatcgtgcacattgaatgtgagctgaactttgagatccacggcagcgctgagatccgctgtgaagatggcaagtggacagagccccccaagtgcatcgagggccaggagaaggtggcctgtgaggagccccccttcattgaaaatggagctgccaacctgcacagcaagatctactacaacggggacaaggtgacctacgcctgcaagagcggctacctgctgcacggcagcaatgagatcacctgcaacagaggcaagtggaccctgcccccagaatgtgtggagaacaatgaaaactgcaagcacccccctgtggtgatgaatggagctgtggctgatggcatcctggccagctatgccaccggcagctctgtggagtaccgctgcaatgagtactacctgctgcggggcagcaagatcagccgctgtgagcagggcaagtggagcagcccccctgtgtgcctggagccctgcaccgtgaatgtggactacatgaacagaaacaacatcgagatgaagtggaagtatgagggcaaggtgctgcacggggacctgattgactttgtgtgcaagcagggctatgacctgagccccctgacccccctgtctgagctgtctgtgcagtgcaacagaggagaggtgaagtaccccctgtgcaccaggaaggagagcaagggcatgtgcaccagccccccactcatcaagcacggcgtcatcatcagcagcacagtggacacctatgaaaatggcagctctgtggagtaccgctgctttgaccaccacttcctggagggcagccgggaggcctactgcctggatggcatgtggaccaccccacccctgtgcctggagccctgcaccctgtccttcacagagatggagaagaacaacctgctgctgaagtgggactttgacaaccggccccacatcctgcacggggagtacatcgagttcatctgccgcggggacacctacccagctgagctgtacatcaccggcagcatcctgaggatgcagtgtgaccggggccagctgaagtacccccgctgcatcccccggcagagcaccctgagctaccaggagcccctgcggacctag

SEQ ID NO: 147909 - DNA, 3675 bp, Artificial Sequence
  Description of Artificial Sequence: Synthetic coding sequence
atgctgaccaagtttgagaccaagagcgcccgggtgaagggcctgtccttccaccccaagaggccctggatcctgaccagcctgcacaacggggtcatccagctgtgggactacaggatgtgcaccctgattgacaagtttgatgaacatgatggccctgtgcggggcatcgacttccacaagcagcagcccctgtttgtgtctggaggagatgactacaagatcaaggtgtggaactacaagctgcggcgctgcctcttcaccctgctgggccacctggactacatccgcaccaccttcttccaccacgagtacccctggatcctgagcgccagtgatgaccagaccatccgggtgtggaactggcagagcaggacctgtgtgtgtgtgctgaccggccacaaccactacgtgatgtgtgcccagttccaccccacagaggacctggtggtgtctgccagcctggaccagacagtgcgggtgtgggacatcagcggcctgaggaagaagaacctgagccctggagctgtggagagtgatgtgcggggcatcactggagtggacctgtttggcaccacagatgctgtggtgaagcacgtgctggagggccatgacagaggagtgaactgggccgccttccaccccaccatgcccctcatcgtgtctggagcagatgaccggcaggtgaagatctggaggatgaatgaaagcaaggcctgggaggtggacacctgccggggccactacaacaacgtgtcctgtgctgtgttccacccccggcaggagctgatcctgagcaacagcgaggacaagagcatccgggtgtgggacatgagcaagaggactggagtgcagaccttccggcgggaccatgaccgcttctgggtgctggccgcccaccccaacctgaacctgtttgctgctggccatgatggcggcatgattgtgttcaagctggagcgggagaggcctgcctatgctgtgcacggcaacatgctgcactacgtgaaggaccgcttcctgcggcagctggacttcaacagcagcaaggatgtggccgtgatgcagctgcggagcggcagcaagtttcctgtgttcaacatgagctacaacccagcagaaaatgctgtgctgctgtgcacccgggccagcaacctggagaacagcacctatgacctgtacaccatccccaaggatgctgacagccagaacccagatgcccctgagggcaagaggagcagcggcctgacagctgtgtgggtggccaggaacagatttgctgtgctggacaggatgcacagcctgctgatcaagaacctgaagaatgagatcaccaagaaggtgcaggtgcccaactgtgatgagatcttctacgccggcactggaaacctgctgctgagagatgctgacagcatcaccctgtttgatgtgcagcagaagaggaccctggcctctgtgaagatcagcaaggtgaagtatgtgatctggagcgctgacatgagccacgtggccctgctggccaagcacgccatcgtcatctgcaacaggaagctggatgccctgtgcaacatccacgagaacatccgggtgaagagcggggcctgggatgagagcggggtcttcatctacaccaccagcaaccacatcaagtatgctgtgaccactggagaccacggcatcatccgcaccctggacctgcccatctacgtgaccagggtgaagggcaacaacgtgtactgcctggaccgggagtgccggccccgggtgctgaccatcgaccccacagagttcaagttcaagctggccctgatcaacagaaaatatgatgaggtgctgcacatggtgagaaatgccaagctggtgggccagagcatcatcgcctacctgcagaagaagggctacccagaggtggccctgcactttgtgaaggatgagaagacccgcttcagcctggccctggagtgtggcaacatcgagatcgccctggaggccgccaaggccctggatgacaagaactgctgggagaagctgggggaggtggccctgctgcagggcaaccaccagatcgtggagatgtgctaccagaggaccaagaactttgacaagctgtccttcctgtacctgatcaccggcaacctggagaagctgaggaagatgatgaagattgctgagatcaggaaggacatgagcggccactaccagaatgccctgtacctgggagatgtgtctgagcgggtgcgcatcctgaagaactgtggccagaagagcctggcctacctgacagctgccacccacggcctggatgaggaggccgagagcctgaaggagacctttgatcctgagaaggagaccatcccagacatcgaccccaatgccaagctgctgcagcccccagcccccatcatgcccctggacaccaactggcccctgctgactgtgtccaagggcttctttgagggcaccatcgccagcaaaggaaaaggaggagccctggccgctgacattgatattgacacagtgggcacagagggctggggagaagatgctgagctgcagctggatgaagatggctttgtggaggccacagagggcctgggagatgatgccctgggcaagggccaggaggagggcggcggctgggatgtggaggaggacctggagctgcccccagagctggacatcagccctggagctgctggaggagcagaagatggcttctttgtgccccccaccaagggcaccagccccacccagatctggtgcaacaacagccagctgcctgtggaccacatcctggccggcagctttgaaacagccatgaggctgctgcatgaccaggtgggcgtcatccagtttggcccctacaagcagctgttcctgcagacctacgcccggggccgcaccacctaccaggccctgccctgcctgcccagcatgtatggctaccccaacagaaactggaaggatgctggcctgaagaatggagtgcctgctgtgggcctgaagctgaatgacctgatccagaggctgcagctgtgctaccagctgaccaccgtgggcaagtttgaggaggccgtggagaagttccgcagcatcctgctgtctgtgcccctgctggtggtggacaacaagcaggagattgctgaggcccagcagctgatcaccatctgccgggagtacatcgtgggcctgtctgtggagacagagaggaagaagctgcccaaggagaccctggagcagcagaagaggatctgtgagatggccgcctacttcacccacagcaacctgcagcctgtgcacatgatcctggtgctgaggacagccctgaacctcttcttcaagctgaagaacttcaagacagctgccacctttgcccggcggctgctggagctgggccccaagccagaggtggcccagcagaccaggaagatcctgagcgcctgtgagaagaaccccacagatgcctaccagctgaactatgacatgcacaacccctttgacatctgtgccgccagctaccggcccatctaccggggcaagcctgtggagaagtgccccctgagcggggcctgctacagccctgagttcaagggccagatctgccgggtgaccaccgtgacagaaattggcaaggatgtgattggcctgcgcatcagccccctgcagttcagatag

SEQ ID NO: 147910 - DNA, 3702 bp, Artificial Sequence
  Description of Artificial Sequence: Synthetic coding sequence
atgctgaccaagtttgagaccaagagcgcccgggtgaagggcctgtccttccaccccaagaggccctggatcctgaccagcctgcacaacggggtcatccagctgtgggactacaggatgtgcaccctgattgacaagtttgatgaacatgatggccctgtgcggggcatcgacttccacaagcagcagcccctgtttgtgtctggaggagatgactacaagatcaaggtgtggaactacaagctgcggcgctgcctcttcaccctgctgggccacctggactacatccgcaccaccttcttccaccacgagtacccctggatcctgagcgccagtgatgaccagaccatccgggtgtggaactggcagagcaggacctgtgtgtgtgtgctgaccggccacaaccactacgtgatgtgtgcccagttccaccccacagaggacctggtggtgtctgccagcctggaccagacagtgcgggtgtgggacatcagcggcctgaggaagaagaacctgagccctggagctgtggagagtgatgtgcggggcatcactggagtggacctgtttggcaccacagatgctgtggtgaagcacgtgctggagggccatgacagaggagtgaactgggccgccttccaccccaccatgcccctcatcgtgtctggagcagatgaccggcaggtgaagatctggaggatgaatgaaagcaaggcctgggaggtggacacctgccggggccactacaacaacgtgtcctgtgctgtgttccacccccggcaggagctgatcctgagcaacagcgaggacaagagcatccgggtgtgggacatgagcaagaggactggagtgcagaccttccggcgggaccatgaccgcttctgggtgctggccgcccaccccaacctgaacctgtttgctgctggccatgatggcggcatgattgtgttcaagctggagcgggagaggcctgcctatgctgtgcacggcaacatgctgcactacgtgaaggaccgcttcctgcggcagctggacttcaacagcagcaaggatgtggccgtgatgcagctgcggagcggcagcaagtttcctgtgttcaacatgagctacaacccagcagaaaatgctgtgctgctgtgcacccgggccagcaacctggagaacagcacctatgacctgtacaccatccccaaggatgctgacagccagaacccagatgcccctgagggcaagaggagcagcggcctgacagctgtgtgggtggccaggaacagatttgctgtgctggacaggatgcacagcctgctgatcaagaacctgaagaatgagatcaccaagaaggtgcaggtgcccaactgtgatgagatcttctacgccggcactggaaacctgctgctgagagatgctgacagcatcaccctgtttgatgtgcagcagaagaggaccctggcctctgtgaagatcagcaaggtgaagtatgtgatctggagcgctgacatgagccacgtggccctgctggccaagcatgagcacagctgccccctgcccctgacagccatcgtcatctgcaacaggaagctggatgccctgtgcaacatccacgagaacatccgggtgaagagcggggcctgggatgaaagtggagtcttcatctacaccaccagcaaccacatcaagtatgctgtgaccaccggggaccacggcatcatccgcaccctggacctgcccatctacgtgaccagggtgaagggcaacaacgtgtactgcctggacagagaatgtcggccccgggtgctgaccatcgaccccacagagttcaagttcaagctggccctgatcaacagaaaatatgatgaggtgctgcacatggtgagaaatgccaagctggtgggccagagcatcatcgcctacctgcagaagaagggctacccagaggtggccctgcactttgtgaaggatgagaagacccgcttcagcctggccctggagtgtggcaacattgaaattgccctggaggccgccaaggccctggatgacaagaactgctgggagaagctgggggaggtggccctgctgcagggcaaccaccagatcgtggagatgtgctaccagaggaccaagaactttgacaagctgtccttcctgtacctgatcactggaaacctggagaagctgaggaagatgatgaagattgctgagatcaggaaggacatgagcggccactaccagaatgccctgtacctgggagatgtgtctgagcgggtgcgcatcctgaagaactgtggccagaagagcctggcctacctgacagctgccacccacggcctggatgaggaggccgagagcctgaaggagacctttgatcctgagaaggagaccatcccagacatcgaccccaatgccaagctgctgcagcccccagcccccatcatgcccctggacaccaactggcccctgctgactgtgtccaagggcttctttgagggcaccatcgccagcaagggcaagggcggggccctggccgctgacatcgacatcgacacagtgggcacagagggctggggagaagatgctgagctgcagctggatgaagatggctttgtggaggccacagagggcctgggagatgatgccctgggcaagggccaggaggagggcggcggctgggatgtggaggaggacctggagctgcccccagagctggacatcagccctggagctgctgggggcgcagaagatggcttctttgtgccccccaccaagggcaccagccccacccagatctggtgcaacaacagccagctgcctgtggaccacatcctggccggcagctttgaaacagccatgaggctgctgcatgaccaggtgggcgtcatccagtttggcccctacaagcagctgttcctgcagacctacgcccggggccgcaccacctaccaggccctgccctgcctgcccagcatgtatggctaccccaacagaaactggaaggatgctggcctgaagaatggagtgcctgctgtgggcctgaagctgaatgacctgatccagaggctgcagctgtgctaccagctgaccaccgtgggcaagtttgaggaggccgtggagaagttccgcagcatcctgctgtctgtgcccctgctggtggtggacaacaagcaggagattgctgaggcccagcagctgatcaccatctgccgggagtacatcgtgggcctgtctgtggagacagagaggaagaagctgcccaaggagaccctggagcagcagaagaggatctgtgagatggccgcctacttcacccacagcaacctgcagcctgtgcacatgatcctggtgctgaggacagccctgaacctcttcttcaagctgaagaacttcaagacagctgccacctttgcccggcggctgctggagctgggccccaagccagaggtggcccagcagaccaggaagatcctgagcgcctgtgagaagaaccccacagatgcctaccagctgaactatgacatgcacaacccctttgacatctgtgccgccagctaccggcccatctaccggggcaagcctgtggagaagtgccccctgagcggggcctgctacagccctgagttcaagggccagatctgccgggtgaccaccgtgacagagatcggcaaggatgtgattggcctgcgcatcagccccctgcagttcagatag

SEQ ID NO: 147911 - DNA, 2862 bp, Artificial Sequence
  Description of Artificial Sequence: Synthetic coding sequence
atgacagctgctgaaaatgtgtgctacaccctcatcaacgtgcccatggacagcgagccccccagcgagatcagcctgaagaatgacctggagaagggagatgtgaagagcaagacagaggccctgaagaaggtgatcatcatgatcctgaatggagagaagctgcccggcctgctgatgaccatcatccgctttgtgctgcccctgcaggaccacaccatcaagaagctgctgctggtgttctgggagatcgtgcccaagaccaccccagatggccgcctgctgcacgagatgatcctggtgtgtgatgcctacaggaaggacctgcagcaccccaatgagttcatccggggcagcaccctgcgcttcctgtgcaagctgaaggaggccgagctgctggagcccctgatgcctgccatccgggcctgcctggagcaccgccacagctatgtgagaagaaatgctgtgctggccatctacaccatctacagaaactttgagcacctgatcccagatgcccctgagctgattcatgacttcctggtgaatgagaaggatgccagctgcaagagaaatgccttcatgatgctgattcatgctgaccaggaccgggccctggactacctgagcacctgcatcgaccaggtgcagacctttggagacatcctgcagctggtgattgtggagctgatctacaaggtgtgccacgccaaccccagcgagcgggcccgcttcatccgctgcatctacaacctgctgcagagcagcagccctgctgtgaagtatgaggccgccggcaccctggtgaccctgagcagcgcccccacagccatcaaggctgctgcccagtgctacatcgacctgatcatcaaggagagtgacaacaacgtgaagctgattgtgctggacaggctcatcgagctgaaggagcacccagcccacgagcgggtgctgcaggacctggtgatggacatcctgcgggtgctgagcaccccagacctggaggtgaggaagaagaccctgcagctggccctggacctggtgagcagcagaaatgtggaggagctggtgattgtgctgaagaaggaggtgatcaagaccaacaacgtgtctgaacatgaggacacagacaagtaccggcagctgctggtgaggaccctgcacagctgcagcgtgcgcttcccagacatggccgccaacgtcatccctgtgctgatggagttcctgagtgacaacaatgaagctgctgctgctgatgtgctggagtttgtgcgggaggccatccagagatttgacaacctgaggatgctgattgtggagaagatgctggaggtgttccacgccatcaagtctgtgaagatctacagaggagccctgtggatcctgggggagtactgcagcaccaaggaggacatccagagcgtgatgacagagatccgccgcagcctgggggagatccccatcgtggagagcgagatcaagaaggaggccggggagctgaagccagaggaggagatcaccgtgggccctgtgcagaagctggtgacagagatgggcacctacgccacccagagcgccctgagcagcagccggcccaccaagaaggaggaggaccggccccccctgcggggcttcctgctggatggagacttctttgtggccgccagcctggccaccaccctgaccaagatcgccctgcgctacgtggccctggtgcaggagaagaagaagcagaacagctttgtggccgaggccatgctgctgatggccaccatcctgcacctgggcaagagcagcctgcccaagaagcccatcacagatgatgatgtggaccgcatcagcctgtgcctgaaggtgctgtctgagtgcagccccctgatgaatgacatcttcaacaaggagtgccggcagagcctgagccacatgctgagcgccaagctggaggaggagaagctgagccagaagaaggagagcgagaagagaaatgtgacagtgcagccagatgaccccatctccttcatgcagctgacagccaagaatgagatgaactgcaaggaggaccagttccagctgagcctgctggccgccatgggcaacacccagaggaaggaggccgctgaccccctggccagcaagctgaacaaggtgacccagctgaccggcttcagtgaccctgtgtatgcagaggcctacgtgcacgtgaaccagtatgacatcgtgctggatgtgctggtggtgaaccagaccagtgacaccctgcagaactgcaccctggagctggccaccctgggggacctgaagctggtggagaagcccagccccctgaccctggcccctcatgactttgccaacatcaaggccaacgtgaaggtggccagcacagaaaatggcatcatcttcggcaacatcgtgtatgatgtgtctggggccgccagtgacaggaactgtgtggtgctgagtgacatccacatcgacatcatggactacatccagcctgccacctgcacagatgctgagttccggcagatgtgggccgagtttgagtgggagaacaaggtgacagtgaacaccaacatggtggacctgaatgactacctgcagcacatcctgaagagcaccaacatgaagtgcctgaccccagagaaggccctgagcggctactgcggcttcatggccgccaacctgtatgcccggagcatctttggagaagatgccctggccaacgtgtccattgagaagcccatccaccagggcccagatgctgctgtgacaggccacatccgcatccgggccaagagccagggcatggccctgagcctgggggacaagatcaacctgagccagaagaagaccagcatctag

SEQ ID NO: 147912 - DNA, 2862 bp, Artificial Sequence; identical to SEQ ID NO: 147911
  Description of Artificial Sequence: Synthetic coding sequence

SEQ ID NO: 147913 - DNA, 2721 bp, Artificial Sequence
  Description of Artificial Sequence: Synthetic coding sequence
atgcccctgcggctggacatcaagaggaagctgacagcccggagtgacagagtgaagtctgtggacctgcaccccacagagccctggatgctggccagcctgtacaacggctctgtgtgtgtgtggaaccacgagacccagaccctggtgaagacctttgaggtgtgtgacctgcctgtgcgggccgccaagtttgtggccaggaagaactgggtggtgactggagcagatgacatgcagatccgggtcttcaactacaacaccctggagcgggtgcacatgtttgaggcccacagcgactacatccgctgcatcgctgtgcaccccacccagcccttcatcctgaccagcagtgatgacatgctgatcaagctgtgggactgggacaagaagtggagctgcagccaggtgtttgagggccacacccactacgtgatgcagatcgtcatcaaccccaaggacaacaaccagtttgccagcgccagcctggacaggaccatcaaggtgtggcagctgggcagcagcagccccaacttcaccctggagggccacgagaagggcgtgaactgcatcgactactacagcggcggggacaagccctacctgatcagcggggctgatgaccggctggtgaagatctgggactaccagaacaagacctgtgtgcagaccctggagggccacgcccagaatgtgtcctgtgccagcttccaccctgagctgcccatcatcatcaccggctctgaagatggcaccgtgcgcatctggcacagcagcacctaccgcctggagagcaccctgaactacggcatggagcgggtgtggtgtgtggccagcctgcggggcagcaacaacgtggccctgggctatgatgagggcagcatcatcgtgaagctgggccgggaggagcccgccatgtccatggatgccaacgggaagatcatctgggccaagcacagcgaggtgcagcaggccaacctgaaggccatgggagatgctgagatcaaggatggagagcggctgcccctggccgtgaaggacatgggcagctgtgagatctacccccagaccatccagcacaaccccaacggccgctttgtggtggtgtgtggagatggagagtacatcatctacacagccatggccctgaggaacaagagctttggcagcgcccaggagtttgcctgggcccatgacagcagtgaatatgccatccgggagagcaacagcatcgtgaagatcttcaagaacttcaaggagaagaagagcttcaagccagactttggagctgagagcatctacggcggcttcctgctgggcgtgcgctctgtgaatggcctggccttctatgactgggacaacacagagctgatcagaagaattgagatccagcccaagcacatcttctggagcgacagcggggagctggtgtgcatcgccacagaggagagcttcttcatcctgaagtacctgtctgagaaggtgctggccgcccaggagacccatgagggcgtgacagaagatggcattgaagatgcctttgaggtgctgggggagatccaggagatcgtgaagacaggcctgtgggtgggggactgcttcatctacaccagctctgtgaaccggctgaactactacgtgggcggggagatcgtgaccatcgcccacctggacaggaccatgtacctgctgggctacatccccaaggacaacagactctacctgggggacaaggagctgaacatcatctcctacagcctgctggtgtctgtgctggagtaccagacagctgtgatgaggcgggacttctccatggctgacaaggtgctgcccaccatccccaaggagcagaggaccagggtggcccacttcctggagaagcagggcttcaagcagcaggccctgactgtgtccacagatcctgagcacagatttgagctggccctgcagctgggggagctgaagatcgcctaccagctggccgtggaggccgagagcgagcagaagtggaagcagctggccgagctggccatcagcaagtgccagtttggcctggcccaggagtgcctgcaccacgcccaggactatggaggcctgctgctgctggccacagccagcggaaatgccaacatggtgaacaagctggccgagggcgctgagagagatggcaagaacaacgtggccttcatgagctacttcctgcagggcaaggtggatgcctgcctggagctgctgatcagaacaggccgcctgcctgaggccgccttcctggcccggacctacctgcccagccaggtgtcccgggtggtgaagctgtggagggagaacctgagcaaggtgaaccagaaggctgctgagagcctggccgaccccacagaatatgaaaatctcttccctggcctgaaggaggcctttgtggtggaggagtgggtgaaggagacccacgccgacctgtggccagccaagcagtaccccctggtgaccccaaatgaggagagaaatgtgatggaggagggcaaggacttccagcccagccgcagcacagcccagcaggagctggatggcaagccagccagccccacccctgtgattgtggccagccacacagccaacaaggaggagaagagcctgctggagctggaggtggacctggacaacctggagctggaggacatcgacaccacagacatcaacctggatgaggacatcctggatgactag

SEQ ID NO: 147914 - DNA, 2634 bp, Artificial Sequence
  Description of Artificial Sequence: Synthetic coding sequence
atgctggccagcctgtacaatggatctgtgtgtgtgtggaaccacgagacccagaccctggtgaagacctttgaggtgtgtgacctgcctgtgcgggccgccaagtttgtggccaggaagaactgggtggtgactggagcagatgacatgcagatccgggtcttcaactacaacaccctggagcgggtgcacatgtttgaggcccacagcgactacatccgctgcatcgctgtgcaccccacccagcccttcatcctgaccagcagtgatgacatgctgatcaagctgtgggactgggacaagaagtggagctgcagccaggtgtttgagggccacacccactacgtgatgcagatcgtcatcaaccccaaggacaacaaccagtttgccagcgccagcctggacaggaccatcaaggtgtggcagctgggcagcagcagccccaacttcaccctggagggccacgagaagggcgtgaactgcatcgactactacagcggcggggacaagccctacctgatctctggagcagatgaccggctggtgaagatctgggactaccagaacaagacctgtgtgcagaccctggagggccacgcccagaatgtgtcctgtgccagcttccaccctgagctgcccatcatcatcactggaagtgaagatggcaccgtgcgcatctggcacagcagcacctaccgcctggagagcaccctgaactacggcatggagcgggtgtggtgtgtggccagcctgcggggcagcaacaacgtggccctgggctatgatgagggcagcatcatcgtgaagctgggccgggaggagcccgccatgtccatggatgccaacgggaagatcatctgggccaagcacagcgaggtgcagcaggccaacctgaaggccatgggagatgctgagatcaaggatggagagcggctgcccctggccgtgaaggacatgggcagctgtgagatctacccccagaccatccagcacaaccccaacggccgctttgtggtggtgtgtggagatggagagtacatcatctacacagccatggccctgaggaacaagagctttggaagtgcccaggagtttgcctgggcccatgacagcagtgaatatgccatccgggagagcaacagcatcgtgaagatcttcaagaacttcaaggagaagaagagcttcaagccagactttggagctgagagcatctatggaggcttcctgctgggcgtgcgctctgtgaatggcctggccttctatgactgggacaacacagagctgatccgccgcatcgagatccagcccaagcacatcttctggagcgacagcggggagctggtgtgcatcgccacagaggagagcttcttcatcctgaagtacctgtctgagaaggtgctggccgcccaggagacccatgaaggagtgacagaagatggcattgaagatgcctttgaggtgctgggggagatccaggagatcgtgaagacaggcctgtgggtgggggactgcttcatctacaccagctctgtgaaccggctgaactactacgtgggcggggagatcgtgaccatcgcccacctggacaggaccatgtacctgctgggctacatccccaaggacaaccggctgtacctgggggacaaggagctgaacatcatctcctacagcctgctggtgtctgtgctggagtaccagacagctgtgatgagaagagacttctccatggctgacaaggtgctgcccaccatccccaaggagcagaggaccagggtggcccacttcctggagaagcagggcttcaagcagcaggccctgactgtgtccacagatcctgagcacagatttgagctggccctgcagctgggggagctgaagatcgcctaccagctggccgtggaggccgagagcgagcagaagtggaagcagctggccgagctggccatcagcaagtgccagtttggcctggcccaggagtgcctgcaccacgcccaggactatggaggcctgctgctgctggccacagccagcggaaatgccaacatggtgaacaagctggccgagggcgctgagagagatggcaagaacaacgtggccttcatgagctacttcctgcagggcaaggtggatgcctgcctggagctgctgatcagaacaggccgcctgcctgaggccgccttcctggcccggacctacctgcccagccaggtgtcccgggtggtgaagctgtggagggagaacctgagcaaggtgaaccagaaggctgctgagagcctggccgaccccacagaatatgagaacctcttccctggcctgaaggaggcctttgtggtggaggagtgggtgaaggagacccatgctgacctgtggccagccaagcagtaccccctggtgaccccaaatgaggagagaaatgtgatggaggagggcaaggacttccagcccagccgcagcacagcccagcaggagctggatggcaagccagccagccccacccctgtgattgtggccagccacacagccaacaaggaggagaagagcctgctggagctggaggtggacctggacaacctggagctggaggacatcgacaccacagacatcaacctggatgaggacatcctggatgactag

SEQ ID NO: 147915 - DNA, 927 bp, Artificial Sequence
  Description of Artificial Sequence: Synthetic coding sequence
atggcccccccagcccctggccctgccagcggcggcagcggggaggtggatgagctgtttgatgtgaagaatgccttctacatcggcagctaccagcagtgcatcaatgaggcccagagggtgaagctgagcagccctgagagagatgtggagagagatgtgttcctgtaccgggcctacctggcccagaggaagtttggagtggtgctggatgagatcaagcccagcagcgcccctgagctgcaggccgtgaggatgtttgctgactacctggcccacgagagccggcgggacagcatcgtggccgagctggaccgggagatgagccgctctgtggatgtgaccaacaccaccttcctgctgatggccgccagcatctacctgcatgaccagaacccagatgctgccctgcgggccctgcaccagggcgacagcctggagtgcacagccatgacagtgcagatcctgctgaagctggaccggctggacctggccaggaaggagctgaagaggatgcaggacctggatgaagatgccaccctgacccagctggccacagcctgggtgtccctggccactggaggagagaagctgcaggatgcctactacatcttccaggagatggctgacaagtgcagccccaccctgctgctgctgaatggccaggccgcctgccacatggcccagggccgctgggaggccgctgagggcctgctgcaggaggccctggacaaggacagcggctacccagagaccctggtgaacctgattgtgctgagccagcacctgggcaagcccccagaggtgaccaaccgctacctgagccagctgaaggatgcccacaggagccaccccttcatcaaggagtaccaggccaaggaaaatgactttgaccggctggtgctgcagtatgcccccagcgcctag

SEQ ID NO: 147916 - DNA, 771 bp, Artificial Sequence
  Description of Artificial Sequence: Synthetic coding sequence
atggcccccccagcccctggccctgccagcggcggcagcggggaggtggatgagctgtttgatgtgaagaatgccttctacatcggcagctaccagcagtgcatcaatgaggcccagagggtgaagctgagcagccctgagagagatgtggagagagatgtgttcctgtaccgggcctacctggcccagaggaagtttggagtggtgctggatgagatcaagcccagcagcgcccctgagctgcaggccgtgaggatgtttgctgactacctggcccacgagagccggcgggacagcatcgtggccgagctggaccgggagatgagccgctctgtggatgtgaccaacaccaccttcctgctgatggccgccagcatctacctgcatgaccagaacccagatgctgccctgcgggccctgcaccagggcgacagcctggagtgcacagccatgacagtgcagatcctgctgaagctggaccggctggacctggccaggaaggagctgaagaggatgcaggacctggatgaagatgccaccctgacccagctggccacagcctgggtgtccctggccacagattctggctacccagagaccctggtgaacctgattgtgctgagccagcacctgggcaagcccccagaggtgaccaaccgctacctgagccagctgaaggatgcccacaggagccaccccttcatcaaggagtaccaggccaaggaaaatgactttgaccggctggtgctgcagtatgcccccagcgcctag

SEQ ID NO: 147917 - DNA, 774 bp, Artificial Sequence
  Description of Artificial Sequence: Synthetic coding sequence
atggcccccccagcccctggccctgccagcggcggcagcggggaggtggatgagctgtttgatgtgaagaatgccttctacatcggcagctaccagcagtgcatcaatgaggcccagagggtgaagctgagcagccctgagagagatgtggagagagatgtgttcctgtaccgggcctacctggcccagaggaagtttggagtggtgctggatgagatcaagcccagcagcgcccctgagctgcaggccgtgaggatgtttgctgactacctggcccacgagagccgcagcacagccatgacagtgcagatcctgctgaagctggaccggctggacctggccaggaaggagctgaagaggatgcaggacctggatgaagatgccaccctgacccagctggccacagcctgggtgtccctggccaccggcggggagaagctgcaggatgcctactacatcttccaggagatggctgacaagtgcagccccaccctgctgctgctgaatggccaggccgcctgccacatggcccagggccgctgggaggccgctgagggcctgctgcaggaggccctggacaaggacagcggctacccagagaccctggtgaacctgattgtgctgagccagcacctgggcaagcccccagaggtgaccaaccgctacctgagccagctgaaggatgcccacaggagccaccccttcatcaaggagtaccaggccaaggaaaatgactttgaccggctggtgctgcagtatgcccccagcgcctag

SEQ ID NO: 147918 - DNA, 924 bp, Artificial Sequence
  Description of Artificial Sequence: Synthetic coding sequence
atggcccccccagccccagctggcctgcggggcagcggggaggtggatgagctgtttgatgtgaagaatgccttctacatcggcagctaccagcagtgcatcaatgaggcccagagggtgaagctgagcagccctgagagagatgtggagagagatgtgttcctgtaccgggcctacctggcccagaggaagtttggagtggtgctggatgagatcaagcccagcagcgcccctgagctgcaggccgtgaggatgtttgctgactacctggcccacgagagcagaagagacagcatcgtggccgagctggaccgggagatgagccgctctgtggatgtgaccaacaccaccttcctgctgatggccgccagcatctacctgcatgaccagaacccagatgctgccctgcgggccctgcaccagggcgacagcctggagtgcacagccatgacagtgcagatcctgctgaagctggaccggctggacctggccaggaaggagctgaagaggatgcaggacctggatgaagatgccaccctgacccagctggccacagcctgggtgtccctggccaccggcggggagaagctgcaggatgcctactacatcttccaggagatggctgacaagtgcagccccaccctgctgctgctgaatggccaggccgcctgccacatggcccagggccgctgggaggccgctgagggcctgctgcaggaggccctggacaaggacagcggctacccagagaccctggtgaacctgattgtgctgagccagcacctgggcaagcccccagaggtgaccaaccgctacctgagccagctgaaggatgcccacaggagccaccccttcatcaaggagtaccaggccaaggaaaatgactttgaccggctggtgctgcagtatgcccccagcgcctag

SEQ ID NO: 147919 - DNA, 741 bp, Artificial Sequence
  Description of Artificial Sequence: Synthetic coding sequence
atgatcaagaagtttgacaagaaggatgaggagagcggcagcggcagcaaccccttccagcacctggagaagtctgctgtgctgcaggaggcccgcatcttcaatgagacccccatcaacccccggcgctgcctgcacatcctgaccaagatcctgtacctgctgaaccagggcgagcacttcggcaccacagaggccacagaggccttctttgccatgaccaggctcttccagagcaatgaccagaccctgcggaggatgtgctacctgaccatcaaggagatggccaccatcagtgaagatgtgatcatcgtgaccagcagcctgaccaaggacatgaccgggaaggaggatgtgtaccggggccctgccatccgggccctgtgccgcatcacagatggcaccatgctgcaggccatcgagcgctacatgaagcaggccatcgtggacaaggtgtcctctgtgagcagcagcgccctggtgagcagcctgcacatgatgaagatctcctatgatgtggtgaagcgctggatcaatgaggcccaggaggccgccagcagtgacaacatcatggtgcagtaccacgccctgggcgtgctgtaccacctgaggaagaatgaccggctggccgtgtccaagatgctgaacaagttcaccaagagcggcctgaagagccagtttgcctactgcatgctgatcagaattgccagccggctgctgaaggagacagaagatggatag

SEQ ID NO: 147920 - DNA, 468 bp, Artificial Sequence
  Description of Artificial Sequence: Synthetic coding sequence
tgagctggcagcttcagctgcaccatgaagttcaccgtgcgggactgtgaccccaacacaggagtgcctgatgaagatggctatgatgatgaatatgtgctggaggacctggaggtgacagtgtctgaccacatccagaaggtgctgaagcccaactttgctgctgcctgggaggaggtgggggacacctttgagaaggaggagacctttgccctgagcagcaccaagaccctggaggaggccgtgaacaacatcatcaccttcctgggcatgcagccctgtgagaggagtgacaaggtgcctgagaacaagaacagccacagcctgtacctggccggcatcttccggggcggctatgacctgctggtgcgcagccggctggccctggctgatggagtgaccatgcaggtgacagtgcgcagcaaggagaggacccctgtggatgtgatcctggcctctgtgggctag

SEQ ID NO: 147921 - DNA, 741 bp, Artificial Sequence; identical to SEQ ID NO: 147919
  Description of Artificial Sequence: Synthetic coding sequence

SEQ ID NO: 147922 - DNA, 1080 bp, Artificial Sequence
  Description of Artificial Sequence: Synthetic coding sequence
atgtacttcaagagagctgcccgggccttccctgtgctgctgactggagctgggaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggctgatgccatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccgcttccaggaggaccaggtgtgcacctag

SEQ ID NO: 147923 - DNA, 1188 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggctgatgccatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccgcttccaggaggaccaggtgtgcacctag

SEQ ID NO: 147924 - DNA, 543 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaaggtgaagtaccactag

SEQ ID NO: 147925 - DNA, 1044 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccaccaggagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccgcttccaggaggaccaggtgtgcacctag

SEQ ID NO: 147926 - DNA, 753 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggctgatgccatcctgatcaacaagacagacctggtgcctgaagaagatgtgaagaagctgcggaccaccatccgctatgagatgatctctgtgctgagcgcctaccgctccatgctgtacacccagaacatcttctacagcgactgctgccctgtggagacctag

SEQ ID NO: 147927 - DNA, 234 bp, Artificial Sequence
  Description of Artificial Sequence: Synthetic coding sequence
atgtacttcaagagagctgcccgggccttccctgtgctgctgactggagctgggaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaagtag

SEQ ID NO: 147928 - DNA, 342 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaagtag

SEQ ID NO: 147929 - DNA, 1131 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggctgatgccatcctgatcaacaagacagacctggtgcctgaagaagatgtgaagaagctgcggaccaccatccgcagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccgcttccaggaggaccaggtgtgcacctag

SEQ ID NO: 147930 - DNA, 483 bp, Artificial Sequence
  Description of Artificial Sequence: Synthetic coding sequence
atgctgcctgctgtgggcagcgcagatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccccggcatcatcaccatcgtggacagcaaatatggcctgaaggtgaagtaccactag

SEQ ID NO: 147931 - DNA, 441 bp, Artificial Sequence
  Description of Artificial Sequence: Synthetic coding sequence
atgtacttcaagagagctgcccgggccttccctgtgctgctgactggagctgggaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacagcggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaaggccaagaactggaccacctag

SEQ ID NO: 147932 - DNA, 1188 bp, Artificial Sequence
  Description of Artificial Sequence: Synthetic coding sequence
atgctgcctgctgtgggcagcgcagatgaggaggaggaccctgctgaggaggactgcccagagctggtgcccatggagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctggccgaggagaagccagatggcctcatcaatgaggccacccggcaggtggccctggctgatgccatcctgatcaacaagacagacctggtgcctgaagaagatgtgaagaagctgcgggccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccacttcaaggaggaccaggtgtgcacctag

SEQ ID NO: 147933 - DNA, 543 bp, Artificial Sequence
  Description of Artificial Sequence: Synthetic coding sequence
atgctgcctgctgtgggcagcgcagatgaggaggaggaccctgctgaggaggactgcccagagctggtgcccatggagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaaggtgaagtaccactag

SEQ ID NO: 147934 - DNA, 1131 bp, Artificial Sequence
  Description of Artificial Sequence: Synthetic coding sequence
atgctgcctgctgtgggcagcgcagatgaggaggaggaccctgctgaggaggactgcccagagctggtgcccatggagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctggccgaggagaagccagatggcctcatcaatgaggccacccggcaggtggccctggctgatgccatcctgatcaacaagacagacctggtgcctgaagaagatgtgaagaagctgcgggccaccatccgcagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccacttcaaggaggaccaggtgtgcacctag

SEQ ID NO: 147935 - DNA, 1080 bp, Artificial Sequence
  Description of Artificial Sequence: Synthetic coding sequence
atgtacttcaagagagctgcccgggccttccctgtgctgctgactggagctgggaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgactacatcctgctggagaccaccggcctggccgaccctggagctgtggcctccatgttctgggtggatgctgagctgggcagtgacatctacctggatggcatcatcaccatcgtggacagcaaatatggcctgaagcacctggccgaggagaagccagatggcctcatcaatgaggccacccggcaggtggccctggctgatgccatcctgatcaacaagacagacctggtgcctgaagaagatgtgaagaagctgcgggccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgctgggcaggaacctggacaaggacatcctgaagcagctgttcatcgccaccgtgacagaaacagagaagcagtggaccacccacttcaaggaggaccaggtgtgcacctag

SEQ ID NO: 147936 - DNA, 483 bp, Artificial Sequence
  Description of Artificial Sequence: Synthetic coding sequence
atgctgcctgctgtgggcagcgcagatgaggaggaggaccctgctgaggaggactgcccagagctggtgcccatggagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaatttggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgactacatcctgctggagaccaccggcctggccgaccccggcatcatcaccatcgtggacagcaaatatggcctgaaggtgaagtaccactag

SEQ ID NO: 147937 - DNA, 1188 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147938 - DNA, 258 bp, Artificial Sequence
  Description of Artificial Sequence: Synthetic coding sequence
atggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147939 - DNA, 258 bp, Artificial Sequence; identical to SEQ ID NO: 147938
  Description of Artificial Sequence: Synthetic coding sequence

SEQ ID NO: 147940 - DNA, 132 bp, Artificial Sequence
  Description of Artificial Sequence: Synthetic coding sequence
atgttcatccagaacctgctgtgggagaagaatgtgaggaacaaggacaaccactgcatggaggtgatccggctgaaggtgcagttcaccgtggccgacttctggaccaagagcttctcctggctgctgtag

SEQ ID NO: 147941 - DNA, 1128 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccccggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147942 - DNA, 1080 bp, Artificial Sequence
  Description of Artificial Sequence: Synthetic coding sequence
atgtacttcaagagggccccccgggccttccctgtgctgctgactggagctgggaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagccgggtggacctgagcaatgtgctggacctgcacgcctttgacagcctgagcggcatcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147943 - DNA, 234 bp, Artificial Sequence
  Description of Artificial Sequence: Synthetic coding sequence
atgtacttcaagagggccccccgggccttccctgtgctgctgactggagctgggaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaagtag

SEQ ID NO: 147944 - DNA, 1131 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccacccggcaggtggccctggccgacatcatcctgatcaacaagacagacctggtgcctgaagaagatgtgaagaagctgcggaccaccatccgcagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147945 - DNA, 225 bp, Artificial Sequence
  Description of Artificial Sequence: Synthetic coding sequence
atgtacttcaagagggccccccgggccttccctgtgctgctgactggagctgggaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgctag

SEQ ID NO: 147946 - DNA, 543 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaaggtgaagtaccactag

SEQ ID NO: 147947 - DNA, 1044 bp, Artificial Sequence
  Description of Artificial Sequence: Synthetic coding sequence
atgctgcctgctgtgggctctgtggatgaggaggaggaccctgctgaggaggactgcccagagctggtgcccatcgagaccacccagagcgaggaggaggagaagagcggcctgggcgccaagatccctgtgaccatcatcaccggctacctgggcgccggcaagaccaccctgctgaactacatcctgacagagcagcacagcaagagggtggccgtcatcctgaatgaaagtggagagggcagcgccctggagaagagcctggccgtgtcccagggcggggagctgtatgaggagtggctggagctgagaaatggctgcctgtgctgcagcgtgaaggacaatggcctgcgggccatcgagaacctgatgcagaagaagggcaagtttgatgacatcctgctggagaccaccggcctggccgaccctggagctgtggcctccatgttctgggtggatgctgagctgggcagtgacatctacctggatggcatcatcaccatcgtggacagcaaatatggcctgaagcacctgacagaggagaagccagatggcctcatcaatgaggccaccaggagcatcaatggcctgggccagatcctggagacccagaggagcagcctgcagaagaagctgcagcacgtgcccggcacccagccccacctggaccagagcatcgtgaccatcacctttgaggtgcctggaaatgccaaggaggagcacctgaacatgttcatccagaacctgctgtgggagaagaatgtgaggaacaaggacaaccactgcatggaggtgatccggctgaagggcctggtgtccatcaaggacaagagccagcaggtgattgtgcagggcgtgcatgagctgtatgacctggaggagacccctgtgtcctggaaggatgacacagagaggaccaaccggctggtgctgattggaagaaacctggacaaggacatcctgaagcagctgttcatcgccaccgtgacagaaacagagaagcagtggaccacccacttcaaggaggaccaggtgtgcacctag

SEQ ID NO: 147948 - DNA, 987 bp, Artificial Sequence
  Description of Artificial Sequence: Synthetic coding sequence
atgctgggcagcagagctgctggctttgcccggggcctgcgggctgtggccctggcctggctgcccggctggaggggccgcagctttgccctggcccgggctgctggggcccctcatggaggagacctgcagcccccagcctgcccagagccccggggccggcagctgagcctgtctgctgctgctgtggtggacagcgccccccggcccctgcagccctacctgcggctgatgaggctggacaagcccatcggcacctggctgctgtacctgccctgcacctggagcatcggcctggccgctgagcccggctgcttcccagactggtacatgctgagcctgtttggaactggagccatcctgatgagaggagctggctgcaccatcaatgacatgtgggaccaggactatgacaagaaggtgaccaggacagccaaccggcccatcgctgctggggacatcagcaccttccagagctttgtgttcctgggcggccagctgaccctggccctgggcgtgctgctgtgcctgaactactacagcatcgccctgggcgccggcagcctgctgctggtgatcacctaccccctgatgaagaggatctcctactggccccagctggccctgggcctgaccttcaactggggcgccctgctgggctggagcgccatcaagggcagctgtgaccccagcgtgtgcctgcccctgtacttctctggagtgatgtggaccctcatctatgacaccatctatgcccaccaggacaagagagatgatgtgctgattggcctgaagagcacagccctgcgctttggagagaacaccaagccctggctgagcggcttctctgtggccatgctgggcgccctgagcctggtgggcgtgaacagcggccagacagccccctactatgctgccctgggcgctgtgggcgcccacctgacccaccagaagtggggcctggagatcctgccccggctggtgtag

SEQ ID NO: 147949 - DNA, 1266 bp, Artificial Sequence
  Description of Artificial Sequence: Synthetic coding sequence
atgacccccatcagccaggtgaggatgaggaaaggaagtgcccacacagctgcccagcccggccgcctgggcctgcaccctgctggggccacagcccacgcctgccggggcatgaccagcatccgggcccggcccggcctgaccagcgccatgctgggcagcagagctgctggctttgcccggggcctgcgggctgtggccctggcctggctgcccggctggaggggccgcagctttgccctggcccgggctgctggggcccctcatggaggagacctgcagcccccagcctgcccagagccccggggccggcagctgagcctgtctgctgctgctgtggtggacagcgccccccggcccctgcagccctacctgcggctgatgaggctggacaagcccatcggcacctggctgctgtacctgccctgcacctggagcatcggcctggccgctgagcccggctgcttcccagactggtacatgctgagcctgtttggaactggagccatcctgatgagaggagctggctgcaccatcaatgacatgtgggaccaggactatgacaagaaggtgaccaggacagccaaccggcccatcgctgctggggacatcagcaccttccagagctttgtgttcctgggcggccagctgaccctggccctgggcgtgctgctgtgcctgaactactacagcatcgccctgggcgccggcagcctgctgctggtgatcacctaccccctgatgaagaggatctcctactggccccagctggccctgggcctgaccttcaactggggcgccctgctgggctggagcgccatcaagggcagctgtgaccccagcgtgtgcctgcccctgtacttctctggagtgatgtggaccctcatctatgacaccatctatgcccaccaggacaagagagatgatgtgctgattggcctgaagagcacagccctgcgctttggagagaacaccaagccctggctgagcggcttctctgtggccatgctgggcgccctgagcctggtgggcgtgaacagcggccagacagccccctactatgctgccctgggcgctgtgggcgcccacctgacccaccagatctacaccctggacatccacaggcctgaggactgctggaacaagttcatcagcaacagaaccctgggcctcatcgtgttcctgggcatcgtgctgggcaacctgtggaaggagaagaagacagacaagaccaagaagggcatcgagaacaagattgagaactag

SEQ ID NO: 147950 - DNA, 1155 bp, Artificial Sequence
  Description of Artificial Sequence: Synthetic coding sequence
atgaccagcatccgggcccggcccggcctgaccagcgccatgctgggcagcagagctgctggctttgcccggggcctgcgggctgtggccctggcctggctgcccggctggaggggccgcagctttgccctggcccgggccgccggggccccccacggcggggacctgcagcccccagcctgcccagagccccggggccggcagctgagcctgtctgctgctgctgtggtggacagcgccccccggcccctgcagccctacctgcggctgatgaggctggacaagcccatcggcacctggctgctgtacctgccctgcacctggagcatcggcctggccgctgagcccggctgcttcccagactggtacatgctgagcctgtttggcaccggggccatcctgatgagaggagctggctgcaccatcaatgacatgtgggaccaggactatgacaagaaggtgaccaggacagccaaccggcccatcgccgccggggacatcagcaccttccagagctttgtgttcctgggcggccagctgaccctggccctgggcgtgctgctgtgcctgaactactacagcatcgccctgggcgccggcagcctgctgctggtgatcacctaccccctgatgaagaggatctcctactggccccagctggccctgggcctgaccttcaactggggcgccctgctgggctggagcgccatcaagggcagctgtgaccccagcgtgtgcctgcccctgtacttcagcggcgtgatgtggaccctcatctatgacaccatctatgcccaccaggacaagagagatgatgtgctgattggcctgaagagcacagccctgcgctttggagagaacaccaagccctggctgagcggcttctctgtggccatgctgggcgccctgagcctggtgggcgtgaacagcggccagacagccccctactatgctgccctgggcgctgtgggcgcccacctgacccaccagatctacaccctggacatccacaggcctgaggactgctggaacaagttcatcagcaacagaaccctgggcctgattgtgttcctgggcatcgtgctgggcaacctgtggaaggagaagaagacagacaagaccaagaagggcatcgagaacaagattgaaaattag

SEQ ID NO: 147951 - DNA, 798 bp, Artificial Sequence
  Description of Artificial Sequence: Synthetic coding sequence
atggccaccctgctgcggcctgtgctgcggcggctgtgtggcctgcccggcctgcagaggcctgctgctgagatgcccctgcgggcccggagtgatggagctggccccctgtacagccaccacctgcccaccagccccctgcagaagggcctgctggccgccggcagcgctgccatggccctgtacaacccctacagacatgacatggtggccgtgctgggggagaccaccggccacaggaccctgaaggtgctgcgggaccagatgaggcgggaccctgagggcgcccagatcctgcaggagcggccccgcatcagcaccagcaccctggacctgggcaagctgcagagcctgcctgagggcagcctgggccgggagtacctgcgcttcctggatgtgaacagagtgtccccagacacccgggcccccaccaggtttgtggatgatgaggagctggcctacgtgatccagcgctaccgggaggtgcatgacatgctgcacaccctgctgggcatgcccaccaacatcctgggggagatcgtggtgaagtggtttgaagctgtgcagacaggcctgcccatgtgcatcctgggcgccttcttcggccccatccggctgggcgcccagagcctgcaggtgctggtgtctgagctgatcccctgggccgtgcagaatggaagaagagccccctgtgtgctgaacctgtactatgaaagacgctgggagcagagcctgcgggccctgcgggaggagctgggcatcacagccccacccatgcacgtgcagggcctggcctag

SEQ ID NO: 147952 - DNA, 456 bp, Artificial Sequence
  Description of Artificial Sequence: Synthetic coding sequence
atggccaccctgctgcggcctgtgctgcggcggctgtgtggcctgcccggcctgcagaggcctgctgctgagatgcccctgcgggcccggagtgatggagctggccccctgtacagccaccacctgcccaccagccccctgcagaagggcctgctggccgccggcagcgctgccatggccctgtacaacccctacagacatgacatggtggccgtgctgggggagaccaccggccacaggaccctgaaggtgctgcgggaccagatgaggcgggaccctgagggcgcccagatcctgcaggagcggccccgcatcagcaccagcaccctggacctgggcaagctgcagagcctgcctgagggcagcctgggccgggagtacctgcgcttcctggatgtgaatgtgtccttccagctgctgtgcatctggcagagcccagacagaacagaggagtag

SEQ ID NO: 147953 - DNA, 654 bp, Artificial Sequence
  Description of Artificial Sequence: Synthetic coding sequence
atgagctgtgccggggctgctgctgccccccggctgtggaggctgcggcctggggcccggcgcagcctgagcgcctacggccgccgcacctctgtgcgcttccgcagcagcggcatgaccctggacaacatcagcagagctgctgtggaccgcatcatccgggtggaccacgccggggagtatggagccaaccgcatctatgccggccagatggctgtgctgggccgcacctctgtgggccctgtgatccagaagatgtgggaccaggagaaggaccacctgaagaagttcaatgagctgatggtgaccttccgggtgcggcccaccgtgctgatgcccctgtggaatgtgctgggctttgccctgggcgccggcacagccctgctgggcaaggagggcgccatggcctgcaccgtggccgtggaggagagcatcgcccaccactacaacaaccagatccgcaccctgatggaggaggaccctgagaagtatgaggagctgctgcagctgatcaagaagttcagagatgaggagctggagcaccacgacatcggcctggaccatgatgctgagctggccccagcctatgctgtgctgaagagcatcatccaggccggctgccgggtggccatctacctgtctgagcggctgtag

SEQ ID NO: 147954 - DNA, 540 bp, Artificial Sequence
  Description of Artificial Sequence: Synthetic coding sequence
atgaccctggacaacatcagcagagctgctgtggaccgcatcatccgggtggaccacgccggggagtatggagccaaccgcatctatgccggccagatggctgtgctgggccgcacctctgtgggccctgtgatccagaagatgtgggaccaggagaaggaccacctgaagaagttcaatgagctgatggtgaccttccgggtgcggcccaccgtgctgatgcccctgtggaatgtgctgggctttgccctgggcgccggcacagccctgctgggcaaggagggcgccatggcctgcaccgtggccgtggaggagagcatcgcccaccactacaacaaccagatccgcaccctgatggaggaggaccctgagaagtatgaggagctgctgcagctgatcaagaagttcagagatgaggagctggagcaccacgacatcggcctggaccatgatgctgagctggccccagcctatgctgtgctgaagagcatcatccaggccggctgccgggtggccatctacctgtctgagcggctgtag

SEQ ID NO: 147955 - DNA, 957 bp, Artificial Sequence
  Description of Artificial Sequence: Synthetic coding sequence
atggctgctgctgctgtgtctggggccctgggccgggccggctggaggctgctgcagctgcgctgcctgcctgtggcccgctgccggcaggccctggtgccccgggccttccacgccagcgctgtgggcctgcggagcagtgatgagcagaagcagcagccccccaacagcttcagccagcagcacagcgagacccagggcgctgagaagccagaccctgagagcagccacagccccccacgctacacagaccagggcggggaggaggaggaggactatgaaagtgaggagcagctgcagcaccgcatcctgacagctgccctggagtttgtgcctgcccacggctggacagctgaggccatcgccgagggcgcccagagcctgggcctgagcagcgctgctgcctccatgtttgggaaggatggcagcgagctgatcctgcactttgtgacccagtgcaacacccggctgaccagggtgctggaggaggagcagaagctggtgcagctgggccaggccgagaagaggaagacagaccagttcctgagagatgctgtggagacccggctgaggatgctgatcccctacatcgagcactggccccgggccctgagcatcctgatgctgccccacaacatccccagcagcctgagcctgctgacctccatggtggatgacatgtggcactacgccggggaccagagcacagacttcaactggtacacccggcgggccatgctggccgccatctacaacaccacagagctggtgatgatgcaggacagcagcccagactttgaggacacctggaggttcctggagaacagagtgaatgatgccatgaacatgggccacacagccaagcaggtgaagagcactggagaggccctggtgcagggcctgatgggcgctgctgtgaccctgaagaacctgaccggcctgaaccagaggaggtag

SEQ ID NO: 147956 - DNA, 1743 bp, Artificial Sequence
  Description of Artificial Sequence: Synthetic coding sequence
atgtttgctggcctgcaggacctgggcgtggccaacggggaggacctgaaggagaccctgaccaactgcacagagcccctgaaggccatcgagcagttccagacagaaaatggagtgctgctgcccagcctgcagagcgccctgcccttcctggacctgcacggcaccccccggctggagttccaccagagcgtgtttgatgagctgcgggacaagctgctggagcgggtgtctgccatcgccagcgagggcaaggccgaggagcgctacaagaagctggaggacctgctggagaagagcttcagcctggtgaagatgcccagcctgcagcctgtggtgatgtgtgtgatgaagcacctgcccaaggtgcctgagaagaagctgaagctggtgatggctgacaaggagctgtaccgggcctgtgctgtggaggtgaagaggcagatctggcaggacaaccaggccctgtttggagatgaggtgagccccctgctgaagcagtacatcctggagaaggagagcgccctcttcagcacagagctgtctgtgctgcacaacttcttcagccccagccccaagacccggcggcagggcgaggtggtgcagaggctgaccaggatggtgggcaagaatgtgaagctgtatgacatggtgctgcagttcctgcggaccctcttcctgcggaccagaaatgtgcactactgcaccctgcgggcagagctgctgatgagcctgcatgacctggatgtgggggagatctgcaccgtggacccctgccacaagttcacctggtgcctggatgcctgcatccgggagagatttgtggacagcaagagggcccgggagctgcagggcttcctggatggagtgaagaagggccaggagcaggtgctgggggacctgtccatgatcctgtgtgacccctttgccatcaacaccctggccctgagcacagtgcgccacctgcaggagctggtgggccaggagaccctgccccgggacagcccagacctgctgctgctgctgcggctgctggccctgggccagggcgcctgggacatgattgacagccaggtgttcaaggagcccaagatggaggtggagctgatcacccgcttcctgcccatgctgatgtccttcctggtggatgactacaccttcaacgtggaccagaagctgcctgctgaggagaaggcccctgtgtcctaccccaacaccctgcctgagagcttcaccaagttcctgcaggagcagaggatggcctgtgaggtgggcctgtactacgtgctgcacatcaccaagcagaggaacaagaatgccctgctgcggctgctgcccggcctggtggagaccttcggggacctggcctttggagacatcttcctgcacctgctgaccggcaacctggccctgctggctgatgaatttgccctggaggacttctgcagcagcctgtttgatggcttcttcctgacagccagccccaggaaagaaaatgtgcacagacatgccctgcggctgctgatccacctgcacccccgggtggcccccagcaagctggaggccctgcagaaggccctggagcccaccggccagagcggggaggccgtgaaggagctgtacagccagctgggggagaagctggagcagctggaccacaggaagcccagccctgcccaggccgctgagaccccagccctggagctgcccctgcccagcgtgcctgccccagcccccctgtag

SEQ ID NO: 147957 - DNA, 501 bp, Artificial Sequence
  Description of Artificial Sequence: Synthetic coding sequence
atggccagcggcgtgacagtgaatgatgaagtcatcaaggtgttcaatgacatgaaggtgaggaagagcagcacccaggaggagatcaagaagaggaagaaggctgtgctcttctgcctgagtgatgacaagaggcagatcatcgtggaggaggccaagcagatcctggtgggggacatcggggacacagtggaggacccctacaccagctttgtgaagctgctgcccctgaatgactgccgctatgccctgtatgatgccacctatgagaccaaggagagcaagaaggaggacctggtgttcatcttctgggcccctgagagcgcccccctgaagagcaagatgatctatgccagcagcaaggatgccatcaagaagaagttcaccggcatcaagcatgagtggcaggtgaatggcctggatgacatcaaggacaggagcaccctgggggagaagctgggcggcaatgtggtggtgtccctggagggcaagcccctgtag

SEQ ID NO: 147958 - DNA, 501 bp, Artificial Sequence; identical to SEQ ID NO: 147957
  Description of Artificial Sequence: Synthetic coding sequence

SEQ ID NO: 147959 - DNA, 1722 bp, Artificial Sequence
  Description of Artificial Sequence: Synthetic coding sequence
atgagaagatatgaccggggcctgaagaccctggagaacctgctggccagcatcagaaaaggaaatgccattgatgaagctgacatccccccacctgtggccatcggcaaaggacctgccagcacccccacctacagccctgcccccacccagcctgccccccgcatcgccagcgcccctgagccccgggtgaccctggagggccccagcgccacagccccagccagcagccctggcctggccaagccccagatgcctcctggcccctgcagccctggccccctggcccagctgcagagccggcagagggactacaagctggccgccctgcacgccaagcagcagcagctggccttcctggagggcaggaagaagcagctgctgcaggccgccctgcgggccaagcagaagaatgatgtggagggcgccaagatgcacctgcggcaggccaagggcctggagcccatgctggaggccagcagaaatggcctgcctgtggacatcaccaaggtgcccccagcccctgtgaacaaggatgactttgccctggtgcagaggcctggccctggcctgagccaggaggccgccaggagatatggagagctgaccaagctgatccggcagcagcacgagatgtgcctgaaccacagcaaccagttcacccagctgggcaacatcacagagaccaccaagtttgagaagctggccgaggactgcaagaggtccatggacatcctgaagcaggcctttgtgcggggcctgcccacccccacagccaggtttgagcagaggaccttcagcgtcatcaagatcttcccagacctgagcagcaatgacatgctgctcttcatcgtgaagggcatcaacctgcccaccccacctggcctgagccctggggacctggatgtgtttgtgcgctttgacttcccctacccaaatgtggaggaggcccagaaggacaagaccagcgtcatcaagaacacagacagccctgagttcaaggagcagttcaagctgtgcatcaacagaagccaccggggcttcagaagagccatccagaccaagggcatcaagtttgaggtggtgcacaagggcggcctcttcaagacagacagagtgctgggcacagcccagctgaagctggatgccctggagatcgcctgtgaggtgcgggagatcctggaggtgctggatggccggcggcccactggaggccgcctggaggtgatggtgcgcatccgggagcccctgacagcccagcagctggagaccaccacagagcgctggctggtgattgatcctgtgcctgctgctgtgcccaccgtggccggccccaagggcaaggcccctcctgtgcctgccccagcccgggagagcggcaacagaagtgcccggcccctgcacagcctgtctgtgctggcctttgaccaggagcggctggagaggaagatcctggccctgcggcaggcccggcggcctgtgcccccagaggtggcccagcagtaccaggacatcatgcagaggagccagtggcagagggcccagctggagcagggcggcgtgggcatccggcgggagtatgctgcccagctggagcggcagctgcagttctacacagaagctgcccggcggctgggcaatgatggcagcagagatgctgccaaggaggccctgtacagaagaaacctggtggagagcgagctgcagaggctgcggaggtag

SEQ ID NO: 147960 - DNA, 2856 bp, Artificial Sequence
  Description of Artificial Sequence: Synthetic coding sequence
atgcacaagaggaaaggacctcctggccccccaggaagaggagctgctgctgcccggcagctgggcctgctggtggacctgagcccagatggcctgatgatcccagaagatggagccaatgatgaggagctggaggccgagttcctggccctggtgggcggccagcccccagccctggagaagctgaagggcaagggccccctgcccatggaggccatcgagaagatggccagcctgtgcatgagggaccctgatgaagatgaggaggagggcacagatgaagatgacctggaggctgatgatgacctgctggccgagctgaatgaggtgctgggggaggagcagaaggccagcgagaccccacctcctgtggcccagcccaagccagaggccccccaccctggcctggagaccaccctgcaggagcggctggccctgtaccagacagccattgaaagtgcccggcaggccggggacagcgccaagatgagaagatatgaccggggcctgaagaccctggagaacctgctggccagcatcagaaaaggaaatgccattgatgaagctgacatccccccacctgtggccatcggcaaaggacctgccagcacccccacctacagccctgcccccacccagcctgccccccgcatcgccagcgcccctgagccccgggtgaccctggagggccccagcgccacagccccagccagcagccctggcctggccaagccccagatgcctcctggcccctgcagccctggccccctggcccagctgcagagccggcagagggactacaagctggccgccctgcacgccaagcagcagggcgacaccacagctgctgcccggcacttccgggtggccaagagctttgatgctgtgctggaggccctgagcagaggagagcctgtggacctgagctgcctgcccccacctccagaccagctgcccccagacccccccagcccccccagccagccccccaccccagccacagcccccagcaccacagaggtgcccccaccacccaggaccctgctggaggccctggagcagaggatggagcgctaccaggtggccgccgcccaggccaagagcaaaggagaccagaggaaggccaggatgcatgaaagaattgtgaagcagtaccaggatgccatccgggcccacaaggccggccgggctgtggatgtggccgagctgcctgtgcccccaggcttcccccccatccagggcctggaggccaccaagcccacccagcagagcctggtgggcgtgctggagacagccatgaagctggccaaccaggatgagggcccagaagatgaggaggatgaggtgcccaagaagcagaacagccctgtggcccccacagcccagcccaaggccccacccagcaggaccccccagagcggcagcgcccccacagccaaggccccacccaaggccaccagcacccgggcccagcagcagctggccttcctggagggcaggaagaagcagctgctgcaggccgccctgcgggccaagcagaagaatgatgtggagggcgccaagatgcacctgcggcaggccaagggcctggagcccatgctggaggccagcagaaatggcctgcctgtggacatcaccaaggtgcccccagcccctgtgaacaaggatgactttgccctggtgcagaggcctggccctggcctgagccaggaggccgcccggcgctacggggagctgaccaagctgatccggcagcagcacgagatgtgcctgaaccacagcaaccagttcacccagctgggcaacatcacagagaccaccaagtttgagaagctggccgaggactgcaagaggtccatggacatcctgaagcaggcctttgtgcggggcctgcccacccccacagccaggtttgagcagaggaccttcagcgtcatcaagatcttcccagacctgagcagcaatgacatgctgctcttcatcgtgaagggcatcaacctgcccaccccacctggcctgagccctggggacctggatgtgtttgtgcgctttgacttcccctaccccaacgtggaggaggcccagaaggacaagaccagcgtcatcaagaacacagacagccctgagttcaaggagcagttcaagctgtgcatcaacagaagccaccggggcttccggcgggccatccagaccaagggcatcaagtttgaggtggtgcacaagggcggcctcttcaagacagacagagtgctgggcacagcccagctgaagctggatgccctggagatcgcctgtgaggtgcgggagatcctggaggtgctggatggaagaagacccaccggcggccgcctggaggtgatggtgcgcatccgggagcccctgacagcccagcagctggagaccaccacagagcgctggctggtgattgatcctgtgcctgctgctgtgcccacccaggtggccggccccaagggcaaggcccctcctgtgcctgccccagcccgggagagcggcaacagaagtgcccggcccctgcacagcctgtctgtgctggcctttgaccaggagcggctggagaggaagatcctggccctgcggcaggcccggcggcctgtgcccccagaggtggcccagcagtaccaggacatcatgcagaggagccagtggcagagggcccagctggagcagggcggcgtgggcatccggcgggagtatgctgcccagctggagcggcagctgcagttctacacagaagctgcccggcggctgggcaatgatggcagcagagatgctgccaaggaggccctgtacagaagaaacctggtggagagcgagctgcagaggctgcggaggtag

SEQ ID NO: 147961 - DNA, 711 bp, Artificial Sequence
  Description of Artificial Sequence: Synthetic coding sequence
tggcacagcccagatggcctgatgatcccagaagatggagccaatgatgaggagctggaggccgagttcctggccctggtgggcggccagcccccagccctggagaagctgaagggcaagggccccctgcccatggaggccatcgagaagatggccagcctgtgcatgagggaccctgatgaagatgaggaggagggcacagatgaagatgacctggaggctgatgatgacctgctggccgagctgaatgaggtgctgggggaggagcagaaggccagcgagaccccacctcctgtggcccagcccaagccagaggccccccaccctggcctggagaccaccctgcaggagcggctggccctgtaccagacagccatcgagagcgcccggcaggccggggacagcgccaagatgagaagatatgaccggggcctgaagaccctggagaacctgctggccagcatcagaaaaggaaatgccattgatgaggccgacatccccccacctgtggccatcggcaagggccctgccagcacccccacctacagccctgcccccacccagcctgcccccagaattgccagcgcccctgagccccgggtgaccctggagggccccagcgccacagccccagccagcagccctggcctggccaagccccagatgcctcctggcccctgcagccctggccccctggcccagctgcagtag

SEQ ID NO: 147962 - DNA, 1116 bp, Artificial Sequence
  Description of Artificial Sequence: Synthetic coding sequence
atgcctcctggcccctgcagccctggccccctggcccagctgcagagccggcagagggactacaagctggccgccctgcacgccaagcagcagggcgacaccacagctgctgcccggcacttccgggtggccaagagctttgatgctgtgctggaggccctgagcagaggagagcctgtggacctgagctgcctgcccccacctccagaccagctgcccccagacccccccagcccccccagccagccccccaccccagccacagcccccagcaccacagaggtgcccccaccacccaggaccctgctggaggccctggagcagaggatggagcgctaccaggtggccgccgcccaggccaagagcaaaggagaccagaggaaggccaggatgcatgaaagaattgtgaagcagtaccaggatgccatccgggcccacaaggccggccgggctgtggatgtggccgagctgcctgtgcccccaggcttcccccccatccagggcctggaggccaccaagcccacccagcagagcctggtgggcgtgctggagacagccatgaagctggccaaccaggatgagggcccagaagatgaggaggatgaggtgcccaagaagcagaacagccctgtggcccccacagcccagcccaaggccccacccagcaggaccccccagagcggcagcgcccccacagccaaggccccacccaaggccaccagcacccgggcccagcagcagctggccttcctggagggcaggaagaagcagctgctgcaggccgccctgcgggccaagcagaagaatgatgtggagggcgccaagatgcacctgcggcaggccaagggcctggagcccatgctggaggccagcagaaatggcctgcctgtggacatcaccaaggtgcccccagcccctgtgaacaaggatgactttgccctggtgcagaggcctggccctggcctgagccaggaggccgcccggcgctacggggagctgaccaagctgatccggcagcagcacgagatgtgcctgaaccacagcaaccagttcacccagctgggcaacatcacagagaccaccaaggccaacatggtgaagccctgcttctactag

SEQ ID NO: 147963 - DNA, 4539 bp, Artificial Sequence
  Description of Artificial Sequence: Synthetic coding sequence
atggtgtctgagaagagccacctgggcaacccccaggagcctgtgcaggaggagcccaagacccggctgctgtccatgacagtgagaagaggccccaggagcctgccccccatccccagcaccagcaggacaggctttgctgagttctccatgaggggccgcatgagggagaagctgcaggccgcccggagcaaggccgagagcgccctgctgcaggagatccccaccccccggccccggcggctgcggagccccagcaagaaggagctggagacagaatttggaacagagcccgggaaggaggtggagaggacccagcaggaggtggacagccagagctacagccgggtgaagttccatgacagcgccaggaagatcaagcccaagccccaggtgcccccaggcttccccagcgctgaggaggcctacaacttcttcaccttcaactttgatcctgagcctgagggcagcgaggagaagcccaaggcccggcacagagctggcaccaaccaggaggaggaggagggggaggaggaggagcccccagcccagggcggcggcaaggagatggatgaggaggagctgctgaatggagatgatgctgaggacttcctgctgggcctggaccacgtggctgatgactttgtggccgtgcggcctgctgactatgagagcatccatgaccggctgcagatggagcgggagatgctgttcatccccagccggcagacagtgcccacctacaagaagctgcctgaaaatgtgcagccccgcttcctggaggatgagggcctgtacacaggagtgcggcctgaggtggcccggaccaaccagaacatcatggagaaccggctgctgatgcaggaccctgagcggcgctggtttggagatgatggccgcatcctggccctgcccaaccccatcaagcccttccccagcaggcctcctgtgctgacccaggagcagagcatcaaggccgagctggagaccctgtacaagaaggctgtgaagtatgtgcacagcagccagcacgtgatccgcagcggggaccccccaggcaacttccagctggacatcgacatcagcggcctcatcttcacccaccacccctgcttcagccgggagcacgtgctggccgccaagctggcccagctgtatgaccagtacctggcccggcaccagaggaacaaggccaagttcctgacagacaagctgcaggccctgagaaatgctgtgcagacaggcctggaccctgagaagccccaccagagcctggacaccatccagaagaccatcaatgagtacaagtctgagatccggcagaccaggaagttcagagatgctgagcaggagaaggacaggaccctgctgaagaccatcatcaaggtgtggaaggagatgaagagcctgcgggagttccagcgcttcaccaacacccccctgaagctggtgctgaggaaggagaaggctgaccagaaggcagatgaggaggcctatgaagctgagatccaggccgagatcagcgagctgctggaggagcacacagaggagtatgcccagaagatggaggagtaccgcaccagcctgcagcagtggaaggcctggaggaaggtgcagagggccaagaagaagaagaggaagcaggccgctgaggagcaccctggagatgaaattgctgagccctacccagaggaggacctggtgaagcccagccccccagagcccacagacagagctgtgattgagcaggaggtgcgggagagagctgcccagagcagaagaagaccctgggagcccaccctggtgcctgagctgagcctggccggctctgtgaccccaaatgaccagtgccccagggctgaggtgtcccggcgggaggatgtgaagaagaggtctgtgtacctgaaggtgctcttcaacaacaaggaggtgtccaggacagtgtcccggcccctgggcgctgacttccgggtgcacttcggccagatcttcaacctgcagatcgtgaactggccagagagcctgaccctgcaggtgtatgagaccgtgggccacagcagccccaccctgctggccgaggtgttcctgcccatccctgagaccaccgtggtgacaggccgggcccccacagaggaggtggagttcagcagcaaccagcacgtgaccctggaccatgaaggagtgggcagcggcgtgcccttctcctttgaagcagatggcagcaaccagctgaccctgatgaccagcggcaaggtgagccacagcgtggcctgggccatcggggagaatggcatccccctcatcccccccctgagccagcagaacatcggcttccgcagcgccctgaagaaggcagatgccatcagcagcatcggcaccagcggcctgacagacatgaagaagctggccaagtgggccgctgagagcaagctggaccccaatgaccccaacaatgcccccctgatgcagctgatctctgtggccaccagcggggagagctatgtgcctgacttcttccggctggagcagctgcagcaggagttcaactttgtgtctgaccaggagctgaacagaagcaagcgcttccggctgctgcacctgcggagccaggaggtgcctgagttcaggaactacaagcaggtgcctgtgtatgaccgggagatcatggagaaggtgttccaggactatgagaagaggctgcgggacagaaatgtcatcgagaccaaggagcacatcgacacccaccgggccatcgtggccaagtacctgcagcaggtgcgggagagcgtcatcaaccgcttcctgattgccaagcagtacttcctgctggccgacatgattgtggaggaggaggtgcccaacatcagcatcctgggcctgagcctcttcaagctggccgagcagaagaggcccctgcggcccaggaggaaaggaaggaagaaggtgacagcccagaacctgagtgatggagacatcaagctgctggtgaacatcgtgcgggcctatgacatccctgtgaggaagccagctgtgtccaagttccagcagcccagccgcagcagcaggatgttttctgagaagcatgctgccagccccagcacctacagccccacccacaatgctgactaccccctgggccaggtgctggtgcggccctttgtggaggtgtccttccagaggacagtgtgccacaccaccacagctgagggccccaaccccagctggaatgaggagctggagctgcccttccgggccccaaatggagactacagcacagccagcctgcagagcgtgaaggatgtggtgttcatcaacatctttgatgaggtgctgcatgatgtgctggaggatgaccgggagcggggcagcggcatccacaccagaattgagcggcactggctgggctgtgtgaagatgcccttcagcaccatctacttccaggccaggtttgagagccaggaggatgagaagctgctgcaggccacagagaagttccaggccgagtgtgccctgaagttccccaaccggcagtgcctgaccaccgtgattgacatcagcggcaagacagtgttcatcacccgctacctgaagcccctgaaccccccccaggagctgctgaatgtgtaccccaacaacctgcaggccacagctgagctggtggcccgctacgtgtccctcatccccttcctgcctgacacagtgtcctttggaggcatctgtgacctgtggagcaccagtgaccagttcctggacctgctggccggagatgaggaggagcacgctgtgctgctgtgcaactacttcctgagcctgggcaagaaggcctggctgctgatgggaaatgccatccctgagggccccacagcctacgtgctgacctgggagcagggccgctacctgatctggaacccctgcagcggccacttctacggccagtttgacaccttctgccccctgaagaatgtgggctgcctgattggccctgacaacatctggttcaacatccagagatatgagagccccctgcgcatcaactttgatgtgacccggcccaagctgtggaagagcttcttcagccgcagcctgccctacccaggcctgagctctgtgcagcctgaggagctgatctaccagaggagtgacaaggctgctgctgctgagctgcaggaccgcatcgagaagatcctgaaggagaagatcatggactggaggcccaggcacctgacccgctggaaccgctactgcaccagcaccctgcggcacttcctgcccctgctggagaagagccagggagaagatgtggaggatgaccacagagctgagctgctgaagcagctgggggactaccgcttcagcggcttccccctgcacatgccctacagcgaggtgaagcccctgattgatgctgtgtacagcactggagtgcacaacattgatgtgcccaacgtggagtttgccctggccgtgtacatccacccctaccccaagaatgtgctgtctgtgtggatctacgtggccagcctcatccggaacagatag

SEQ ID NO: 147964 - DNA, 4863 bp, Artificial Sequence
  Description of Artificial Sequence: Synthetic coding sequence
atgaacccccgggaggagaaggtgaagatcatcacagaggagttcattgaaaatgatgaagatgctgacatgggccggcagaacaagaacagcaaggtgcggcggcagcccaggaagaagcagcccccaacagctgtgcccaaggagatggtgtctgagaagagccacctgggcaacccccaggagcctgtgcaggaggagcccaagacccggctgctgtccatgacagtgcggcggggccccaggagcctgccccccatccccagcaccagcaggactggatttgctgagttctccatgaggggccgcatgagggagaagctgcaggccgcccggagcaaggccgagagcgccctgctgcaggagatccccaccccccggccccggcggctgcggagccccagcaagaaggagctggagacagaatttggaacagagcccgggaaggaggtggagaggacccagcaggaggtggacagccagagctacagccgggtgaagttccatgattctgccaggaagatcaagcccaagccccaggtgcccccaggcttccccagcgctgaggaggcctacaacttcttcaccttcaactttgatcctgagcctgagggcagcgaggagaagcccaaggcccggcaccgggccggcaccaaccaggaggaggaggagggggaggaggaggagcccccagcccagggcggcggcaaggagatggatgaggaggagctgctgaatggagatgatgctgaggacttcctgctgggcctggaccacgtggctgatgactttgtggccgtgcggcctgctgactatgagagcatccatgaccggctgcagatggagcgggagatgctgttcatccccagccggcagacagtgcccacctacaagaagctgcctgaaaatgtgcagccccgcttcctggaggatgagggcctgtacacaggagtgcggcctgaggtggcccggaccaaccagaacatcatggagaaccggctgctgatgcaggaccctgagcggcgctggtttggagatgatggccgcatcctggccctgcccaaccccatcaagcccttccccagccggccccctgtgctgacccaggagcagagcatcaaggccgagctggagaccctgtacaagaaggctgtgaagtatgtgcacagcagccagcacgtgatccgcagcggggaccccccaggcaacttccagctggacatcgacatcagcggcctcatcttcacccaccacccctgcttcagccgggagcacgtgctggccgccaagctggcccagctgtatgaccagtacctggcccggcaccagaggaacaaggccaagttcctgacagacaagctgcaggccctgagaaatgctgtgcagacaggcctggaccctgagaagccccaccagagcctggacaccatccagaagaccatcaatgagtacaagtctgagatccggcagaccaggaagttcagagatgctgagcaggagaaggacaggaccctgctgaagaccatcatcaaggtgtggaaggagatgaagagcctgcgggagttccagcgcttcaccaacacccccctgaagctggtgctgaggaaggagaaggctgaccagaaggcagatgaggaggcctatgaggccgagatccaggccgagatcagcgagctgctggaggagcacacagaggagtatgcccagaagatggaggagtaccgcaccagcctgcagcagtggaaggcctggaggaaggtgcagagggccaagaagaagaagaggaagcaggccgctgaggagcaccctggagatgaaattgctgagccctacccagaggaggacctggtgaagcccagccccccagagcccacagaccgggccgtcatcgagcaggaggtgcgggagcgggccgcccagagcagaagaagaccctgggagcccaccctggtgcctgagctgagcctggccggctctgtgaccccaaatgaccagtgccccagggctgaggtgtccagaagagaagatgtgaagaagaggtctgtgtacctgaaggtgctcttcaacaacaaggaggtgtccaggacagtgtcccggcccctgggcgctgacttccgggtgcacttcggccagatcttcaacctgcagatcgtgaactggccagagagcctgaccctgcaggtgtatgaaacagtgggccacagcagccccaccctgctggccgaggtgttcctgcccatccctgagaccaccgtggtgacaggccgggcccccacagaggaggtggagttcagcagcaaccagcacgtgaccctggaccacgagggcgtgggcagcggcgtgcccttctcctttgaagcagatggcagcaaccagctgaccctgatgaccagcggcaaggtgagccacagcgtggcctgggccatcggagaaaatggcatccccctcatcccccccctgagccagcagaacatcggcttccgcagcgccctgaagaaggcagatgccatcagcagcatcggcaccagcggcctgacagacatgaagaagctggccaagtgggccgctgagagcaagctggaccccaatgaccccaacaatgcccccctgatgcagctgatctctgtggccaccagcggggagagctatgtgcctgacttcttccggctggagcagctgcagcaggagttcaactttgtgtctgaccaggagctgaacagaagcaagcgcttccggctgctgcacctgcggagccaggaggtgcctgagttcaggaactacaagcaggtgcctgtgtatgaccgggagatcatggagaaggtgttccaggactatgagaagaggctgcgggacagaaatgtgattgagaccaaggagcacatcgacacccaccgggccatcgtggccaagtacctgcagcaggtgcgggagagcgtcatcaaccgcttcctgattgccaagcagtacttcctgctggccgacatgattgtggaggaggaggtgcccaacatcagcatcctgggcctgagcctcttcaagctggccgagcagaagaggcccctgcggcccaggaggaagggcaggaagaaggtgacagcccagaacctgagtgatggagacatcaagctgctggtgaacatcgtgcgggcctatgacatccctgtgaggaagccagctgtgtccaagttccagcagcccagccgcagcagcaggatgttcagcgagaagcacgccgccagccccagcacctacagccccacccacaatgctgactaccccctgggccaggtgctggtgcggccctttgtggaggtgtccttccagaggacagtgtgccacaccaccacagctgagggccccaaccccagctggaatgaggagctggagctgcccttccgggcccccaacggggactacagcacagccagcctgcagagcgtgaaggatgtggtgttcatcaacatctttgatgaggtgctgcatgatgtgctggaggatgaccgggagcggggcagcggcatccacacccgcatcgagcggcactggctgggctgtgtgaagatgcccttcagcaccatctacttccaggccagaattgatggcaccttcaagattgacatcccccctgtgctgctgggctacagcaaggagaggaacatgatcctggagcggggctttgacagcgtgcgcagcctgtctgagggcagctacatcaccctcttcatcaccatcgagccccagctggtgcctggagagagcatccgggagaagtttgagagccaggaggatgagaagctgctgcaggccacagagaagttccaggccgagtgtgccctgaagttccccaaccggcagtgcctgaccaccgtgattgacatcagcggcaagacagtgttcatcacccgctacctgaagcccctgaaccccccccaggagctgctgaatgtgtaccccaacaacctgcaggccacagctgagctggtggcccgctacgtgtccctcatccccttcctgcctgacacagtgtcctttggaggcatctgtgacctgtggagcaccagtgaccagttcctggacctgctggccggagatgaggaggagcacgctgtgctgctgtgcaactacttcctgagcctgggcaagaaggcctggctgctgatgggaaatgccatccctgagggccccacagcctacgtgctgacctgggagcagggccgctacctgatctggaacccctgcagcggccacttctacggccagtttgacaccttctgccccctgaagaatgtgggctgcctgattggccctgacaacatctggttcaacatccagagatatgagagccccctgcgcatcaactttgatgtgacccggcccaagctgtggaagagcttcttcagccgcagcctgccctacccaggcctgagctctgtgcagcctgaggagctgatctaccagaggagtgacaaggctgctgctgctgagctgcaggaccgcatcgagaagatcctgaaggagaagatcatggactggaggcccaggcacctgacccgctggaaccgctactgcaccagcaccctgcggcacttcctgcccctgctggagaagagccagggagaagatgtggaggatgaccacagagctgagctgctgaagcagctgggggactaccgcttcagcggcttccccctgcacatgccctacagcgaggtgaagcccctgattgatgctgtgtacagcactggagtgcacaacattgatgtgcccaacgtggagtttgccctggccgtgtacatccacccctaccccaagaatgtgctgtctgtgtggatctacgtggccagcctcatccggaacagatag

SEQ ID NO: 147965 - DNA, 4863 bp, Artificial Sequence; identical to SEQ ID NO: 147964
  Description of Artificial Sequence: Synthetic coding sequence

SEQ ID NO: 147966 - DNA, 4539 bp, Artificial Sequence; identical to SEQ ID NO: 147963
  Description of Artificial Sequence: Synthetic coding sequence

SEQ ID NO: 147967 - DNA, 369 bp, Artificial Sequence
  Description of Artificial Sequence: Synthetic coding sequence
atgaacccccgggaggagaaggtgaagatcatcacagaggagttcattgaaaatgatgaagatgctgacatgggccggcagaacaagaacagcaaggtgcggcggcagcccaggaagaagcagaagcccacccccttcagccgggcctgctggcagatcctgccccacctgtctgctggggtgcccctgctgggctgggagcaccctgtgcagggcaagagcttccaggccaccaactgctgcccccagggcaatggagtgaggaagatccccccctggcagcccccaggggcctgtgccggcggggcccaggaccccccaccagaatatgacagccctgagcggcccacagagcgggccggctgctag

SEQ ID NO: 147968 - DNA, 4863 bp, Artificial Sequence; identical to SEQ ID NO: 147964
  Description of Artificial Sequence: Synthetic coding sequence

SEQ ID NO: 147969 - DNA, 369 bp, Artificial Sequence; identical to SEQ ID NO: 147967
  Description of Artificial Sequence: Synthetic coding sequence

SEQ ID NO: 147970 - DNA, 4539 bp, Artificial Sequence; identical to SEQ ID NO: 147963
  Description of Artificial Sequence: Synthetic coding sequence

SEQ ID NO: 147971 - DNA, 369 bp, Artificial Sequence; identical to SEQ ID NO: 147967
  Description of Artificial Sequence: Synthetic coding sequence

SEQ ID NO: 147972 - DNA, 1767 bp, Artificial Sequence
  Description of Artificial Sequence: Synthetic coding sequence
atgaacccccgggaggagaaggtgaagatcatcacagaggagttcattgaaaatgatgaagatgctgacatgggccggcagaacaagaacagcaaggtgcggcggcagcccaggaagaagcagcccccaacagctgtgcccaaggagatggtgtctgagaagagccacctgggcaacccccaggagcctgtgcaggaggagcccaagacccggctgctgtccatgacagtgcggcggggccccaggagcctgccccccatccccagcaccagcaggactggatttgctgagttctccatgaggggccgcatgagggagaagctgcaggccgcccggagcaaggccgagagcgccctgctgcaggagatccccaccccccggccccggcggctgcggagccccagcaagaaggagctggagacagaatttggaacagagcccgggaaggaggtggagaggacccagcaggaggtggacagccagagctacagccgggtgaagttccatgattctgccaggaagatcaagcccaagccccaggtgcccccaggcttccccagcgctgaggaggcctacaacttcttcaccttcaactttgatcctgagcctgagggcagcgaggagaagcccaaggcccggcaccgggccggcaccaaccaggaggaggaggagggggaggaggaggagcccccagcccagggcggcggcaaggagatggatgaggaggagctgctgaatggagatgatgctgaggacttcctgctgggcctggaccacgtggctgatgactttgtggccgtgcggcctgctgactatgagagcatccatgaccggctgcagatggagcgggagatgctgttcatccccagccggcagacagtgcccacctacaagaagctgcctgaaaatgtgcagccccgcttcctggaggatgagggcctgtacacaggagtgcggcctgaggtggcccggaccaaccagaacatcatggagaaccggctgctgatgcaggaccctgagcggcgctggtttggagatgatggccgcatcctggccctgcccaaccccatcaagcccttccccagccggccccctgtgctgacccaggagcagagcatcaaggccgagctggagaccctgtacaagaaggctgtgaagtatgtgcacagcagccagcacgtgatccgcagcggggaccccccaggcaacttccagctggacatcgacatcagcggcctcatcttcacccaccacccctgcttcagccgggagcacgtgctggccgccaagctggcccagctgtatgaccagtacctggcccggcaccagaggaacaaggccaagttcctgacagacaagctgcaggccctgagaaatgctgtgcagacaggcctggaccctgagaagccccaccagagcctggacaccatccagaagaccatcaatgagtacaagtctgagatccggcagaccaggaagttcagagatgctgagcaggagaaggacaggaccctgctgaagaccatcatcaaggtgtggaaggagatgaagagcctgcgggagttccagcgcttcaccaacacccccctgaagctggtgctgaggaaggagaaggctgaccagaaggcagatgaggaggcctatgaggccgagatccaggccgagatcagcgagctgctggaggagcacacagaggagtatgcccagaagatggaggagtaccgcaccagcctgcagcagtggaaggcctggaggaaggtgcagtag

SEQ ID NO: 147973 - DNA, 336 bp, Artificial Sequence
  Description of Artificial Sequence: Synthetic coding sequence
atgaacccccgggaggagaaggtgaagatcatcacagaggagttcattgaaaatgatgaagatgctgacatgggccggcagaacaagaacagcaaggtgcggcggcagcccaggaagaagcagcccccaacagctgtgcccaaggagatggtgtctgagaagagccacctgggcaacccccaggagcctgtgcaggaggagcccaagacccggctgctgtccatgacagtgcggcggggcccccggcgggagctggtggtgaagaagagcctgggccggcccggcaccgtgacccacgtgtgcaaccccagcaccctggagggccggggcggctag

SEQ ID NO: 147974 - DNA, 882 bp, Artificial Sequence
  Description of Artificial Sequence: Synthetic coding sequence
atggccctggtgtctgctgacagcagaattgctgagctgctgacagagctgcaccagctgatcaagcagacccaggaggagaggagccgctctgagcacaacctggtgaacatccagaagacccatgagaggatgcagacagagaacaagatcagcccctactaccgcaccaagctgcggggcctgtacaccacagccaaggcagatgctgaggccgagtgcaacatcctgaggaaggccctggacaagattgctgagatcaagagcctgctggaggagaggagaattgctgccaagattgctggcctgtacaatgattctgagccccccaggaagaccatgagaagaggagtgctgatgaccctgctgcagcagagcgccatgaccctgcccctgtggattggcaagccaggggacaagcccccacccctgtgtggggccatcccagccagcggggactatgtggcccggcctggggacaaggtggccgcccgggtgaaggctgtggatggagatgagcagtggatcctggccgaggtggtgtcctacagccacgccaccaacaagtatgaggtggatgacattgatgaggagggcaaggagcggcacaccctgagcagaagaagagtcatccccctgccccagtggaaggccaaccctgagacagatcctgaggccctcttccagaaggagcagctggtgctggccctgtacccccagaccacctgcttctaccgggccctgatccacgccccaccccagaggccccaggatgactacagcgtgctgtttgaggacaccagctatgcagatggctacagcccccccctgaatgtggcccagagatatgtggtggcctgcaaggagcccaagaagaagtag

SEQ ID NO: 147975 - DNA, 843 bp, Artificial Sequence
  Description of Artificial Sequence: Synthetic coding sequence
atgaatgacaggagcagcagaagaaggaccatgaaggatgatgagacctttgagatcagcatcccctttgatgaggccccccacctggacccccagatcttctacagcctgagccccagcagaagaaactttgaggagcccccagaggccgccagcagcgccctggccctgatgaacagcgtgaagacccagctgcacatggccctggagagaaattcctggctgcagaagagaattgaggacctggaggaggagcgggacttcctgcgctgccagctggacaagttcatcagcagcgccaggatggaggccgaggaccactgcaggatgaagccaggccccaggaggatggagggggacagcagaggaggagctggaggagaggccagtgaccctgagagcgctgccagcagcctgagcggggccagcgaggagggcagcgccagcgagcggcggcggcagaagcagaagggcggggccagcagaagaagatttgggaagcccaaggcccgggagcggcagagggtgaaggatgctgatggagtgctgtgccgctacaagaagatcctgggcaccttccagaagctgaagtccatgagccgggcctttgagcaccaccgggtggacaggaacacagtggccctgaccacccccatcgccgagctgctgattgtggcccctgagaagctggccgaggtgggggagtttgaccccagcaaggagcggctgctggagtacagccgccgctgcttcctggccctggatgatgagaccctgaagaaggtgcaggccctgaagaagagcaagctgctgctgcccatcacctaccgcttcaagaggtag

SEQ ID NO: 147976 - DNA, 495 bp, Artificial Sequence
  Description of Artificial Sequence: Synthetic coding sequence
atgatgctgacccaggcccccagctctgtggtgcgcagcaggaacagcaggaaccacacagtgaacagcggcggcagctgcctgagcgccagcacagtggccatcccagccatcaatgacagcagcgctgccatgtctgcctgcagcaccatcagcgcccagcctgccagctccatggacacccagatgcacagccccaagaagcaggagcgggtgaacaagagggtcatctggggcatcgaggtggccgaggagctgcactggaagggctgggagctgggcaaggagaccaccaggaacctggtgctgaagaacagaagcctgaagctgcagaagatgaagtaccgctaccagtacaagggcagcaggacccagtgccacagcctggagcccaggaagcaggccctcttcaagaccaagcagaacaagcagaagaagcccctgacctgccacatcaaggccagcgagtgcctgaagtatgtgcagtatgaatag

SEQ ID NO: 147977 - DNA, 495 bp, Artificial Sequence; identical to SEQ ID NO: 147976
  Description of Artificial Sequence: Synthetic coding sequence

SEQ ID NO: 147978 - DNA, 5778 bp, Artificial Sequence
  Description of Artificial Sequence: Synthetic coding sequence
atgttcaccctgaccggctgccgcctggtggagaagacccagaaggtggagaaccccagcgtgtcctttgccagcagcttccccctcatccccctgctgctgcggggcaagtctgtgcagaagaagcaggccgagagcaagagccagatcaagctgcacacccagagcgcccccttcggcctgtgccccaaggacatgatgctgacccaggcccccagctctgtggtgcgcagcaggaacagcaggaaccacacagtgaacagcggcggcagctgcctgagcgccagcacagtggccatcccagccatcaatgacagcagcgctgccatgtctgcctgcagcaccatcagcgcccagcctgccagctccatggacacccagatgcacagccccaagaagcaggagcgggtgaacaagagggtcatctggggcatcgaggtggccgaggagctgcactggaagggctgggagctgggcaaggagaccaccaggaacctggtgctgaagaacagaagcctgaagctgcagaagatgaagtaccggccccccaagaccaagttcttcttcaccgtcatcccccagcccatcttcctgagccctggcatcaccctgaccctgcccatcgtgttccggcccctggaggccaaggagtacatggaccagctgtggtttgagaaggccgagggcatgttctgtgtgggcctgcgggccaccctgccctgccacaggctcatctgccggccccccagcctgcagctgcccatgtgtgctgtgggggacaccacagaggccttcttctgcctggacaacgtgggggacctgcccaccttcttcacctgggagttcagcagccccttccagatgctgcctgccaccggcctgctggagcccggccaggccagccagatcaaggtgaccttccagcccctgacagctgtgatctatgaggtgcaggccacctgctggtatggagctggcagccggcagaggagcagcatccagctgcaggccgtggccaagtgtgcccagctgctggtgtccatcaagcacaagtgcccagaggaccaggatgctgagggcttccagaagctgctgtactttggatctgtggccgtgggctgcaccagcgagcggcagatccggctgcacaaccccagcgctgtgaatgcccccttccgcatcgagatcagcccagatgagctggccgaggaccaggccttcagctgccccacagcccatggaattgtgctgcccggggagaagaagtgtgtgtctgtgttcttccaccccaagaccctggacaccaggacagtggactactgcagcatcatgcccagcggctgtgccagcaagaccctgctgaaggtggtgggcttctgccggggccctgctgtgtccctgcagcactactgtgtgaacttctcctgggtgaacctgggggagaggtctgagcagcccctgtggattgagaaccagagcgactgcacagcccacttccagtttgccatcgactgcctggagagcgtcttcaccatccggcctgccttcggcaccctggtgggcaaggccaggatgaccctgcactgtgccttccagcccacccaccccatcatctgcttcagaagagtggcctgcctgatccaccaccaggaccccctcttcctggacctgatgggcacctgccacagcgacagcaccaagccagccatcctgaagccccagcacctgacctggtaccgcacccacctggcccggggcctgaccctgtaccccccagacatcctggatgccatgctgaaggagaagaagctggcccaggaccagaatggagccctgatgatccccatccaggacctggaggacatgcctgccccccagtacccctacatcccccccatgacagagttcttctttgatggcaccagtgacatcaccatcttccccccacccatctctgtggagcctgtggaggtggactttggagcctgccccggccctgaggcccccaaccctgtgcccctgtgcctgatgaaccacaccaagggcaagatcatggtggtgtggacccggcggagtgactgccccttctgggtgaccccagagagctgtgatgtgccccccctgaagtccatggccatgaggctgcacttccagcccccccaccccaactgcctgtacacagtggagctggaggcctttgccatctacaaggtgctgcagagctacagcaacatcgaggaggactgcaccatgtgccccagctggtgcctgactgtgcgggcccggggccacagctactttgctggctttgagcaccacatcccccagtacagcctggatgtgcccaagctgtttcctgctgtgagcagcggggagcccacctaccgcagcctgctgctggtgaacaaggactgcaagctgctgaccttcagcctggccccccagaggggcagtgatgtgatcctgcggcccaccagcggcctggtggcccctggggcccaccagatcatcctgatctgcacctacccagagggcagctcctggaagcagcacaccttctacctgcagtgcaatgccagcccccagtacctgaaggaggtgtccatgtacagccgggaggagcccctgcagctgaagctggacacccacaagagcctgtacttcaagcccacctgggtgggctgcagcagcaccagccccttcaccttcaggaaccccagccggctgcccctgcagtttgagtggagggtgtctgagcagcacaggaagctgctggccgtgcagcccagccggggcctcatccagcccaatgaaaggctgaccctgacctggaccttcagccccctggaggagaccaagtacctgttccaggtgggcatgtgggtgtgggaggccggcctgagccccaatgccaacccagctgccaccacccactacatgctgcggctggtgggcgtgggcctgaccagcagcctgagcgccaaggagaaggagctggcctttggaaatgtgctggtgaacagcaagcagagccgcttcctggtgctgctgaatgatggcaactgcaccctgtactaccgcctgtacctggagcagggcagccctgaggccgtggacaaccaccccctggccctgcagctggacagaacagagggctccatgccacccaggagccaggacaccatctgcctgacagcctgccccaagcagaggagccagtacagctggaccatcacctacagcctgctgagccaccgggacaacaaggccggggagaagcaggagctgtgctgcgtgtccctggtggccgtgtaccccctgctgagcatcctggatgtgtcctccatgggcagcgctgagggcatcaccaggaagcacctgtggaggctcttcagcctggacctgctgaacagctacctggagcgggaccccaccccctgtgagctgacctacaaggtgcccaccaggcacagcatgagccagatcccccctgtgctgacccccctgcggctggacttcaactttggagctgcccccttcaaggcccctccttctgtggtgttcctggccctgaagaacagcggcgtggtgtccctggactgggccttcctgctgcccagcgaccagagaattgatgtggagctgtgggccgagcaggccgagctgaacagcacagagctgcaccagatgagggtgcaggacaactgcctcttcagcatcagccccaaggccggcagcctgagccctggccaggagcagatggtggagctgaagtacagccacctgttcatcggcacagaccacctgcctgtgctcttcaaggtgagccacggccgggagatcctgctgaacttcatcggcgtgacagtgaagccagagcagaagtatgtgcacttcaccagcaccacccaccagttcatccccatccccatcggggacaccctgcccccccggcagatctatgagctgtacaatggaggctctgtgcctgtgacctatgaggtgcagacagatgtgctgagccaggtgcaggagaagaactttgaccaccccatcttctgctgcctgaaccccaagggggagatccagcccggcagcacagcccgggtgctgtggatcttcagccccatcgaggccaagacctacacagtggatgtgcccatccacatcctgggctggaacagcgccctgatccacttccagggcgtgggctacaacccccacatgatgggagacacagcccccttccacaacatcagctcctgggacaacagcagcatccacagccggctggtggtgcccggccagaatgtgttcctgagccagagccacatcagcctgggcaacatccctgtgcagagcaagtgcagccggctgctcttcctgaacaacatcagcaagaatgaggagatcgccttctcctggcagcccagccccctggactttggagaggtgtctgtgagccccatgattggagtggtggcccctgaggagaccgtgccctttgtggtgaccctgcgggcctctgtgcacgccagcttctacagcgctgacctggtgtgcaagctgtacagccagcagctgatgaggcagtaccacaaggagctgcaggagtggaaggatgagaaggtgcggcaggaggtggagttcaccatcacagacatgaaggtgaagaagaggacctgctgcacagcctgtgagcccgccaggaagtacaagaccctgccccccatcaagaaccagcagagcgtgtccaggcctgcctcctggaagctgcagacccccaaggaggaggtgtcctggccctgcccccagccccccagccctggcatgctgtgcctgggcctgacagcccgggcccacgccacagactacttcctggccaacttcttcagcgagttcccctgccacttcctgcaccgggagctgcccaagaggaaggccccccgggaggagagcgagaccagcgaggagaagagccccaacaagtggggccctgtgtccaagcagaagaagcagctgctggtggacatcctgaccaccatcatccggggcctgctggaggacaagaacttccatgaagctgtggaccagagcctggtggagcaggtgccctacttccggcagttctggaatgagcagagcaccaagttcatggaccagaagaacagcctgtacctgatgcccatcctgcctgtgcccagcagctcctgggaggatggcaagggcaagcagcccaaggaggacaggcctgagcactacccaggcctgggcaagaaggaggagggggaggaggagaagggggaggaggaggaggaggagctggaggaggaggaggaggaggaggaggagacagaggaggaggagctgggcaaggaggagattgaggagaaggaggaggagagagatgagaaggaggagaaggtgtcctgggccggcatcggccccaccccccagcctgagagccaggagagcatgcagtggcagtggcagcagcagctgaatgtgatggtgaaggaggagcaggagcaggatgagaaggaggccatccggcggctgcctgcctttgccaacctgcaggaggccctgctggagaacatgatccagaacatcctggtggaggccagcagaggagaggtggtgctgaccagccggccccgggtgattgccctgccccccttctgtgtgcccaggagcctgaccccagacaccctgctgcccacccagcaggccgaggtgctgcaccctgtggtgcccctgcccacagacctgccctag

SEQ ID NO: 147979 - DNA, 2190 bp, Artificial Sequence
  Description of Artificial Sequence: Synthetic coding sequence
atgctgacccaggcccccagctctgtggtgcgcagcaggaacagcaggaaccacacagtgaacagcggcggcagctgcctgagcgccagcacagtggccatcccagccatcaatgacagcagcgctgccatgtctgcctgcagcaccatcagcgcccagcctgccagctccatggacacccagatgcacagccccaagaagcaggagcgggtgaacaagagggtcatctggggcatcgaggtggccgaggagctgcactggaagggctgggagctgggcaaggagaccaccaggaacctggtgctgaagaacagaagcctgaagctgcagaagatgaagtaccggccccccaagaccaagttcttcttcaccgtcatcccccagcccatcttcctgagccctggcatcaccctgaccctgcccatcgtgttccggcccctggaggccaaggagtacatggaccagctgtggtttgagaaggccgagggcatgttctgtgtgggcctgcgggccaccctgccctgccacaggctcatctgccggccccccagcctgcagctgcccatgtgtgctgtgggggacaccacagaggccttcttctgcctggacaacgtgggggacctgcccaccttcttcacctgggagttcagcagccccttccagatgctgcctgccaccggcctgctggagcccggccaggccagccagatcaaggtgaccttccagcccctgacagctgtgatctatgaggtgcaggccacctgctggtatggagctggcagccggcagaggagcagcatccagctgcaggccgtggccaagtgtgcccagctgctggtgtccatcaagcacaagtgcccagaggaccaggatgctgagggcttccagaagctgctgtactttggatctgtggccgtgggctgcaccagcgagcggcagatccggctgcacaaccccagcgctgtgaatgcccccttccgcatcgagatcagcccagatgagctggccgaggaccaggccttcagctgccccacagcccatggaattgtgctgcccggggagaagaagtgtgtgtctgtgttcttccaccccaagaccctggacaccaggacagtggactactgcagcatcatgcccagcggctgtgccagcaagaccctgctgaaggtggtgggcttctgccggggccctgctgtgtccctgcagcactactgtgtgaacttctcctgggtgaacctgggggagaggtctgagcagcccctgtggattgagaaccagagcgactgcacagcccacttccagtttgccatcgactgcctggagagcgtcttcaccatccggcctgccttcggcaccctggtgggcaaggccaggatgaccctgcactgtgccttccagcccacccaccccatcatctgcttcagaagagtggcctgcctgatccaccaccaggaccccctcttcctggacctgatgggcacctgccacagcgacagcaccaagccagccatcctgaagccccagcacctgacctggtaccgcacccacctggcccggggcctgaccctgtaccccccagacatcctggatgccatgctgaaggagaagaagctggcccaggaccagaatggagccctgatgatccccatccaggacctggaggacatgcctgccccccagtacccctacatcccccccatgacagagttcttctttgatggcaccagtgacatcaccatcttccccccacccatctctgtggagcctgtggaggtggactttggagcctgccccggccctgaggcccccaaccctgtgcccctgtgcctgatgaaccacaccaagggcaagatcatggtggtgtggacccggcggagtgactgccccttctgggtgaccccagagagctgtgatgtgccccccctgaagtccatggccatgaggctgcacttccagcccccccaccccaactgcctgtacacagtggagctggaggcctttgccatctacaaggtgtgtgccagaaatgaaagagaggagtgtggggtgtctgcccggagcctgagcggcctggtgggctggcaggaggtgacagagggcagcttccggctgcaccccctgcgggcccggctgagcctgggctggacagtgacccccatgagcctgagcccccccaagctgctggcctag

SEQ ID NO: 147980 - DNA, 5778 bp, Artificial Sequence; identical to SEQ ID NO: 147978
  Description of Artificial Sequence: Synthetic coding sequence

SEQ ID NO: 147981 - DNA, 5778 bp, Artificial Sequence; identical to SEQ ID NO: 147978
  Description of Artificial Sequence: Synthetic coding sequence

SEQ ID NO: 147982 - DNA, 816 bp, Artificial Sequence
  Description of Artificial Sequence: Synthetic coding sequence
atgaccctgcactgtgccttccagcccacccaccccatcatctgcttcagaagagtggcctgcctgatccaccaccaggaccccctcttcctggacctgatgggcacctgccacagcgacagcaccaagccagccatcctgaagccccagcacctgacctggtaccgcacccacctggcccggggcctgaccctgtaccccccagacatcctggatgccatgctgaaggagaagaagctggcccaggaccagaatggagccctgatgatccccatccaggacctggaggacatgcctgccccccagtacccctacatcccccccatgacagagttcttctttgatggcaccagtgacatcaccatcttccccccacccatctctgtggagcctgtggaggtggactttggagcctgccccggccctgaggcccccaaccctgtgcccctgtgcctgatgaaccacaccaagggcaagatcatggtggtgtggacccggcggagtgactgccccttctgggtgaccccagagagctgtgatgtgccccccctgaagtccatggccatgaggctgcacttccagcccccccaccccaactgcctgtacacagtggagctggaggcctttgccatctacaaggtgtgtgccagaaatgaaagagaggagtgtggggtgtctgcccggagcctgagcggcctggtgggctggcaggaggtgacagagggcagcttccggctgcaccccctgcgggcccggctgagcctgggctggacagtgacccccatgagcctgagcccccccaagctgctggcctag

SEQ ID NO: 147983 - DNA, 543 bp, Artificial Sequence
  Description of Artificial Sequence: Synthetic coding sequence
atggccgccctggacctgcgggcagagctggacagcctggtgctgcagctgctgggggacctggaggagctggagggcaagaggacagtgctgaatgcccgggtggaggagggctggctgagcctggccaaggcccgctatgccatgggcgccaagtctgtgggccccctgcagtatgccagccacatggagccccaggtgtgcctgcacgccagcgaggcccaggagggcctgcagaagttcaaggtggtgcgggccggcgtgcacgcccctgaggaggtgggcccccgggaggccggcctgcggcggaggaagggccccaccaagaccccagagcctgagagcagcgaggccccccaggaccccctgaactggtttggcatcctggtgccccacagcctgcggcaggcccaggccagcttcagagatggcctgcagctggccgctgacatcgccagcctgcagaacagaattgactggggccgcagccagctgcggggcctgcaggagaagctgaagcagctggagcctggagctgcctag

SEQ ID NO: 147984 - DNA, 567 bp, Artificial Sequence
  Description of Artificial Sequence: Synthetic coding sequence
atgggcacccccctggatggcggcagccgggtgcccatcggctgcccagccaagctgcggcgggtgaccaggaagaaggtggccccagacctggagggctggctgagcctggccaaggcccgctatgccatgggcgccaagtctgtgggccccctgcagtatgccagccacatggagccccaggtgtgcctgcacgccagcgaggcccaggagggcctgcagaagttcaaggtggtgcgggccggcgtgcacgcccctgaggaggtgggcccccgggaggccggcctgcggcggaggaagggccccaccaagaccccagagcctgagagcagcgaggccccccaggaccccctgaactggtttggcatcctggtgccccacagcctgcggcaggcccaggccagcttcagagatggagtgctggaggccaagaagaggaagtgcttcctggagagggtcatccagtgtgtggtgtccccagctgctgagcaggaggctgaagatgagagctgcccagaggactgggccgctgctgtgcctgctgagaccagcgccaaggccatctag

SEQ ID NO: 147985 - DNA, 855 bp, Artificial Sequence
  Description of Artificial Sequence: Synthetic coding sequence
atgtctgacaacaaggagaggaagagccagggcttccccaaggaggacaaccaggacaccagcagcctggctgatgctgtggagaaggtggccaagcagcagcagagccaggccagcgagattgagaagaacaagaaggtgctcttcaacctgaagaatgagctgcacgagctggagaaggagattgctgccatctctgctgagaccaaggagacagagcggcagatctaccagcaggacagcgccatcgagaacaccaagctgcactgtgacagcctggagacccagatcaagagcctgcacagtgaaaatgtgaagctgaagtttgatattgaaacagcccaggaggactttgaggagcacatgatcaagtacaatgcctactatgccaagatcaaggcccacaagaacagcctgggggaggtggagagcaagtggagcttcatgacagagctgcacgagaagagggactttgtgaagaagctgaagaccatgaaggaggagctgatgcaggacctgcagaaccctgggggcaaccgcatcacccaggtgcaggaggacatcaccaacctgaaggacaagatcatcaccgtgaaggagagcatcatcgagaagacctgcttcctggaggaggagaagaagacccatgagaagctgaggaaggagattgagagcctggcccccagcccccggctggagtgcagcagcgccatcagcgcccactgcaagctgtgcctgcccggcagccgccacagccctgccagcgccagcggcgtggccggcaccactggagcctgccaccacacccagctgatcttctgcatcttcagcagagatggagtgagcccctgctag

SEQ ID NO: 147986 - DNA, 822 bp, Artificial Sequence
  Description of Artificial Sequence: Synthetic coding sequence
atgtctgacaacaaggagaggaagagccagggcttccccaaggaggacaaccaggacaccagcagcctggctgatgctgtggagaaggtggccaagcagcagcagagccaggccagcgagattgagaagaacaagaaggtgctcttcaacctgaagaatgagctgcacgagctggagaaggagattgctgccatctctgctgagaccaaggagacagagcggcagatctaccagcaggacagcgccatcgagaacaccaagctgcactgtgacagcctggagacccagatcaagagcctgcacagtgaaaatgtgaagctgaagtttgatattgaaacagcccaggaggactttgaggagcacatgatcaagtacaatgcctactatgccaagatcaaggcccacaagaacagcctgggggaggtggagagcaagtggagcttcatgacagagctgcacgagaagagggactttgtgaagaagctgaagaccatgaaggaggagctgatgcaggacctgcagaaccctgggggcaaccgcatcacccaggtgcaggaggacatcaccaacctgaaggacaagatcatcaccgtgaaggagagcatcatcgagaagacctgcttcctggaggaggagaagaagacccatgagaagctgaggaaggagattgaggtgcagcacaagagatatgatgccatcctgaagaggctgcactgccaggtgaacaagctgcagagcaacagacggcagtggcagtggaacatccagcagctggagaagacagctgctgagctgaggaaatgtattggcatgcaggagtag

SEQ ID NO: 147987 - DNA, 1536 bp, Artificial Sequence
  Description of Artificial Sequence: Synthetic coding sequence
atgagcaaggtggcccggagcagcagcgagagtgatgtgcagctgtgggagacagaggaggatgacatgacagaaggagacctgggctacggcctgggcaggaagccaggcggcatctatgaaattgagttcagccacaggagcaggaagagaagtgatggcaagaacttcagccccccacccttccccaggaaaggagaggagagaaatgaggccagcttccagtacagcaagcacaagagccagcaggacaccttcccccaggtgagccgcatcagcaactaccgccggcagagcagcacagtggacagcaacagcgagctgagcaatgaggagctgcggcagtgcctgaatgagaccctggaggaggtggagatgctgaagacagagctggaggccagccagaggcagctgcggggcaaggaggaggccctgaagatcctgcagagcatggccatcctgggcaaggccaccagccacacccaggccgtgctgcagaagaccatggagcagaacagaagcctggagaaggagatcaatgccctgcagtgggagattgaatttgaccacaaccgcttcaagaacatcgaggagagctggatccagaagtatgaccggctgaactgtgaaaatgctgtgctgaaggagaacctgaaggtgaagacagaggagatcaagatgctgaagagtgacaatgctgtgctgaaccagcgctacctggaggccctggccatgctggacatcaagcagcagaagatggcccaggagaacatgtgctgtgacaagagcggctttgctgaggccagcggcctggagctggccgtgctgggcgcctgcctgtgccacggccctgggggcaacccctgcagctgtgccaggatggccgccagcaccaggaagctgctgctgcagctgaagcaggagctggagatcctgcagaagagcaaggaggaggcctacgtgatggctgatgccttccgcatcgcctttgagcagcagctgatgaggaagaatgaccaggccctgcagctgacccagatggacaagatgcacaagaaggccaccaagtggatgaactggaagcacctgaaggaggatggcttccccagccccaggagcaagaagaccttcggccagaggctgctgggcatgctgcccagcgagaacagcagcaagaggatggaggaccaggacagcccccaggaggtgctgaagatgctgattgacctgctgaatgacaaggaggaggccctggcccaccagaggaaggtgtcctacatgctggcccgggccctggaggacaaggacacagccagcaatgaaaacaaggagaagaaccccatcaaggagaacttccccttcaacaacccctggaggaagaccagcgagttctctgtgctgggggaccccatccacagctctgtgtgcatcctgaacagcgtgggctgcatctgcagcatccagcacagccagattgaccccaactaccgcaccctgaagaggagccacagcctgcccagcagcatcatcttctag

SEQ ID NO: 147988 - DNA, 1536 bp, Artificial Sequence; identical to SEQ ID NO: 147987
  Description of Artificial Sequence: Synthetic coding sequence

SEQ ID NO: 147989 - DNA, 1161 bp, Artificial Sequence
  Description of Artificial Sequence: Synthetic coding sequence
atgctgaagacagagctggaggccagccagaggcagctgcggggcaaggaggaggccctgaagatcctgcagagcatggccatcctgggcaaggccaccagccacacccaggccgtgctgcagaagaccatggagcagaacagaagcctggagaaggagatcaatgccctgcagtgggagattgaatttgaccacaaccgcttcaagaacatcgaggagagctggatccagaagtatgaccggctgaactgtgaaaatgctgtgctgaaggagaacctgaaggtgaagacagaggagatcaagatgctgaagagtgacaatgctgtgctgaaccagcgctacctggaggccctggccatgctggacatcaagcagcagaagatggcccaggagaacatgtgctgtgacaagagcggctttgctgaggccagcggcctggagctggccgtgctgggcgcctgcctgtgccacggccctgggggcaacccctgcagctgtgccaggatggccgccagcaccaggaagctgctgctgcagctgaagcaggagctggagatcctgcagaagagcaaggaggaggcctacgtgatggctgatgccttcagaattgcctttgagcagcagctgatgaggaagaatgaccaggccctgcagctgacccagatggacaagatgcacaagaaggccaccaagtggatgaactggaagcacctgaaggaggatggcttccccagccccaggagcaagaagaccttcggccagaggctgctgggcatgctgcccagcgagaacagcagcaagaggatggaggaccaggacagcccccaggaggtgctgaagatgctgattgacctgctgaatgacaaggaggaggccctggcccaccagaggaaggtgtcctacatgctggcccgggccctggaggacaaggacacagccagcaatgaaaacaaggagaagaaccccatcaaggagaacttccccttcaacaacccctggaggaagaccagcgagttctctgtgctgggggaccccatccacagctctgtgtgcatcctgaacagcgtgggctgcatctgcagcatccagcacagccagattgaccccaactaccgcaccctgaagaggagccacagcctgcccagcagcatcatcttctag

SEQ ID NO: 147990 - DNA, 3465 bp, Artificial Sequence
  Description of Artificial Sequence: Synthetic coding sequence
atgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaaggagattgagcaggagctgcacctggcccaggccgagatccagagcctgcggcaggccgctgaggacagcgccacagagcacgagagtgacatcgccagcctgcaggaggacctgtgcaggatgcagaatgagctggaggacatggagcgcatccggggggactatgagatggagatcgccagcctgcgggcagagatggagatgaagagcagcgagcccagcggcagcctgggcctgagtgactacagcggcctgcaggaggagctgcaggagctgcgggagcgctaccacttcctgaatgaggagtaccgggccctgcaggagagcaacagcagcctgaccggccagctggccgacctggagagcgagaggacccagagggccacagagcgctggctgcagagccagaccctgtccatgaccagcgctgagagccagaccagcgagatggacttcctggagccagaccctgagatgcagctgctgcggcagcagctgagagatgctgaggagcagatgcacggcatgaagaacaagtgccaggagctgtgctgtgagctggaggagctgcagcaccaccggcaggtgtctgaggaggagcagaggcggctgcagcgggagctgaagtgtgcccagaatgaggtgctgcgcttccagaccagccacagcgtgacccagaatgaggagctgaagagccggctgtgcaccctgcagaagaagtatgacaccagccaggatgagcagaatgagctgctgaagatgcagctgcagctgcagacagagctgcggcagctgaaggtgatgaagagcaccctggtggagaaccagagcgagaaggagctgctgtgccgcctgcagaagctgcacctgcagcaccagaatgtgacctgtgagaaggagaagctgctggagcggcagcagcagctgcaggaggagctgcagtgccatgaagctgagctgcagcacctgcgggacacagtggccagcttcaaggagagcaatgagaaggacacagagacccacgcccagctgcaggagatgaagcagctgtaccaggccagcaaggatgagctggagcggcagaagcacatgtatgaccagctggagcaggacctgctgctgtgccagctggagctgaaggagctgaaggccagccaccccatcccagaagataaaggaaaatgtgccaacaagtgtgacaccctgctgagccggctgacagagctgcaggagaagtacaaggccagccagaaggagatgggccagctgcagatggagcagtgtgagctgctggaggaccagaggaggatgcaggaggagcagggccagctgcaggaggagctgcaccggctgaccctgcccctgcccaagagcggcctgctgctgaagagccaggagctgctgaccaagctggaggacctgtgtgagctgcagctgctgtaccagggcatgcaggaggagcagaagaagctgatccagaaccaggactgtgtgctgaaggagcagctggagatccacgaggagctgcggcgcttcaaggagagccacttccaggaggtgctggagaacccagatgacagcaagctggccaagagcagcaagtgcaacagaaacaagcagagcaagctgctgatggagcagatgcaggccctgcaggtgatgtatgatgctggccaggccaagcaggagctgctgcagcaggagcagggccgcctgctggaggagaggaagaggctgcaggccgacctgcagctgtgcctggaggagatgcagctgctgcaggtgcagagccccagcatcaagatgagcctggagagctatggcaagagctatggctccatggtgcccagcaatgaaaactgcaggaagacctatgacaccaccgtggatgacaatgaaagctactacaagagctacaccagcacccagaccagcagcaagagcttcctgaagagctatgacagcagcaccagcgccagcgaggcctacggcaagagctactgcaccaccagcaacagcagcatcacctacaagaagagctatggcagcaccagcagcagtgacacctgccagaagagctttgtgagcagctgcacagatgaggagcctgctgagcctgaggacatggagagatttgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggatgcctgtgagcgggagttcaaggagtgcatggagtgcctggagaagcccatggccccccagaatgacaagaatgagatcaaggagctgcagaccaagctgcgggagctgcagctgcagtaccaggcctccatggatgagcagggccgcctgctggtggtgcaggagcagctggagggccagctgcagtgctgccaggaggagctgcggcagctgcgggagaagaggccttctgtggtgaaggaggcccggggcaagaatgccaacaagaacatgaacaagaatgccaacggggtgaagatgaagaaggtgaccaagccctgcagcgacaccagcgagagtgacctggagaccaggaagagcctggaggtggtgctgtactacaaggccagccagaggaagctggatggcctggccaaggaggaggagaagaaggaggagatggaggaggagaagaagcaggtgaaggaggaggccaaggagcagtgtggagatgagctggtggccgagcctgctgaccctgaggaggccaagagcacagaggaccaggaggagaatgaggaggacaaggaggaggaggagaaggaggaggacagcgaggaggaggaggatgatgctgacagcagcctggagagccctgaggagaacaaccccctgcggctgtctgagagcaagaagagcagccccacccccaacccccccatcttcagcctgcccctggtgggcctggtggtgatcagcgccctgctgtggtgctggtgggccgagaccagcagctag

SEQ ID NO: 147991 - DNA, 2874 bp, Artificial Sequence
  Description of Artificial Sequence: Synthetic coding sequence
ctgcgggccctggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaaggagattgagcaggagctgcacctggcccaggccgagatccagagcctgcggcaggccgctgaggacagcgccacagagcacgagagtgacatcgccagcctgcaggaggacctgtgcaggatgcagaatgagctggaggacatggagcgcatccggggggactatgagatggagatcgccagcctgcgggcagagatggagatgaagagcagcgagcccagcggcagcctgggcctgagtgactacagcggcctgcaggaggagctgcaggagctgcgggagcgctaccacttcctgaatgaggagtaccgggccctgcaggagagcaacagcagcctgaccggccagctggccgacctggagagcgagaggacccagagggccacagagcgctggctgcagagccagaccctgtccatgaccagcgctgagagccagaccagcgagatggacttcctggagccagaccctgagatgcagctgctgcggcagcagctgagagatgctgaggagcagatgcacggcatgaagaacaagtgccaggagctgtgctgtgagctggaggagctgcagcaccaccggcaggtgtctgaggaggagcagaggcggctgcagcgggagctgaagtgtgcccagaatgaggtgctgcgcttccagaccagccacagcgtgacccagaatgaggagctgaagagccggctgtgcaccctgcagaagaagtatgacaccagccaggatgagcagaatgagctgctgaagatgcagctgcagctgcagacagagctgcggcagctgaaggtgatgaagagcaccctggtggagaaccagagcgagaaggagctgctgtgccgcctgcagaagctgcacctgcagcaccagaatgtgacctgtgagaaggagaagctgctggagcggcagcagcagctgcaggaggagctgcagtgccatgaagctgagctgcagcacctgcgggacacagtggccagcttcaaggagagcaatgagaaggacacagagacccacgcccagctgcaggagatgaagcagctgtaccaggccagcaaggatgagctggagcggcagaagcacatgtatgaccagctggagcaggacctgctgctgtgccagctggagctgaaggagctgaaggccagccaccccatcccagaagataaaggaaaatgtgccaacaagtgtgacaccctgctgagccggctgacagagctgcaggagaagtacaaggccagccagaaggagatgggccagctgcagatggagcagtgtgagctgctggaggaccagaggaggatgcaggaggagcagggccagctgcaggaggagctgcaccggctgaccctgcccctgcccaagagcggcctgctgctgaagagccaggagctgctgaccaagctggaggacctgtgtgagctgcagctgctgtaccagggcatgcaggaggagcagaagaagctgatccagaaccaggactgtgtgctgaaggagcagctggagatccacgaggagctgcggcgcttcaaggagagccacttccaggaggtgctggagaacccagatgacagcaagctggccaagagcagcaagtgcaacagaaacaagcagagcaagctgctgatggagcagatgcaggccctgcaggtgatgtatgatgctggccaggccaagcaggagctgctgcagcaggagcagggccgcctgctggaggagaggaagaggctgcaggccgacctgcagctgtgcctggaggagatgcagctgctgcaggtgcagagccccagcatcaagatgagcctggagagctatggcaagagctatggctccatggtgcccagcaatgaaaactgcaggaagacctatgacaccaccgtggatgacaatgaaagctactacaagagctacaccagcacccagaccagcagcaagagcttcctgaagagctatgacagcagcaccagcgccagcgaggcctacggcaagagctactgcaccaccagcaacagcagcatcacctacaagaagagctatggcagcaccagcagcagtgacacctgccagaagagctttgtgagcagctgcacagatgaggagcctgctgagcctgaggacatggagagatttgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggatgcctgtgagcgggagttcaaggagtgcatggagtgcctggagaagcccatggccccccagaatgacaagaatgaaaacatgtttggcctgtggaagcccatggtgttcctggccatcgctgctgtggccctgtatgtgctgcccaacatgaggcagcaggagagcgagttctgcctgatggagtag

SEQ ID NO: 147992 - DNA, 1305 bp, Artificial Sequence
  Description of Artificial Sequence: Synthetic coding sequence
atggaggccggggccggggccggggccggggccgccggctggagctgccccggccctggccccaccgtgaccaccctgggcagctatgaggccagcgagggctgtgagaggaagaagggccagcgctggggcagcctggagcggcggggcatgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaaggagattgagcaggagctgcacctggcccaggccgagatccagagcctgcggcaggccgctgaggacagcgccacagagcacgagagtgacatcgccagcctgcaggaggacctgtgcaggatgcagaatgagctggaggacatggagcgcatccggggggactatgagatggagatcgccagcctgcgggcagagatggagatgaagagcagcgagcccagcgaggagctgcaggagctgcgggagcgctaccacttcctgaatgaggagtaccgggccctgcaggagagcaacagcagcctgaccggccagctggccgacctggagagcgagaggacccagagggccacagagcgctggctgcagagccagaccctgtccatgaccagcgctgagagccagaccagcgagatggacttcctggagccagaccctgagatgcagctgctgcggcagcagctgagagatgctgaggagcagatgcacggcatgaagaacaagtgccaggagctgtgctgtgagctggaggagctgcagcaccaccggcaggtgtctgaggaggagcagaggcggctgcagcgggagctgaagtgtgcccagaatgaggtgctgcgcttccagaccagccacagcgtgacccagagcagccccacccccaacccccccatcttcagcctgcccctggtgggcctggtggtgatcagcgccctgctgtggtgctggtgggccgagaccagcagctag

SEQ ID NO: 147993 - DNA, 3474 bp, Artificial Sequence
  Description of Artificial Sequence: Synthetic coding sequence
ctgcgggccctggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaaggagattgagcaggagctgcacctggcccaggccgagatccagagcctgcggcaggccgctgaggacagcgccacagagcacgagagtgacatcgccagcctgcaggaggacctgtgcaggatgcagaatgagctggaggacatggagcgcatccggggggactatgagatggagatcgccagcctgcgggcagagatggagatgaagagcagcgagcccagcggcagcctgggcctgagtgactacagcggcctgcaggaggagctgcaggagctgcgggagcgctaccacttcctgaatgaggagtaccgggccctgcaggagagcaacagcagcctgaccggccagctggccgacctggagagcgagaggacccagagggccacagagcgctggctgcagagccagaccctgtccatgaccagcgctgagagccagaccagcgagatggacttcctggagccagaccctgagatgcagctgctgcggcagcagctgagagatgctgaggagcagatgcacggcatgaagaacaagtgccaggagctgtgctgtgagctggaggagctgcagcaccaccggcaggtgtctgaggaggagcagaggcggctgcagcgggagctgaagtgtgcccagaatgaggtgctgcgcttccagaccagccacagcgtgacccagaatgaggagctgaagagccggctgtgcaccctgcagaagaagtatgacaccagccaggatgagcagaatgagctgctgaagatgcagctgcagctgcagacagagctgcggcagctgaaggtgatgaagagcaccctggtggagaaccagagcgagaaggagctgctgtgccgcctgcagaagctgcacctgcagcaccagaatgtgacctgtgagaaggagaagctgctggagcggcagcagcagctgcaggaggagctgcagtgccatgaagctgagctgcagcacctgcgggacacagtggccagcttcaaggagagcaatgagaaggacacagagacccacgcccagctgcaggagatgaagcagctgtaccaggccagcaaggatgagctggagcggcagaagcacatgtatgaccagctggagcaggacctgctgctgtgccagctggagctgaaggagctgaaggccagccaccccatcccagaagataaaggaaaatgtgccaacaagtgtgacaccctgctgagccggctgacagagctgcaggagaagtacaaggccagccagaaggagatgggccagctgcagatggagcagtgtgagctgctggaggaccagaggaggatgcaggaggagcagggccagctgcaggaggagctgcaccggctgaccctgcccctgcccaagagcggcctgctgctgaagagccaggagctgctgaccaagctggaggacctgtgtgagctgcagctgctgtaccagggcatgcaggaggagcagaagaagctgatccagaaccaggactgtgtgctgaaggagcagctggagatccacgaggagctgcggcgcttcaaggagagccacttccaggaggtgctggagaacccagatgacagcaagctggccaagagcagcaagtgcaacagaaacaagcagagcaagctgctgatggagcagatgcaggccctgcaggtgatgtatgatgctggccaggccaagcaggagctgctgcagcaggagcagggccgcctgctggaggagaggaagaggctgcaggccgacctgcagctgtgcctggaggagatgcagctgctgcaggtgcagagccccagcatcaagatgagcctggagagctatggcaagagctatggctccatggtgcccagcaatgaaaactgcaggaagacctatgacaccaccgtggatgacaatgaaagctactacaagagctacaccagcacccagaccagcagcaagagcttcctgaagagctatgacagcagcaccagcgccagcgaggcctacggcaagagctactgcaccaccagcaacagcagcatcacctacaagaagagctatggcagcaccagcagcagtgacacctgccagaagagctttgtgagcagctgcacagatgaggagcctgctgagcctgaggacatggagagatttgaggagatggtggtgaaggtgctgatcaagctgcaggccgtgcaggccatgtaccagatcagccaggaggagcacagccagctgcaggagcagatggagaagctgctggccaagcagaaggacctgaaggaggagctggatgcctgtgagcgggagttcaaggagtgcatggagtgcctggagaagcccatggccccccagaatgacaagaatgagatcaaggagctgcagaccaagctgcgggagctgcagctgcagtaccaggcctccatggatgagcagggccgcctgctggtggtgcaggagcagctggagggccagctgcagtgctgccaggaggagctgcggcagctgcgggagaagaggccttctgtggtgaaggaggcccggggcaagaatgccaacaagaacatgaacaagaatgccaacggggtgaagatgaagaaggtgaccaagccctgcagcgacaccagcgagagtgacctggagaccaggaagagcctggaggtggtgctgtactacaaggccagccagaggaagctggatggcctggccaaggaggaggagaagaaggaggagatggaggaggagaagaagcaggtgaaggaggaggccaaggagcagtgtggagatgagctggtggccgagcctgctgaccctgaggaggccaagagcacagaggaccaggaggagaatgaggaggacaaggaggaggaggagaaggaggaggacagcgaggaggaggaggatgatgctgacagcagcctggagagccctgaggagaacaaccccctgcggctgtctgagagcaagaagaacatgtttggcctgtggaagcccatggtgttcctggccatcgctgctgtggccctgtatgtgctgcccaacatgaggcagcaggagagcgagttctgcctgatggagtag

SEQ ID NO: 147994 - DNA, 309 bp, Artificial Sequence
  Description of Artificial Sequence: Synthetic coding sequence
atgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagtag

SEQ ID NO: 147995 - DNA, 1341 bp, Artificial Sequence
  Description of Artificial Sequence: Synthetic coding sequence
atggaggccggggccggggccggggccggggccgccggctggagctgccccggccctggccccaccgtgaccaccctgggcagctatgaggccagcgagggctgtgagaggaagaagggccagcgctggggcagcctggagcggcggggcatgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaaggagattgagcaggagctgcacctggcccaggccgagatccagagcctgcggcaggccgctgaggacagcgccacagagcacgagagtgacatcgccagcctgcaggaggacctgtgcaggatgcagaatgagctggaggacatggagcgcatccggggggactatgagatggagatcgccagcctgcgggcagagatggagatgaagagcagcgagcccagcggcagcctgggcctgagtgactacagcggcctgcaggaggagctgcaggagctgcgggagcgctaccacttcctgaatgaggagtaccgggccctgcaggagagcaacagcagcctgaccggccagctggccgacctggagagcgagaggacccagagggccacagagcgctggctgcagagccagaccctgtccatgaccagcgctgagagccagaccagcgagatggacttcctggagccagaccctgagatgcagctgctgcggcagcagctgagagatgctgaggagcagatgcacggcatgaagaacaagtgccaggagctgtgctgtgagctggaggagctgcagcaccaccggcaggtgtctgaggaggagcagaggcggctgcagcgggagctgaagtgtgcccagaatgaggtgctgcgcttccagaccagccacagcgtgacccagagcagccccacccccaacccccccatcttcagcctgcccctggtgggcctggtggtgatcagcgccctgctgtggtgctggtgggccgagaccagcagctag

SEQ ID NO: 147996 - DNA, 21 bp, Artificial Sequence
  Description of Artificial Sequence: Synthetic coding sequence
atgcaggccatggagggctag

SEQ ID NO: 147997 - DNA, 414 bp, Artificial Sequence
  Description of Artificial Sequence: Synthetic coding sequence
atgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcccaggtgctgcagctggtggccgagctggaggagacccgggagctggccggccagcatgaagatgacagcctggagctgcagggcctgctggaggatgagcggctggccagcgcccagcaggccgaggtgttcaccaagcagatccagcagctgcagggcgagctgcggagcctgcgggaggagatcagcctgctggagcacgagaaggagagcgagctgaagtag

SEQ ID NO: 147998 - DNA, 192 bp, Artificial Sequence
  Description of Artificial Sequence: Synthetic coding sequence
atgcaggccatggagggggaggtgctgctgcctgccctgtatgaggaggaggaggaggaggaggaggaggaggaggaggtggaggaggaggaggagcaggtgcagaagggcggctctgtgggcagcctgtctgtgaacaagcaccggggcctgagcctgacagaaacagagctggaggagctgcgggcctag

SEQ ID NO: 147999 - DNA, 870 bp, Artificial Sequence
  Description of Artificial Sequence: Synthetic coding sequence
atggccggggccggccgcggggctgctgtgtcccgggtgcaggccggccctggcagcccccggcgggcccggggccggcagcaggtgcagcccctgggcaagcagaggcctgccccctggccaggcctgcggagcaaggagaagaagaaggtgaactgcaagcccaagaaccaggatgagcaggagatccccttccggctgcgggagatcatgaggagccggcaggagatgaagaaccccatcagcaacaagaagaggaagaaggccgcccaggtgaccttcaggaagaccctggagaaggaggccaagggggaggagccagacattgctgtgcccaagttcaagcagaggaagggggagagtgatggagcctacatccacaggatgcagcaggaggcccagcacgtgctcttcctgagcaagaaccaggccatccggcagcctgaggtgcaggccgcccccaaggagaagtctgagcagaagaaggccaagaaggccttccagaagaggcggctggacaaggtgcggaggaagaaggaggagaaggctgctgaccggctggagcaggagctgctgcgggacacagtgaagtttggagaggtggtgctgcagcccccagagctgacagcccggccccagaggtctgtgtccaaggaccagcctggaagaagaagccagatgctgaggatgctgctgagccctgggggcgtgtcccagcccctgacagccagcctggcccggcagagaattgtggaggaggagcgggagagagctgtgcaggcctaccgggccctgaagcagaggcagcagcagctgcatggagagcggccccacctgaccagcaggaagaagccagagccccagctgtag

SEQ ID NO: 148000 - DNA, 1656 bp, Artificial Sequence
  Description of Artificial Sequence: Synthetic coding sequence
atgcccctgagcacagctggcatcctgagcagcagcagcgctgccagcaacagaagcaggaacaaggcccgctaccgcaccaaggctgtgagcagcgaggtggatgagagcctgtttggagacatcaagagccctgcccagggccagagcgacagccccatcgtgctgctgcgggacaagcacaccctgcagaagaccctgacagccctgggcctggacaggaagccagagaccatccagctgatcacccgggacatggtgcgggagctgattgtgcccacagaggaccccagcggggagagcctcatcatcagccctgaggagtttgagcgcatcaagtgggccagccacgtgctgacccgggaggagctggaggcccgggaccaggccttcaagaaggagaaggaggccaccatggatgctgtgatgaccaggaagaagatcatgaagcagaaggagatggtgtggaacaacaacaagaagctgagtgacctggaggaggtggccaaggagcgggcccagaacctgctgcagagggccaacaagctgaggatggagcaggaggaggagctgaaggacatgagcaagatcatcctgaatgccaagtgccacgccatcagagatgcccagatcctggagaagcagcagatccagaaggagctggacacagaggagaagaggctggaccagatgatggaggtggagcggcagaagagcatccagaggcaggaggagctggagaggaagaggcgggaggagcgcatccggggccggcggcagatcgtggagcagatggagaagaaccaggaggagaggagcctgctggccgagcagcgggagcaggagaaggagcagatgctggagtacatggagcagctgcaggaggaggacctgaaggacatggagcggcggcagcagcagaagctgaagatgcaggccgagatcaagaggatcaatgatgagaaccagaagcagaaggccgagctgctggcccaggagaagctggccgaccagatggtgatggagttcaccaagaagaagatggcccgggaggccgagtttgaggccgagcaggagcgcatccggcgggagaaggagaaggagatcgcccggctgcgggccatgcaggagaaggcccaggactaccaggccgagcaggatgccctgcgggccaagaggaaccaggaggtggccgaccgggagtggaggaggaaggagaaggaaaatgccaggaagaagatggagacagaggccgagctgaggaagagccggctggagcaggtggccttcaaggagcacgccctggccgtgcaggtgcagagggacagagatgaatttgagcgcatcctgcgggcccagcgggagcagatcgagaaggagcggctggaggaggagaagaaggccaccggccgcctgcagcacgccaatgagctgcggcggcaggtgcgggagaaccagcagaaggaggtgcagaaccgcatcgccacctttgaggagggccgccgcctgaaggaggaggcccagaagaggcgggagagaattgatgagatcaagaggaagaagctggaggagctgcgggccaccggcctgcctgagaagtactgcatcgaggccgagaggaaggccaacatcctgcctgccacctctgtgaactag

SEQ ID NO: 148001 - DNA, 1401 bp, Artificial Sequence
  Description of Artificial Sequence: Synthetic coding sequence
atggtgcgggagctgattgtgcccacagaggaccccagcggggagagcctcatcatcagccctgaggagtttgagcgcatcaagtgggccagccacgtgctgacccgggaggagctggaggcccgggaccaggccttcaagaaggagaaggaggccaccatggatgctgtgatgaccaggaagaagatcatgaagcagaaggagatggtgtggaacaacaacaagaagctgagtgacctggaggaggtggccaaggagcgggcccagaacctgctgcagagggccaacaagctgaggatggagcaggaggaggagctgaaggacatgagcaagatcatcctgaatgccaagtgccacgccatcagagatgcccagatcctggagaagcagcagatccagaaggagctggacacagaggagaagaggctggaccagatgatggaggtggagcggcagaagagcatccagaggcaggaggagctggagaggaagagaagagaggagcgcatccggggccggcggcagatcgtggagcagatggagaagaaccaggaggagaggagcctgctggccgagcagcgggagcaggagaaggagcagatgctggagtacatggagcagctgcaggaggaggacctgaaggacatggagcggcggcagcagcagaagctgaagatgcaggccgagatcaagaggatcaatgatgagaaccagaagcagaaggccgagctgctggcccaggagaagctggccgaccagatggtgatggagttcaccaagaagaagatggcccgggaggccgagtttgaagctgagcaggagcgcatcagaagagagaaggagaaggagatcgcccggctgcgggccatgcaggagaaggcccaggactaccaggccgagcaggatgccctgcgggccaagaggaaccaggaggtggccgaccgggagtggaggaggaaggagaaggaaaatgccaggaagaagatggagacagaagctgagctgaggaagagccggctggagcaggtggccttcaaggagcacgccctggccgtgcaggtgcagagggacagagatgaatttgagcgcatcctgcgggcccagcgggagcagatcgagaaggagcggctggaggaggagaagaaggccaccggccgcctgcagcacgccaatgagctgcggcggcaggtgcgggagaaccagcagaaggaggtgcagaacagaattgccacctttgaggagggccggcggctgaaggaggaggcccagaagagaagagaaagaattgatgagatcaagaggaagaagctggaggagctgcgggccaccggcctgcctgagaagtactgcattgaagctgagaggaaggccaacatcctgcctgccacctctgtgaactag

SEQ ID NO: 148002 - DNA, 1884 bp, Artificial Sequence
  Description of Artificial Sequence: Synthetic coding sequence
atggaggaggccgaccgcatcctgatccacagcctgcggcaggccggcacagctgtgcccccagatgtgcagaccctgcgggccttcaccacagagctggtggtggaggccgtggtgcgctgcctgcgggtcatcaacccagctgtgggcagcggcctgagccccctgctgcccctggccatgtctgcccgcttccggctggccatgagcctggcccaggcctgcatggacctgggctaccccctggagctgggctaccagaacttcctgtaccccagcgagccagacctgcgggacctgctgctcttcctggccgagcggctgcccacagatgcctctgaagatgctgaccagcctgctggggacagcgccatcctgctgcgggccatcggcagccagatccgggaccagctggccctgccctgggtgcccccccacctgcggacccccaagctgcagcacctgcagggcagcgccctgcagaagcccttccacgccagccggctggtggtgcctgagctgagcagcagaggagagccccgggagttccaggccagccccctgctgctgcctgtgcccacccaggtgccccagcctgtgggccgggtggccagcctgctggagcaccacgccctgcagctgtgccagcagacaggccgggacaggcctggagatgaggactgggtgcacaggaccagccggctgcccccccaggaggacacccgggcccagaggcagaggctgcagaagcagctgacagagcacctgcggcagagctggggcctgctgggcgcccccatccaggcccgggacctgggggagctgctgcaggcctggggcgctggggccaagacaggagcccccaagggcagccgcttcacccacagcgagaagttcaccttccacctggagccccaggcccaggccacccaggtgtctgatgtgcctgccaccagccggcggcctgagcaggtgacctgggccgcccaggagcaggagctggagagcctgcgggagcagctggagggcgtgaacagaagcattgaggaggtggaggccgacatgaagaccctgggcgtgtcctttgtgcaggccgagagcgagtgccgccacagcaagctgagcacagctgagcgggagcaggccctgcggctgaagagcagagctgtggagctgctgcctgatggaacagccaacctggccaagctgcagctggtggtggagaacagcgcccagagggtcatccacctggccggccagtgggagaagcaccgggtgcccctgctggccgagtaccgccacctgaggaagctgcaggactgccgggagctggagagcagccggcggctggccgagatccaggagctgcaccagagcgtgcgggctgctgctgaggaggcccggaggaaggaggaggtgtacaagcagctgatgtctgagctggagaccctgcccagagatgtgtcccggctggcctacacccagaggatcctggagatcgtgggcaacatcaggaagcagaaggaggagatcaccaagatcctgagtgacaccaaggagctgcagaaggagatcaacagcctgagcggcaagctggacaggacctttgctgtgacagatgagctggtgttcaaggatgccaagaaggatgatgctgtgaggaaggcctacaagtacctggccgccctgcacgagaactgcagccagctgatccagaccatcgaggacaccggcaccatcatgagggaggtgcgggacctggaggagcagattgaaacagagctgggcaagaagaccctgagcaacctggagaagatccgggaggactaccgggccctgcggcaggagaatgccggcctgctgggccgggtgcgggaggcctag

SEQ ID NO: 148003 - DNA, 1743 bp, Artificial Sequence
  Description of Artificial Sequence: Synthetic coding sequence
atggaggaggccgaccgcatcctgatccacagcctgcggcaggccggcacagctgtgcccccagatgtgcagaccctgcgggccttcaccacagagctggtggtggaggccgtggtgcgctgcctgcgggtcatcaacccagctgtgggcagcggcctgagccccctgctgcccctggccatgtctgcccgcttccggctggccatgagcctggcccaggcctgcatggacctgggctaccccctggagctgggctaccagaacttcctgtaccccagcgagccagacctgcgggacctgctgctcttcctggccgagcggctgcccacagatgcctctgaagatgctgaccagcctgctggggacagcgccatcctgctgcgggccatcggcagccagatccgggaccagctggccctgccctgggtgcccccccacctgcggacccccaagctgcagcacctgcagggcagcgccctgcagaagcccttccacgccagccggctggtggtgcctgagctgagcagcagaggagagccccgggagttccaggccagccccctgctgctgcctgtgcccacccaggtgccccagcctgtgggccgggtggccagcctgctggagcaccacgccctgcagctgtgccagcagacaggccgggacaggcctggagatgaggactgggtgcacaggaccagccggctgcccccccaggaggacacccgggcccagaggcagaggctgcagaagcagctgacagagcacctgcggcagagctggggcctgctgggcgcccccatccaggcccgggacctgggggagctgctgcaggcctggggcgctggggccaagacaggagcccccaagggcagccgcttcacccacagcgagaagttcaccttccacctggagccccaggcccaggccacccaggtgtctgatgtgcctgccaccagccggcggcctgagcaggtgacctgggccgcccaggagcaggagctggagagcctgcgggagcagctggagggcgtgaacagaagcattgaggaggtggaggccgacatgaagaccctgggcgtgtcctttgtgcaggccgagagcgagtgccgccacagcaagctgagcacagctgagcgggagcaggccctgcggctgaagagcagagctgtggagctgctgcctgatggaacagccaacctggccaagctgcagctggtggtggagaacagcgcccagagggtcatccacctggccggccagtgggagaagcaccgggtgcccctgctggccgagtaccgccacctgaggaagctgcaggactgccgggagctggagagcagccggcggctggccgagatccaggagctgcaccagagcgtgcgggctgctgctgaggaggcccggaggaaggaggaggtgtacaagcagctgatgtctgagctggagaccctgcccagagatgtgtcccggctggcctacacccagaggatcctggagatcgtgggcaacatcaggaagcagaaggaggagatcaccaagatcctgagtgacaccaaggagctgcagaaggagatcaacagcctgagcggcaagctggacaggacctttgctgtgacagatgagctggtgttcaaggatgccaagaaggatgatgctgtgaggaaggcctacaagtacctggccgccctgcacttcatcggagatggcaccgtgggctggggcccctggatccccaacaagtag

SEQ ID NO: 148004 - DNA, 603 bp, Artificial Sequence
  Description of Artificial Sequence: Synthetic coding sequence
atggatgacaagaagaagaagaggagccccaagccctgcctggcccagcctgcccaggcccctggcaccctgcggcgggtgcctgtgcccaccagccacagcggcagcctggccctgggcctgccccacctgcccagccccaagcagagggccaagttcaagagggtgggcaaggagaagtgcaggcctgtgctggccggcggcggcagcggcagcgctggcacccccctgcagcacagcttcctgacagaggtgacagatgtgtatgagatggagggcggcctgctgaacctgctgaatgacttccacagcggccgcctgcaggccttcggcaaggaatgttcctttgagcagctggagcacgtgcgggagatgcaggagaagctggcccggctgcacttcagcctggatgtgtgtggggaggaggaggatgatgaggaggaggaggatggagtgacagagggcctgcctgaggagcagaagaagaccatggctgacaggaacctggaccagctgctgagcaacctggaggacctgagcaacagcatccagaagctgcacctggccgagaatgctgagcctgaggagcagagcgctgcctag

SEQ ID NO: 148005 - DNA, 690 bp, Artificial Sequence
  Description of Artificial Sequence: Synthetic coding sequence
atgtgggccgccggccgctggggccccaccttccccagcagctatgccggcttctctgctgactgccggcccaggagccggcccagcagtgacagctgcagcgtgcccatgaccggggcccggggccagggcctggaggtggtgcgcagccccagcccccccctgcccctgagctgcagcaacagcaccaggagcctgctgagccccctgggccaccagagcttccagtttgatgaagatgatggagatggagaagatgaggaggatgtggatgatgaggaggatgtggatgaagatgcccatgattctgaggccaaggtggccagcctgcggggcatggagctgcagggctgtgccagcacccaggtggagagcgagaacaaccaggaggagcagaagcaggtgcggctgcctgagagccggctgaccccctgggaggtgtggttcatcggcaaggagaaggaggagcgggaccggctgcagctgaaggccctggaggagctgaaccagcagctggagaagaggaaggagatggaggagcgggagaagaggaagatcatcgccgaggagaagcacaaggagtgggtgcagaagaagaatgagcaggtgcggcggggcaagtggatccacaccctgaccagcctgctgcagaacatcagcagctactacaccagcctgccccgcttctag

SEQ ID NO: 148006 - DNA, 1122 bp, Artificial Sequence
  Description of Artificial Sequence: Synthetic coding sequence
atgtgggccgccggccgctggggccccaccttccccagcagctatgccggcttctctgctgactgccggcccaggagccggcccagcagtgacagctgcagcgtgcccatgaccggggcccggggccagggcctggaggtggtgcgcagccccagcccccccctgcccctgagctgcagcaacagcaccaggagcctgctgagccccctgggccaccagagcttccagtttgatgaagatgatggagatggagaagatgaggaggatgtggatgatgaggaggatgtggatgaagatgcccatgattctgaggccaaggtggccagcctgcggggcatggagctgcagggctgtgccagcacccaggtggagagcgagaacaaccaggaggagcagaagcaggtgcggctgcctgagagccggctgaccccctgggaggtgtggttcatcggcaaggagaaggaggagcgggaccggctgcagctgaaggccctggaggagctgaaccagcagctggagaagaggaaggagatggaggagcgggagaagaggaagatcatcgccgaggagaagcacaaggagtgggtgcagaagaagaatgagcagaagaggaaggagcgggagcagaagatcaacaaggagatggaggagaaggccgccaaggagctggagaaggagtacctgcaggagaaggccaaggagaagtaccaggagtggctgaagaagaagaatgcagaagaatgtgagaggaagaagaaggagaaggagaaggagaagcagcagcaggccgagatccaggagaagaaggagattgctgagaagaagttccaggagtggctggagaatgccaagcacaagcccaggcctgctgccaagagctatggctacgccaacgggaagctgaccggcttctacagcggcaacagctacccagagcccgccttctacaaccccatcccctggaagcccatccacatgcccccacccaaggaggccaaggacctgagcggcaggaagagcaagaggcctgtgatcagccagccccacaagagcagcagcctggtgatccacaaggcccggagcaacctgtgcctgggcaccctgtgccgcatccagaggtag

SEQ ID NO: 148007 - DNA, 2268 bp, Artificial Sequence
  Description of Artificial Sequence: Synthetic coding sequence
atggagtacatcttccccaacacaggagtgctgtggagctggctgatcaacatcctgtgcaacagacgcatcgtgtggttcaccagcagccagctgccccggggccccccagccagcagcggcggccacagcttccacaccctgcgggagaggtctgagagccggctgtttgtggagagctatgctgctgcctggcagcccccaggcaccagcggcggggccagctgctgcagcagcctgagcgcccaggtgatgagcagcgagttcctggccgagctgcactgggaggatggctttgccatccctgtggccaatgaggagaacaagctgctggaggaccagctgagcaagctgaaggatgagcgggccagcctgcaggatgagctgcgggagtatgaggagcgcatcaacagcatgaccagccacttcaagaatgtgaagcaggagctgagcatcacccagagcctgtgcaaggcccgggagcgggagacagagagcgaggagcacttcaaggccatcgcccagcgggagctgggccgggtgaaggatgagatccagaggctggagaatgagatggccagcatcctggagaagaagagtgacaaggaaaatggcatcttcaaggccacccagaagctggatggcctgaagtgccagatgaactgggaccagcaggccctggaggcctggctggaggagagcgcccacaaggacagtgatgccctgaccctgcagaagtatgcccagcaggatgacaacaagatccgggccctgaccctgcagctggagcggctgaccctggagtgcaaccagaagaggaagatcctggacaatgagctgacagagaccatcagcgcccagctggagctggacaaggccgcccaggacttcaggaagatccacaatgaaaggcaggagctgatcaagcagtgggagaacaccatcgagcagatgcagaagagagatggagacatcgacaactgtgccctggagctggcccgcatcaagcaggagacccgggagaaggagaacctggtgaaggagaagatcaagttcctggagagcgagatcggcaacaacacagaatttgagaagaggatctctgtggccgacaggaagctgctgaagtgcaggacagcctaccaggaccacgagaccagccgcatccagctgaagggggagctggacagcctgaaggccaccgtgaacagaaccagcagtgacctggaggccctgaggaagaacatcagcaagatcaagaaggacatccacgaggagacagcccggctgcagaagaccaagaaccacaatgagatcatccagaccaagctgaaggagatcacagagaagaccatgtctgtggaggagaaggccaccaacctggaggacatgctgaaggaggaggagaaggatgtgaaggaggtggatgtgcagctgaacctgatcaagggcgtgctcttcaagaaggcccaggagctgcagacagagaccatgaaggagaaggctgtgctgtctgaaattgagggcaccaggagcagcctgaagcacctgaaccaccagctgcagaagctggactttgagaccctgaagcagcaggagatcatgtacagccaggacttccacatccagcaggtggagaggaggatgagccggctgaagggggagatcaacagcgaggagaagcaggccctggaggccaagatcgtggagctgaggaagagcctggaggagaagaagagcacctgtggcctgctggagacccagatcaagaagctgcacaatgacctgtacttcatcaagaaggcccacagcaagaacagtgatgagaagcagagcctgatgaccaagatcaatgagctgaacctcttcatcgacagaagtgagaaggagctggacaaggccaagggcttcaagcaggacctgatgattgaggacaacctgctgaagctggaggtgaagaggacccgggagatgctgcacagcaaggccgaggaggtgctgagcctggagaagaggaagcagcagctgtacacagccatggaggagaggacagaggagatcaaggtgcacaagaccatgctggccagccagatccgctacgtggaccaggagcgggagaacatcagcacagagttccgggagcggctgagcaagattgagaagctgaagaacagatatgagatcctgactgtggtgatgctgcccccagagggggaggaggagaagacccaggcctactacgtgatcaaggtgatgtccatgtcctag

SEQ ID NO: 148008 - DNA, 2826 bp, Artificial Sequence
  Description of Artificial Sequence: Synthetic coding sequence
atgagcagcgagttcctggccgagctgcactgggaggatggctttgccatccctgtggccaatgaggagaacaagctgctggaggaccagctgagcaagctgaaggatgagcgggccagcctgcaggatgagctgcgggagtatgaggagcgcatcaacagcatgaccagccacttcaagaatgtgaagcaggagctgagcatcacccagagcctgtgcaaggcccgggagcgggagacagagagcgaggagcacttcaaggccatcgcccagcgggagctgggccgggtgaaggatgagatccagaggctggagaatgagatggccagcatcctggagaagaagagtgacaaggaaaatggcatcttcaaggccacccagaagctggatggcctgaagtgccagatgaactgggaccagcaggccctggaggcctggctggaggagagcgcccacaaggacagtgatgccctgaccctgcagaagtatgcccagcaggatgacaacaagatccgggccctgaccctgcagctggagcggctgaccctggagtgcaaccagaagaggaagatcctggacaatgagctgacagagaccatcagcgcccagctggagctggacaaggccgcccaggacttcaggaagatccacaatgaaaggcaggagctgatcaagcagtgggagaacaccatcgagcagatgcagaagagagatggagacatcgacaactgtgccctggagctggcccgcatcaagcaggagacccgggagaaggagaacctggtgaaggagaagatcaagttcctggagagcgagatcggcaacaacacagaatttgagaagaggatctctgtggccgacaggaagctgctgaagtgcaggacagcctaccaggaccacgagaccagccgcatccagctgaagggggagctggacagcctgaaggccaccgtgaacagaaccagcagtgacctggaggccctgaggaagaacatcagcaagatcaagaaggacatccacgaggagacagcccggctgcagaagaccaagaaccacaatgagatcatccagaccaagctgaaggagatcacagagaagaccatgtctgtggaggagaaggccaccaacctggaggacatgctgaaggaggaggagaaggatgtgaaggaggtggatgtgcagctgaacctgatcaagggcgtgctcttcaagaaggcccaggagctgcagacagagaccatgaaggagaaggctgtgctgtctgaaattgagggcaccaggagcagcctgaagcacctgaaccaccagctgcagaagctggactttgagaccctgaagcagcaggagatcatgtacagccaggacttccacatccagcaggtggagaggaggatgagccggctgaagggggagatcaacagcgaggagaagcaggccctggaggccaagatcgtggagctgaggaagagcctggaggagaagaagagcacctgtggcctgctggagacccagatcaagaagctgcacaatgacctgtacttcatcaagaaggcccacagcaagaacagtgatgagaagcagagcctgatgaccaagatcaatgagctgaacctcttcatcgacagaagtgagaaggagctggacaaggccaagggcttcaagcaggacctgatgattgaggacaacctgctgaagctggaggtgaagaggacccgggagatgctgcacagcaaggccgaggaggtgctgagcctggagaagaggaagcagcagctgtacacagccatggaggagaggacagaggagatcaaggtgcacaagaccatgctggccagccagatccgctacgtggaccaggagcgggagaacatcagcacagagttccgggagcggctgagcaagattgagaagctgaagaacagatatgagatcctgactgtggtgatgctgcccccagagggggaggaggagaagacccaggcctactacgtgatcaaggccgcccaggagaaggaggagctgcagcgggagggggactgcctggatgccaagatcaacaaggccgagaaggagatctatgccctggagaacaccctgcaggtgctgaacagctgcaacaacaactacaagcagagcttcaagaaggtgacccccagcagtgatgaatatgagctgaagatccagctggaggagcagaagagagctgtggatgagaagtaccgctacaagcagaggcagatccgggagctgcaggaggacatccagagcatggagaacaccctggatgtgattgagcacctggccaacaacgtgaaggagaagctgtctgagaagcaggcctacagcttccagctgagcaaggagacagaggagcagaagcccaagctggagcgggtgaccaagcagtgtgccaagctgaccaaggagatccggctgctgaaggacaccaaggatgagaccatggaggagcaggacatcaagctgcgggagatgaagcagttccacaaggtgattgatgagatgctggtggacatcatcgaggagaacacagagatccgcatcatcctgcagacctacttccagcagagcggcctggagctgcccacagccagcaccaagggcagccggcagagcagccgcagccccagccacaccagcctgagcgcccggagcagccgcagcaccagcaccagcaccagccagagcagcatcaaggtgctggagctgaagtttcctgccagcagcagcctggtgggcagccccagccggcccagcagcgccagcagcagcagcagcaatgtgaagagcaagaagagcagcaagtag

SEQ ID NO: 148009 - DNA, 1740 bp, Artificial Sequence
  Description of Artificial Sequence: Synthetic coding sequence
atggccgagcccggcggggccgccggccgcagccacccagaagatggcagcgccagcgagggggagaaggagggcaacaatgaaagccacatggtgagccccccagagaaggatgatggccagaagggggaggaggccgtgggcagcacagagcaccctgaggaggtgaccacccaggccgaggccgccatcgaggagggggaggtggagacagaaggagaggccgctgtggagggggaggaggaggccgtgtcctatggagatgctgagagcgaggaggagtactactacacagagaccagcagccctgagggccagatctctgctgctgacaccacctacccctacttcagccccccccaggagctgcccggggaggaggcctatgattctgtgtctggagaggccggcctgcagggcttccagcaggaggccaccggccccccagagagccgggagcggcgggtgaccagccctgagcccagccatggagtgctgggccccagcgagcagatgggccaggtgaccagcggccctgctgtgggccgcctgaccggcagcacagaggagccccagggccaggtgctgcccatgggcgtgcagcaccgcttccggctgagccacggcagtgacatcgagagcagtgacctggaggagtttgtgtcccaggagcctgtgatccccccaggagtgcctgatgcccacccccgggagggggacctgcccgtcttccaggaccagatccagcagcccagcacagaggagggcgccatggccgagcgggtggagagcgagggcagtgatgaggaggccgaggatgagggcagccagctggtggtgctggaccctgaccaccccctgatggtgcgcttccaggccgccctgaagaactacctgaaccggcagatcgagaagctgaagctggacctgcaggagctggtggtggccaccaagcagagccgggcccagaggcaggagctgggcgtgaacctgtatgaggtgcagcagcacctggtgcacctgcagaagctgctggagaagagccatgacagacatgccatggccagcagcgagcggcggcagaaggaggaggagctgcaggccgcccgggccctgtacaccaagacctgtgccgccgccaatgaggagaggaagaagctggccgccctgcagacagagatggagaacctggccctgcacctgttctacatgcagaacatcgaccaggacatgagagatgacatccgggtgatgacccaggtggtgaagaaggccgagacagagcgcatccgggcagaaattgagaagaagaagcaggacctgtatgtggaccagctgaccacccgggcccagcagctggaggaggacatcgccctgtttgaggcccagtacctggcccaggccgaggacacccgcatcctgaggaaggctgtgtctgaggcctgcacagaaattgatgccatctctgtggagaagaggcgcatcatgcagcagtgggccagcagcctggtgggcatgaagcacagagatgaggcccacagagctgtgctggaggccctgtctgtgtccctggagcgcttccccagccagaacatcaacacagcccggagccggctgagcaccacctggcacagcgctggcatcctgctgcggggcagcttcctgcccggggccagccgggcctttgcctctgtgtgctatggaggagctgctgtggacaaccgcatccgggagtgctag

SEQ ID NO: 148010 - DNA, 1437 bp, Artificial Sequence
  Description of Artificial Sequence: Synthetic coding sequence
atggccgagcccggcggggccgccggccgcagccacccagaagatggcagcgccagcgagggggagaaggagggcaacaatgaaagccacatggtgagccccccagagaaggatgatggccagaagggggaggaggccgtgggcagcacagagcaccctgaggaggtgaccacccaggccgaggccgccatcgaggagggggaggtggagacagaaggagaggccgctgtggagggggaggaggaggccgtgtcctatggagatgctgagagcgaggaggagtactactacacagagaccagcagccctgagggccagatctctgctgctgacaccacctacccctacttcagccccccccaggagctgcccggggaggaggcctatgattctgtgtctggagaggccggcctgcagggcttccagcaggaggccaccggccccccagagagccgggagcggcgggtgaccagccctgagcccagccatggagtgctgggccccagcgagcagatgggccaggtgaccagcggccctgctgtgggccgcctgaccggcagcacagaggagccccagggccaggtgctgcccatgggcgtgcagcaccgcttccggctgagccacggcagtgacatcgagagcagtgacctggaggagtttgtgtcccaggagcctgtgatccccccaggagtgcctgatgcccacccccgggagggggacctgcccgtcttccaggaccagatccagcagcccagcacagaggagggcgccatggccgagcgggtggagagcgagggcagtgatgaggaggccgaggatgagggcagccagctggtggtgctggaccctgaccaccccctgatggtgcgcttccaggccgccctgaagaactacctgaaccggcagatcgagaagctgaagctggacctgcaggagctggtggtggccaccaagcagagccgggcccagaggcaggagctgggcgtgaacctgtatgaggtgcagcagcacctggtgcacctgcagaagctgctggagaagagccatgacagacatgccatggccagcagcgagcggcggcagaaggaggaggagctgcaggccgcccgggccctgtacaccaagacctgtgccgccgccaatgaggagaggaagaagctggccgccctgcagacagagatggagaacctggccctgcacctgttctacatgcagaacatcgaccaggacatgagagatgacatccgggtgatgacccaggtggtgaagaaggccgagacagagcgcatccgggcagaaattgagaagaagaagcagggcgtgggggacaccggggccgccttcatccccaagaccacccagggcgaccaggtgtctggccggggcaagaagaagccaggcaccgtggtggcccgggtgtccccagctgagctgtag

SEQ ID NO: 148011 - DNA, 3093 bp, Artificial Sequence
  Description of Artificial Sequence: Synthetic coding sequence
atggccgagcccggcggggccgccggccgcagccacccagaagatggcagcgccagcgagggggagaaggagggcaacaatgaaagccacatggtgagccccccagagaaggatgatggccagaagggggaggaggccgtgggcagcacagagcaccctgaggaggtgaccacccaggccgaggccgccatcgaggagggggaggtggagacagaaggagaggccgctgtggagggggaggaggaggccgtgtcctatggagatgctgagagcgaggaggagtactactacacagagaccagcagccctgagggccagatctctgctgctgacaccacctacccctacttcagccccccccaggagctgcccggggaggaggcctatgattctgtgtctggagaggccggcctgcagggcttccagcaggaggccaccggccccccagagagccgggagcggcgggtgaccagccctgagcccagccatggagtgctgggccccagcgagcagatgggccaggtgaccagcggccctgctgtgggccgcctgaccggcagcacagaggagccccagggccaggtgctgcccatgggcgtgcagcaccgcttccggctgagccacggcagtgacatcgagagcagtgacctggaggagtttgtgtcccaggagcctgtgatccccccaggagtgcctgatgcccacccccgggagggggacctgcccgtcttccaggaccagatccagcagcccagcacagaggagggcgccatggccgagcgggtggagagcgagggcagtgatgaggaggccgaggatgagggcagccagctggtggtgctggaccctgaccaccccctgatggtgcgcttccaggccgccctgaagaactacctgaaccggcagatcgagaagctgaagctggacctgcaggagctggtggtggccaccaagcagagccgggcccagaggcaggagctgggcgtgaacctgtatgaggtgcagcagcacctggtgcacctgcagaagctgctggagaagagccatgacagacatgccatggccagcagcgagcggcggcagaaggaggaggagctgcaggccgcccgggccctgtacaccaagacctgtgccgccgccaatgaggagaggaagaagctggccgccctgcagacagagatggagaacctggccctgcacctgttctacatgcagaacatcgaccaggacatgagagatgacatccgggtgatgacccaggtggtgaagaaggccgagacagagcgcatccgggcagaaattgagaagaagaagcaggacctgtatgtggaccagctgaccacccgggcccagcagctggaggaggacatcgccctgtttgaggcccagtacctggcccaggccgaggacacccgcatcctgaggaaggctgtgtctgaggcctgcacagaaattgatgccatctctgtggagaagaggcgcatcatgcagcagtgggccagcagcctggtgggcatgaagcacagagatgaggcccacagagctgtgctggaggccctgcggggctgccagcaccaggccaagagcacagatggagaaattgaggcctacaagaagagcatcatgaaggaggaggagaagaatgagaagctggccagcatcctgaacagaacagaaacagaggccaccctgctgcagaagctgaccacccagtgcctgaccaagcaggtggccctgcagagccagttcaacacctaccgcctgaccctgcaggacacagaagatgccctgagccaggaccagctggagcagatgatcctgacagaggagctgcaggccatccggcaggccatccagggcgagctggagctgcggaggaagacagatgctgccatccgggagaagctgcaggagcacatgaccagcaacaagaccaccaagtacttcaaccagctgatcctgcggctgcagaaggagaagaccaacatgatgacccacctgagcaagatcaatggagacatcgcccagaccaccctggacatcacccacaccagcagccggctggatgcccaccagaagaccctggtggagctggaccaggatgtgaagaaggtgaatgagctgatcaccaacagccagagcgagatcagcaggaggaccatcctgattgaaaggaagcagggcctcatcaacttcctgaacaagcagctggagaggatggtgtctgagctgggcggggaggaggtgggccccctggagctggagatcaagaggctgagcaagctgattgatgaacatgatggcaaggctgtgcaggcccaggtgacctggctgcggctgcagcaggagatggtgaaggtgacccaggagcaggaggagcagctggccagcctggatgccagcaagaaggagctgcacatcatggagcagaagaagctgcgggtggagagcaagattgagcaggagaagaaggagcagaaggagattgagcaccacatgaaggacctggacaatgacctgaagaagctgaacatgctgatgaacaagaaccgctgcagcagcgaggagctggagcagaacaacagagtgacagaaaatgaatttgtgcgcagcctgaaggccagcgagcgggagaccatcaagatgcaggacaagctgaaccagctgtctgaggagaaggccaccctgctgaaccagctggtggaggccgagcaccagatcatgctgtgggagaagaagatccagctggccaaggagatgaggagctctgtggacagcgagatcggccagacagagatccgggccatgaagggggagatccacaggatgaagaagtactgcaggaccacccaggatgcccaccgccacgtgcatgagcagcacggcacccatgctggcacctgcaccaagaacacaggccgggcccaggcccgggcccggaccaccagagatgcccggggccacgtgcatgagcagcacggcaccagggctggcacctgcaccaacaacacaggccgggcccaggcccgggcccggaccagagatgccaggagacatgtgcatgagcacaggacccacacagcccgggcctag

SEQ ID NO: 148012 - DNA, 3429 bp, Artificial Sequence
  Description of Artificial Sequence: Synthetic coding sequence
atggccgagcccggcggggccgccggccgcagccacccagaagatggcagcgccagcgagggggagaaggagggcaacaatgaaagccacatggtgagccccccagagaaggatgatggccagaagggggaggaggccgtgggcagcacagagcaccctgaggaggtgaccacccaggccgaggccgccatcgaggagggggaggtggagacagaaggagaggccgctgtggagggggaggaggaggccgtgtcctatggagatgctgagagcgaggaggagtactactacacagagaccagcagccctgagggccagatctctgctgctgacaccacctacccctacttcagccccccccaggagctgcccggggaggaggcctatgattctgtgtctggagaggccggcctgcagggcttccagcaggaggccaccggccccccagagagccgggagcggcgggtgaccagccctgagcccagccatggagtgctgggccccagcgagcagatgggccaggtgaccagcggccctgctgtgggccgcctgaccggcagcacagaggagccccagggccaggtgctgcccatgggcgtgcagcaccgcttccggctgagccacggcagtgacatcgagagcagtgacctggaggagtttgtgtcccaggagcctgtgatccccccaggagtgcctgatgcccacccccgggagggggacctgcccgtcttccaggaccagatccagcagcccagcacagaggagggcgccatggccgagcgggtggagagcgagggcagtgatgaggaggccgaggatgagggcagccagctggtggtgctggaccctgaccaccccctgatggtgcgcttccaggccgccctgaagaactacctgaaccggcagatcgagaagctgaagctggacctgcaggagctggtggtggccaccaagcagagccgggcccagaggcaggagctgggcgtgaacctgtatgaggtgcagcagcacctggtgcacctgcagaagctgctggagaagagccatgacagacatgccatggccagcagcgagcggcggcagaaggaggaggagctgcaggccgcccgggccctgtacaccaagacctgtgccgccgccaatgaggagaggaagaagctggccgccctgcagacagagatggagaacctggccctgcacctgttctacatgcagaacatcgaccaggacatgagagatgacatccgggtgatgacccaggtggtgaagaaggccgagacagagcgcatccgggcagaaattgagaagaagaagcaggacctgtatgtggaccagctgaccacccgggcccagcagctggaggaggacatcgccctgtttgaggcccagtacctggcccaggccgaggacacccgcatcctgaggaaggctgtgtctgaggcctgcacagaaattgatgccatctctgtggagaagaggcgcatcatgcagcagtgggccagcagcctggtgggcatgaagcacagagatgaggcccacagagctgtgctggaggccctgcggggctgccagcaccaggccaagagcacagatggagaaattgaggcctacaagaagagcatcatgaaggaggaggagaagaatgagaagctggccagcatcctgaacagaacagaaacagaggccaccctgctgcagaagctgaccacccagtgcctgaccaagcaggtggccctgcagagccagttcaacacctaccgcctgaccctgcaggacacagaagatgccctgagccaggaccagctggagcagatgatcctgacagaggagctgcaggccatccggcaggccatccagggcgagctggagctgcggaggaagacagatgctgccatccgggagaagctgcaggagcacatgaccagcaacaagaccaccaagtacttcaaccagctgatcctgcggctgcagaaggagaagaccaacatgatgacccacctgagcaagatcaatggagacatcgcccagaccaccctggacatcacccacaccagcagccggctggatgcccaccagaagaccctggtggagctggaccaggatgtgaagaaggtgaatgagctgatcaccaacagccagagcgagatcagcaggaggaccatcctgattgaaaggaagcagggcctcatcaacttcctgaacaagcagctggagaggatggtgtctgagctgggcggggaggaggtgggccccctggagctggagatcaagaggctgagcaagctgattgatgaacatgatggcaaggctgtgcaggcccaggtgacctggctgcggctgcagcaggagatggtgaaggtgacccaggagcaggaggagcagctggccagcctggatgccagcaagaaggagctgcacatcatggagcagaagaagctgcgggtggagagcaagattgagcaggagaagaaggagcagaaggagattgagcaccacatgaaggacctggacaatgacctgaagaagctgaacatgctgatgaacaagaaccgctgcagcagcgaggagctggagcagaacaacagagtgacagaaaatgaatttgtgcgcagcctgaaggccagcgagcgggagaccatcaagatgcaggacaagctgaaccagctgtctgaggagaaggccaccctgctgaaccagctggtggaggccgagcaccagatcatgctgtgggagaagaagatccagctggccaaggagatgaggagctctgtggacagcgagatcggccagacagagatccgggccatgaagggggagatccacaggatgaaggtgcggctgggccagctgctgaagcagcaggagaagatgatccgggccatggagctggccgtggcccggcgggagaccgtgaccacccaggccgagggccagaggaagatggacaggaaggccctgaccaggacagacttccaccacaagcagctggagctgcggaggaagatcagagatgtgaggaaggccacagatgaatgtaccaagacagtgctggagctggaggagacccagagaaatgtgagcagcagcctgctggagaagcaggagaagctgagcgtcatccaggccgactttgacaccctggaggccgacctgacccggctgggcgccctgaagaggcagaacctgtctgaaattgtggccctgcagacccggctgaagcacctgcaggccgtgaaggagggccgctacgtgttcctgttccgcagcaagcagagcctggtgctggagcggcagaggctggacaagaggctggccctgattgccaccatcctggacagagtgagagatgagtacccccagttccaggaggccctgcacaaggtgtcccagatgattgccaacaagctggagagccctggccccagctag

SEQ ID NO: 148013 - DNA, 921 bp, Artificial Sequence
  Description of Artificial Sequence: Synthetic coding sequence
atggccgaggtgtccattgaccagagcaagctgcccggggtgaaggaggtgtgccgggactttgctgtgctggaggaccacaccctggcccacagcctgcaggagcaggagattgagcaccacctggccagcaatgtgcagaggaaccggctggtgcagcacgacctgcaggtggccaagcagctgcaggaggaggacctgaaggcccaggcccagctgcagaagcgctacaaggacctggagcagcaggactgtgaaattgcccaggagatccaggagaagctggccattgaagctgagcggcggcgcatccaggagaagaaggatgaggacatcgcccggctgctgcaggagaaggagctgcaggaggagaagaagaggaagaagcacttccctgagttccctgccacccgggcctatgctgacagctactactatgaagatggcggcatgaagccccgggtgatgaaggaggccgtgtccacccccagcaggatggcccaccgggaccaggagtggtatgatgctgagatcgccaggaagctgcaggaggaggagctgctggccacccaggtggacatgagagctgcccaggtggcccaggatgaggagatcgcccggctgctgatggccgaggagaagaaggcctacaagaaggccaaggagcgggagaagagcagcctggacaagaggaagcaggaccctgagtggaagcccaagacagccaaggccgccaacagcaagagcaaggagagtgatgagccccaccacagcaagaatgaaagacctgcccggcccccaccacccatcatgacagatggagaagatgctgactacacccacttcaccaaccagcagagcagcaccaggcacttcagcaagtctgagagcagccacaagggcttccactacaagcactag

SEQ ID NO: 148014 - DNA, 1449 bp, Artificial Sequence
  Description of Artificial Sequence: Synthetic coding sequence
atggccgaggtgtccattgaccagagcaagctgcccggggtgaaggaggtgtgccgggactttgctgtgctggaggaccacaccctggcccacagcctgcaggagcaggagattgagcaccacctggccagcaatgtgcagaggaaccggctggtgcagcacgacctgcaggtggccaagcagctgcaggaggaggacctgaaggcccaggcccagctgcagaagcgctacaaggacctggagcagcaggactgtgaaattgcccaggagatccaggagaagctggccattgaagctgagcggcggcgcatccaggagaagaaggatgaggacatcgcccggctgctgcaggagaaggagctgcaggaggagaagaagaggaagaagcacttccctgagttccctgccacccgggcctatgctgacagctactactatgaagatggagaccagcccggcagcagaagagcccgggagctgggcagcggcttcagccggccctgccgcctgcagagagatggcaagacagtgaagcacaagaaggagaagccagagcaccccctggagaacctggaggagcctgagcagcactgcagcagcaagaggagcctgagcagcagcagcagcggcaagggccgggacaacccccacatcaacaatgagcagcacgagaggaagaggagcacccaggagcggccccggcggcccctgctgcccaccatcagcggggaggtgttcctgagcacagaatgtgatgactgggagaccaagatcaaccaccagaccaggaactgggagaagcagagccgccaccaggaccggctgagccccaagagcagccagaaggccggcctgcactgcaaggaggtggtgtatggccgggaccacggccagggcgagcacaggaagaggaggcaccggcccaggaccccacccttcagcgagagcgaggagcagctgcacctgcatgatgctggcatgaagccccgggtgatgaaggaggccgtgtccacccccagcaggatggcccaccgggaccaggagtggtatgatgctgagatcgccaggaagctgcaggaggaggagctgctggccacccaggtggacatgagagctgcccaggtggcccaggatgaggagatcgcccggctgctgatggccgaggagaagaaggcctacaagaaggccaaggagcgggagaagagcagcctggacaagaggaagcaggaccctgagtggaagcccaagacagccaaggccgccaacagcaagagcaaggagagtgatgagccccaccacagcaagaatgaaagacctgcccggcccccaccacccatcatgacagatggagaagatgctgactacacccacttcaccaaccagcagagcagcaccaggcacttcagcaagtctgagagcagccacaagggcttccactacaagcactag

SEQ ID NO: 148015 - DNA, 1425 bp, Artificial Sequence
  Description of Artificial Sequence: Synthetic coding sequence
atggctgacagcgccagcgagagtgacacagatggagctgggggcaacagcagcagcagcgctgccatgcagagcagctgcagcagcaccagcggcggcggcggcggcggcggcggcggcggcggcggcggcaagagcggcggcatcgtcatcagccccttccggctggaggagctgaccaaccggctggccagcctgcagcaggagaacaaggtgctgaagattgagctggagacctacaagctgaagtgcaaggccctgcaggaggagaacagagacctgaggaaggcctctgtgaccatccaggcccgggcagagcaggaggaggagttcatcagcaacaccctcttcaagaagatccaggccctgcagaaggagaaggagaccctggccgtgaactatgagaaggaggaggagttcctgaccaatgagctgagcaggaagctgatgcagctgcagcacgagaaggccgagctggagcagcacctggagcaggagcaggagttccaggtgaacaagctgatgaagaagatcaagaagctggagaatgacaccatcagcaagcagctgaccctggagcagctgcggcgggagaagattgacctggagaacaccctggagcaggagcaggaggccctggtgaaccggctgtggaagaggatggacaagctggaggccgagaagaggatcctgcaggagaagctggaccagcctgtgtctgccccacccagcccccgggacatctccatggagattgacagccctgagaacatgatgaggcacatccgcttcctgaagaatgaggtggagcggctgaagaagcagctgcgggccgcccagctgcagcacagcgagaagatggcccagtacctggaggaggagcggcacatgagggaggagaacctgcggctgcagaggaagctgcagcgggagatggagcggcgggaggccctgtgccggcagctgtctgagagcgagagcagcctggagatggatgatgagcgctacttcaatgagatgtctgcccagggcctgcggcccaggacagtgagcagccccatcccctacacccccagccccagcagcagccggcccatcagccctggcctgtcctatgccagccacacagtgggcttcaccccacccaccagcctgacccgggccggcatgagctactacaacagccctggcctgcacgtgcagcacatgggcaccagccacggcatcacccggcccagccccaggaggagcaacagcccagacaagttcaagaggcccaccccaccacccagccccaacacccagacccctgtgcagcccccacctcctcctcctcctccacccatgcagcccaccgtgcccagcgctgccaccagccagcccacccccagccagcacagcgcccaccccagcagccagccctag

SEQ ID NO: 148016 - DNA, 2055 bp, Artificial Sequence
  Description of Artificial Sequence: Synthetic coding sequence
atgaaccccccagctgccttcctggccggccggcagaacatcggcagcgaggtggagatcagcaccatcgagaagcagaggaaggagctgcagctgctgattggagagctgaaggaccgggacaaggagctgaatgacatggtggccgtgcaccagcagcagctgctgtcctgggaggaggaccggcagaaggtgctgaccctggaggagcgctgcagcaagctggagggggagctgcacaagaggacagagatcatccgcagcctgaccaagaaggtgaaggccctggagagcaaccagatggagtgccagacagccctgcagaagacccagctgcagctgcaggagatggcccagaaggccacccacagcagcctgctgtctgaggacctggaggccagaaatgagaccctgagcaacaccctggtggagctgagcgcccaggtgggccagctgcaggcccgggagcaggccctgaccaccatgatcaagctgaaggacaaggacatcattgaagctgtgaaccacatcgctgactgcagcggcaagttcaagatgctggagcacgccctgagagatgccaagatggccgagacctgcatcgtgaaggagaagcaggactacaagcagaagctgaaggccctgaagattgaggtgaacaagctgaaggaggacctgaatgagaagaccacagagaacaatgagcagcgggaggagatcatccggctgaagcaggagaagagctgcctgcatgatgagctgctcttcaccgtggagcgggagaagaggaaggatgagctgctgaacatcgccaagagcaagcaggagaggaccaacagcgagctgcacaacctgcggcagatctacgtgaagcagcagagcgacctgcagttcctgaacttcaacgtggagaacagccaggagctgatccagatgtatgacagcaagatggaggagagcaaggccctggacagcagccgggacatgtgcctgagtgacctggagaacaaccaccccaaggtggacatcaagcgggagaagaaccagaagagcctcttcaaggaccagaagtttgaggccatgctggtgcagcagaacagaagtgacaagagcagctgtgatgagtgcaaggagaagaagcagcagattgacacagtgtttggagagaagagcgtcatcaccctgagcagcatcttcaccaaggacctggtggagaagcacaacctgccctggagcctgggcggcaagacccagatcgagcctgagaacaagatcaccctgtgcaagatccacaccaagagccccaagtgccacggcaccggggtgcagaatgaaggcaagcagcccagcgagacccccaccctgagtgatgagaagcagtggcatgatgtgtctgtgtacctgggcctgaccaactgccccagcagcaagcaccctgagaagctggatgtggagtgccaggaccagatggagaggtctgagatcagctgctgccagaagaatgaggcctgcctgggggagagcggcatgtgtgacagcaagtgctgccaccccagcaacttcatcatcgaggcccctggccacatgtctgatgtggagtggatgagcatcttcaagcccagcaagatgcagagaattgtgcggctgaagagcggctgcacctgcagcgagagcatctgtggcacccagcacgacagccctgccagcgagctgattgccatccaggacagccacagcctgggcagcagcaagagcgccctgagagaagatgaaacagagagcagcagcaacaagaagaacagccccaccagcctgctgatctacaaggatgccccagccttcaatgagaaggccagcatcgtgctgcccagccaggatgacttcagccccaccagcaagctgcagaggctgctggccgagagccggcagatggtgacagacctggagctgagcaccctgctgcccatcagccatgagaacctgaccggcagcgccaccaacaagtctgaggtgcctgaggagagcgcccagaagaacacctttgtgtcctactag

SEQ ID NO: 148017 - DNA, 1338 bp, Artificial Sequence
  Description of Artificial Sequence: Synthetic coding sequence
atgcccaacagcagccccaaggaccccaccacagccagcggaaatggcagcaaggtggagcgggagaagaggaaggatgagctgctgaacatcgccaagagcaagcaggagaggaccaacagcgagctgcacaacctgcggcagatctacgtgaagcagcagagcgacctgcagttcctgaacttcaacgtggagaacagccaggagctgatccagatgtatgacagcaagatggaggagagcaaggccctggacagcagccgggacatgtgcctgagtgacctggagaacaaccaccccaaggtggacatcaagcgggagaagaaccagaagagcctcttcaaggaccagaagtttgaggccatgctggtgcagcagaacagaagtgacaagagcagctgtgatgagtgcaaggagaagaagcagcagattgacacagtgtttggagagaagagcgtcatcaccctgagcagcatcttcaccaaggacctggtggagaagcacaacctgccctggagcctgggcggcaagacccagatcgagcctgagaacaagatcaccctgtgcaagatccacaccaagagccccaagtgccacggcactggagtgcagaatgaaggcaagcagcccagcgagacccccaccctgagtgatgagaagcagtggcatgatgtgtctgtgtacctgggcctgaccaactgccccagcagcaagcaccctgagaagctggatgtggagtgccaggaccagatggagaggtctgagatcagctgctgccagaagaatgaggcctgcctgggggagagcggcatgtgtgacagcaagtgctgccaccccagcaacttcatcatcgaggcccctggccacatgtctgatgtggagtggatgagcatcttcaagcccagcaagatgcagagaattgtgcggctgaagagcggctgcacctgcagcgagagcatctgtggcacccagcacgacagccctgccagcgagctgattgccatccaggacagccacagcctgggcagcagcaagagcgccctgcgggaggatgaaacagagagcagcagcaacaagaagaacagccccaccagcctgctgatctacaaggatgccccagccttcaatgagaaggccagcatcgtgctgcccagccaggatgacttcagccccaccagcaagctgcagaggctgctggccgagagccggcagatggtgacagacctggagctgagcaccctgctgcccatcagccatgagaacctgactggaagtgccaccaacaagtctgaggtgcctgaggagagcgcccagaagaacacctttgtgtcctactag

SEQ ID NO: 148018 - DNA, 2049 bp, Artificial Sequence
  Description of Artificial Sequence: Synthetic coding sequence
atgaaccccccagctgccttcctggccggccggcagaacatcggcagcgaggtggagatcagcaccatcgagaagcagaggaaggagctgcagctgctgattggagagctgaaggaccgggacaaggagctgaatgacatggtggccgtgcaccagcagcagctgctgtcctgggaggaggaccggcagaaggtgctgaccctggaggagcgctgcagcaagctggagggggagctgcacaagaggacagagatcatccgcagcctgaccaagaaggtgaaggccctggagagcaaccagatggagtgccagacagccctgcagaagacccagctgcagctgcaggagatggcccagaaggccacccacagcagcctgctgtctgaggacctggaggccagaaatgagaccctgagcaacaccctggtggagctgagcgcccaggtgggccagctgcaggcccgggagcaggccctgaccaccatgatcaagctgaaggacaaggacatcattgaagctgtgaaccacatcgctgactgcagcggcaagttcaagatgctggagcacgccctgagagatgccaagatggccgagacctgcatcgtgaaggagaagcaggactacaagcagaagctgaaggccctgaagattgaggtgaacaagctgaaggaggacctgaatgagaagaccacagagaacaatgagcagcgggaggagatcatccggctgaagcaggagaagagctgcctgcatgatgagctgctcttcaccgtggagcgggagaagaggaaggatgagctgctgaacatcgccaagagcaagcaggagaggaccaacagcgagctgcacaacctgcggcagatctacgtgaagcagcagagcgacctgcagttcctgaacttcaacgtggagaacagccaggagctgatccagatgtatgacagcaagatggaggagagcaaggccctggacagcagccgggacatgtgcctgagtgacctggagaacaaccaccccaaggtggacatcaagcgggagaagaaccagaagagcctcttcaaggaccagaagtttgaggccatgctggtgcagcagaacagaagtgacaagagcagctgtgatgagtgcaaggagaagaagcagcagattgacacagtgtttggagagaagagcgtcatcaccctgagcagcatcttcaccaaggacctggtggagaagcacaacctgccctggagcctgggcggcaagacccagatcgagcctgagaacaagatcaccctgtgcaagatccacaccaagagccccaagtgccacggcaccggggtgcagaatgaaggcaagcagcccagcgagacccccaccctgagtgatgagaagcagtggcatgatgtgtctgtgtacctgggcctgaccaactgccccagcagcaagcaccctgagaagctggatgtggagtgccaggaccagatggagaggtctgagatcagctgctgccagaagaatgaggcctgcctgggggagagcggcatgtgtgacagcaagtgctgccaccccagcaacttcatcatcgaggcccctggccacatgtctgatgtggagtggatgagcatcttcaagcccagcaagatgcagagaattgtgcggctgaagagcggctgcacctgcagcgagagcatctgtggcacccagcacgacagccctgccagcgagctgattgccatccaggacagccacagcctgggcagcagcaagagcgccctgagagaagatgaaacagagagcagcagcaacaagaagaacagccccaccagcctgctgatctacaaggatgccccagccttcaatgagaaggccagcatcgtgctgcccagccaggatgacttcagccccaccagcaagctgcagaggctgctggccgagagccggcagatggtgacagacctggagctgagcaccctgctgcccatcagccatgagaacctgaccggcagcgccaccaacatcagccacctgtgtggccggcagaaggctgacaccaacacagaatag

SEQ ID NO: 148019 - DNA, 1494 bp, Artificial Sequence
  Description of Artificial Sequence: Synthetic coding sequence
atgcccaagaaggagaagatggccaagacccccctgagtgatgagaagcagctgctgctcttccagcagaagctgctggccgaggaggagatggccaagaagaaggagcggctgctgagccagttcctgaaggacaagctggccaaggaggagcacaacagcgccctgaacctgaacaagatcaacacccagtggaggacagtgctgcgggaggtgaagacccgggagctgcacaaggacatcgagatcctgagccagacctttgagcgggtggtggactgcaaggacaacgtcatcaagagcctggccaaggacctgtctgaggccgaggagcagtatgcccacgccctgcggagccacctgcacaacgtggaccagctgctggccctgcagaggcaccggctgagcctgctggaggagagctacaacatggagctggaggccctgaccaaggagtttgaaacagagaggaagaccatcatcgaccagcacgagaaggagatccactacctgcaggacatcttcatggccatggagcagaactacattgattctgaatatgagagcaagctggagttccagagcatgtggaatgacctgaagaacatgaacctggaggagaagcacttcctgcggctgcacctggagaacagagtggaggacctgtggaggaagttccaggatgtgctgaagaactacacagatgccacagaggacaggaaggccgcctttgagaccctgcaggtgaaggatgagaagagcagcaaggagattgaggtgcagatgaagaagatccagaagctgcaggatgccatcaccatcagcaagggcaagatcatgatccacagccgggagagtgaagatgaaaatcgctacatcagaaatgacaaggagctggtgctggtgcagctgaggaagctgaaggcccagaggacccaggcccgggccgccagccagaagaacctggtgcggctgaccctggagagcaatgccaccctgaaggccctgaggaagatcgtggacaagggggagaagatcctgaagctggccgagatctgcaggaagtttgaaacagaggaggagaaggtgctgcccttctacagctctgtgctgacccccaaggagcaggagggcatccagaagaacaacctggaggagctgacagaggagctgaccaaggtgatggtggactacatcggcatggagaacttctggaagcgctacaacaaggtgaagctggagcagctgagcctgcagcacagaagagcccagctgctggacatcaatggcaagctgcgggagatgctgaagcagtacctggatggcatctctgtgtctgatgaggtgctgagccagctgaaccccctcttcatcgtgaactaccagagcaacctgctgcagcccctgagcatcagaattgcccaccctggcagcaccagccccagcgccccctggagggaccagaggaggagcttcttcctgggcagcagctag

SEQ ID NO: 148020 - DNA, 1455 bp, Artificial Sequence
  Description of Artificial Sequence: Synthetic coding sequence
atgcccaagaaggagaagatggccaagacccccctgagtgatgagaagcagctgctgctcttccagcagaagctgctggccgaggaggagatggccaagaagaaggagcggctgctgagccagttcctgaaggacaagctggccaaggaggagcacaacagcgccctgaacctgaacaagatcaacacccagtggaggacagtgctgcgggaggtgaagacccgggagctgcacaaggacatcgagatcctgagccagacctttgagcgggtggtggactgcaaggacaacgtcatcaagagcctggccaaggacctgtctgaggccgaggagcagtatgcccacgccctgcggagccacctgcacaacgtggaccagctgctggccctgcagaggcaccggctgagcctgctggaggagagctacaacatggagctggaggccctgaccaaggagtttgaaacagagaggaagaccatcatcgaccagcacgagaaggagatccactacctgcaggacatcttcatggccatggagcagaactacattgattctgaatatgagagcaagctggagttccagagcatgtggaatgacctgaagaacatgaacctggaggagaagcacttcctgcggctgcacctggagaacagagtggaggacctgtggaggaagttccaggatgtgctgaagaactacacagatgccacagaggacaggaaggccgcctttgagaccctgcaggtgaaggatgagaagagcagcaaggagattgaggtgcagatgaagaagatccagaagctgcaggatgccatcaccatcagcaagggcaagatcatgatccacagccgggagagtgaagatgaaaatcgctacatcagaaatgacaaggagctggtgctggtgcagctgaggaagctgaaggcccagaggacccaggcccgggccgccagccagaagaacctggtgcggctgaccctggagagcaatgccaccctgaaggccctgaggaagatcgtggacaagggggagaagatcctgaagctggccgagatctgcaggaagtttgaaacagaggaggagaaggtgctgcccttctacagctctgtgctgacccccaaggagcaggagggcatccagaagaacaacctggaggagctgacagaggagctgaccaaggtgatggtggactacatcggcatggagaacttctggaagcgctacaacaaggtgaagctggagcagctgagcctgcagcacagaagagcccagctgctggacatcaatggcaagctgcgggagatgctgaagcagtacctggatggcatctctgtgtctgatgaggtgctgagccagctgaaccccctcttcatcgtgaactaccagagcaacctgctgcagcccctgagcatcagaattgcccaccctggggacaagcagcaccccaccacctag

SEQ ID NO: 148021 - DNA, 3240 bp, Artificial Sequence
  Description of Artificial Sequence: Synthetic coding sequence
atggagagcaacttcaacacagagagcagcagcaccttcaccctgcagagcagcagcgagaccctcttcagcatccagctgctggacttcaagaccagcctgctggaggccctggaggagctgaggatgaggcgggaggccgagatccactatgaggagcagatcggcaagatcatcgtggagacccaggagctgaagtggcagaaggagaccctgcagaaccagaaggagaccctggccgagcagcacaaggaggccatggctgtgttcaagaagcagctgcagatgaagatgtgtgccctggaggaggagaagggcaagtaccagctggccacagagatcaaggagaaggagattgagggcctgaaggagaccctgaaggccctgcaggtgtccaagtacagcctgcagaagaaggtgtctgagatggagcagaaggtgcagctgcacctgctggccaaggaggactaccacaagcagctgtctgaaattgagaagtactatgccaccatcaccggccagtttggcctggtgaaggagaaccacgagaagctggagcagaatgtgcgggaggccatccagagcaacaagaggctgagcgccctgaacaagaagcaggaggccgagatctgcagcctgaagaaggagctgaagaaggccgccagtgacctgatcaagagcaaggtgacctgccagtacaagatgggagaggagaacatcaacctgaccatcaaggagcagaagttccaggagctgcaggagcggctgaacatggagctggagctgaatgagaagatcaatgaggagatcacccacatccaggaggagaagcaggacatcatcatctccttccagcacatgcagcagctgctgcggcagcagatccaggccaacacagagatggaggccgagctgaaggtgctgaaggagaacaaccagaccctggagcgggacaatgagctgcagcgggagaaggtgaaggaaaatgaggagaagttcctgaacctgcagaatgagcacgagaaggccctgggcacctggaagagacatgctgaggagctgaatggagagatcaacaagatcaagaatgagctgagcagcctgaaggagacccacatcaagctgcaggagcactacaacaagctgtgcaaccagaagacctttgaggaggacaagaagttccagaatgtgcctgaggtgaacaatgaaaattctgagatgagcacagagaagtctgagaacaccatcatccagaagtacaacacagagcaggagatccgggaggagaacatggagaacttctgcagcgacacagagtaccgggagaaggaggagaagaaggagggcagcttcatcgaggagatcatcattgatgacctgcagctgtttgagaagagcttcaagaatgaaattgacacagtggtgtcccaggatgagaaccagagcgagatcagcctgagcaagaccctgagcctggacaaggaggtgatcagccagggccagaccagcaatgtgacagacaacaggaagtctgtgaccacagagatcaaggacaagatctgcctggagaaggacaatggctgcacagagttcaagagccccaacaaccactttgtggtgctggacacagccattgaaacagagaagatccacctggagaggacccggggcctggatgtgcaccacacagatgtgaacctggaggtggagaacaacaagaccagcttcaacagcatcctgaatgaaacagcccacaacacctaccacaacaacaacaaggatgtgtctgaaaatgagcccttcaagcagttccggctgctgcccggcacccgggagcacgccctggagaaggagatcaccaacagcgaccagaccaaggctgacctggacagcagcctggacatcaagaagaaccctgtgccctgccagaagtacagcctgaggaacagcagcaatgtgatgctggatgacaagcagtgcaagatcaagcagatccagctgctgaccaagaagtcagaatgttccatcctgctgagcaagcagaccagtgacttcctgcaggtgtgcaatgacaccctggagaagtctgagctgactgtgccctgtgacatcgtcatcgaccaccacgtgtcctatgctgccttcagcgccaacagcaagctgctgctgaagaacagcgacaagaatgtgcacagcatgtccatgctggtgaagcccaacagcagccctgggggcaagaccatgtgcaagaacatgtctgacatgcagaacagccagttcaacaactgcctgggctacctggagaacaccaacgtgaacatcagccacctgcacctgaacaatgaaaacagccacgccagccaggccaaggatgtgaagacagctgtgcacatgaagacctgcacagaaacagagttcagcaacaagaagaaccagattgatgagaaccaggtgacagaggccaccaagaatgacctcttcctgtttgtgtccatcaatgaaaggcagcacaccctgctgaacaacacagagaagacagagagcctgaatgacatcgtgtctgggaagatgttttctgagggccagctggaggagagccacagcttccacatcgagcccagcggggacctggtgaacagaagtggccgcagcacctttgacctgagcaccagtgacaagaagacagagaagacccctgtgtacatgaacttcagtgaccccggcccctggagcaaggtgaaccacatcgagagccagacagccagcagcagcaccccctgcatcagcctgctgctgaaggagcggcccctggaccccagcgagaacaagaagatcatctccatggccctgtgcaagaacatcggcgtggatgatgtgggcaaggacattggaccagacaccaccagcatcaacagagtggccgacaccctgaacaactggagcatccacccagaccccaagggggagcccagcgaggagaagaatgccatggccaagaccttctatgacagcagcttccccacagagcacgtgaagaccaagcccctcatcagcacccccctgcagagccacctgcaggccatcaagaccaccaagaacaccagcggagatgatgactggcagagcctcatcaccaaccagctgaacaagtctgagaacctgctgagcctggagaatgacaaccagcccaagaagaggaaggccgaggagaccctggagaagaacaaccggctgaagtag

SEQ ID NO: 148022 - DNA, 1617 bp, Artificial Sequence
  Description of Artificial Sequence: Synthetic coding sequence
atgctgcagatcggggaggatgtggactacctgctgatcccccgggaggtgcggctggccggcggcgtgtggagggtcatcagcaagccagccaccaaggaggccgagttccgggagcggctgacccagttcctggaggaggagggccgcaccctggaggatgtggcccgcatcatggagaagagcaccccccaccccccccagccccccaagaagcccaaggagccccgggtgagaagaagagtgcagcagatggtgaccccaccaccccggctggtggtgggcacctatgacagcagcaatgccagtgacagcgagttcagtgactttgagaccagccgggacaagagccggcagggcccccggcggggcaagaaggtgaggaagatgcctgtgtcctacctgggcagcaagttcctgggcagtgacctggagagtgaagatgatgaggagctggtggaggccttcctgcggcggcaggagaagcagcccagcgcccccccagccaggagaagagtgaacctgcctgtgcccatgtttgaggacaacctgggcccccagctgagcaaggctgaccgctggagagaatatgtgtcccaggtgtcctggggcaagctgaagagaagagtgaagggctgggcccccagggctggccctggggtgggggaggcccggctggccagcacagctgtggagagcgctggggtgagcagcgcccctgagggcaccagccctggggaccggctgggcaatgctggagatgtgtgtgtgccccaggccagcccccggcgctggaggcccaagatcaactgggccagcttcagaagaagaaggaaggagcagacagcccccaccggccagggcgctgacattgaagctgaccagggcggggaggccgctgacagccagcgggaggaggccatcgctgaccagcgggagggcgccgccggcaaccagagagctggggccccagctgaccagggcgctgaggccgctgacaaccagcgggaggaggccgctgacaaccagagagctggggccccagctgaggagggcgctgaggccgctgacaaccagcgggaggaggccgctgacaaccagagagctgaggccccagctgaccagaggagccagggcacagacaaccaccgggaggaggccgctgacaaccagagagctgaggccccagctgaccagggcagcgaggtgacagacaaccagcgggaggaggccgtgcatgaccagcgggagcgggccccagctgtgcagggcgctgacaaccagagggcccaggcccgggccggccagagagctgaggccgcccacaaccagagagctggggcccctggcatccaggaggccgaggtgtctgctgcccagggcaccactggaacagcccctggggcccgggccaggaagcaggtgaagacagtgcgcttccagaccccaggccgcttctcctggttctgcaagagaagaagagccttctggcacaccccccggctgcccaccctgcccaagagggtgccccgggccggggaggccaggaacctgcgggtgctgcgggcagaggcccgggcagaggccgagcagggcgagcaggaggaccagctgtag

SEQ ID NO: 148023 - DNA, 975 bp, Artificial Sequence
  Description of Artificial Sequence: Synthetic coding sequence
atgctgcagatcggggaggatgtggactacctgctgatcccccgggaggtgcggctggccggcggcgtgtggagggtcatcagcaagccagccaccaaggaggccgagttccgggagcggctgacccagttcctggaggaggagggccgcaccctggaggatgtggcccgcatcatggagaagagcaccccccaccccccccagccccccaagaagcccaaggagccccgggtgagaagaagagtgcagcagatggtgaccccaccaccccggctggtggtgggcacctatgacagcagcaatgccagtgacagcgagttcagtgactttgagaccagccgggacaagagccggcagggcccccggcggggcaagaaggtgaggaagatgcctgtgtcctacctgggcagcaagttcctgggcagtgacctggagagtgaagatgatgaggagctggtggaggccttcctgcggcggcagggcctgcaggtgatccggggccagggcccccagctgacccggggccagaggctgcagatcatccggggcaagaggctgcagatcatccggggccagggcccccagctgcggcggggccagaggctgcagatcacccggggcaagaggctgcagatcatccggggccagaggccccagctgacccggggccaccgggcccagatcaccaccgggaagaggctgcagatcatccggggccggcggccccagctgacccggggccagaggctgcagatcatcaagggcaagaggccctacatgacccggggcaagggcccccagctgagccgggtgcagatcatccggggccacaggcctggcctggcccggggccagaggctgcacatcatccggggccagggcccccaggtgtccaggaagctgaagagccagctgcccaagggcccccaggagcagctgcaggagcccggccctggcaacagaagccggcagtag

SEQ ID NO: 148024 - DNA, 5532 bp, Artificial Sequence
  Description of Artificial Sequence: Synthetic coding sequence
atggagaatgagatcttcacccccctgctggagcagttcatgaccagccccctggtgacctgggtgaagaccttcggccccctggccgctggaaatggcaccaacctggatgaatatgtggccctggtggatggagtcttcctgaaccaggtgatgctgcagatcaaccccaagctggagagccagagggtgaacaagaaggtgaacaatgatgccagcctgaggatgcacaacctgagcatcctggtgcggcagatcaagttctactaccaggagaccctgcagcagctgatcatgatgagcctgcccaacgtgctgatcatcggcaagaaccccttcagcgagcagggcacagaggaggtgaagaagctgctgctgctgctgctgggctgtgctgtgcagtgccagaagaaggaggagttcatcgagcgcatccagggcctggactttgacaccaaggctgctgtggccgcccacatccaggaggtgacccacaaccaggagaatgtgtttgacctgcagtggatggaggtgacagacatgagccaggaggacatcgagcccctgctgaagaacatggccctgcacctgaagaggctgattgatgaaagagatgagcacagcgagaccatcatcgagctgtctgaggagagagatggcctgcacttcctgccccacgccagcagcagcgcccagagcccctgtggcagccctggcatgaagaggacagagagccggcagcacctgtctgtggagctggctgatgccaaggccaagatccggcggctgcggcaggagctggaggagaagacagagcagctgctggactgcaagcaggagctggagcagatggagattgagctgaagaggctgcagcaggagaacatgaacctgctgagtgatgcccggagcgccaggatgtacagagatgagctggatgccctgcgggagaaggctgtgcgggtggacaagctggagagcgaggtgagccgctacaaggagcggctgcatgacatcgagttctacaaggcccgggtggaggagctgaaggaggacaaccaggtgctgctggagaccaagaccatgctggaggaccagctggagggcacccgggcccggagtgacaagctgcacgagctggagaaggagaacctgcagctgaaggccaagctgcatgacatggagatggagcgggacatggacaggaagaagattgaggagctgatggaggagaacatgaccctggagatggcccagaagcagagcatggatgagagcctgcacctgggctgggagctggagcagatcagcaggaccagcgagctgtctgaggccccccagaagagcctgggccacgaggtgaatgagctgaccagcagccggctgctgaagctggagatggagaaccagagcctgaccaagacagtggaggagctgcggaccaccgtggacagcgtggagggcaatgccagcaagatcctgaagatggagaaggagaaccagaggctgagcaagaaggtggagatcctggagaatgagatcgtgcaggagaagcagagcctgcagaactgccagaacctgagcaaggacctgatgaaggagaaggcccagctggagaagaccatcgagaccctgagagaaaattctgagcggcagatcaagatcctggagcaggagaatgagcacctgaaccagacagtgagcagcctgcggcagaggagccagatctctgctgaggcccgggtgaaggacatcgagaaggagaacaagatcctgcacgagagcatcaaggagaccagcagcaagctgagcaagattgaatttgagaagaggcagatcaagaaggagctggagcactacaaggagaagggggagagagctgaggagctggagaatgagctgcaccacctggagaaggaaaatgagctgctgcagaagaagatcaccaacctgaagatcacctgtgagaagattgaggccctggagcaggagaacagcgagctggagagagaaaataggaagctgaagaagaccctggacagcttcaagaacctgaccttccagctggagagcctggagaaggagaacagccagctggatgaggagaacctggagctgcggagaaatgtggagagcctgaagtgtgcctccatgaagatggcccagctgcagctggagaacaaggagctggagagcgagaaggagcagctgaagaagggcctggagctgctgaaggccagcttcaagaagacagagcggctggaggtgtcctaccagggcctggacatcgagaaccagaggctgcagaagaccctggagaacagcaacaagaagatccagcagctggagagcgagctgcaggacctggagatggagaaccagaccctgcagaagaacctggaggagctgaagatcagcagcaagaggctggagcagctggagaaggagaacaagagcctggagcaggagaccagccagctggagaaggacaagaagcagctggagaaggagaacaagaggctgcggcagcaggccgagatcaaggacaccaccctggaggagaacaacgtgaagattggcaacctggagaaggagaacaagaccctgagcaaggagatcggcatctacaaggagagctgtgtgcggctgaaggagctggagaaggagaacaaggagctggtgaagagggccaccatcgacatcaagaccctggtgaccctgcgggaggacctggtgtctgagaagctgaagacccagcagatgaacaatgacctggagaagctgacccatgagctggagaagattggcctgaacaaggagcggctgctgcatgatgagcagagcacagatgacagccgctacaagctgctggagagcaagctggagagcaccctgaagaagagcctggagatcaaggaggagaagattgctgccctggaggcccggctggaggagagcaccaactacaaccagcagctgcggcaggagctgaagacagtgaagaagaactatgaggccctgaagcagaggcaggatgaggagaggatggtgcagagcagcccccccatcagcggggaggacaacaagtgggagcgggagagccaggagaccacccgggagctgctgaaggtgaaggaccggctgattgaggtggagagaaataatgccaccctgcaggccgagaagcaggccctgaagacccagctgaagcagctggagacccagaacaacaacctgcaggcccagatcctggccctgcagaggcagacagtgtccctgcaggagcagaacaccaccctgcagacccagaatgccaagctgcaggtggagaacagcaccctgaacagccagagcaccagcctgatgaaccagaatgcccagctgctgatccagcagagcagcctggagaatgaaaatgaatctgtcatcaaggagcgggaggacctgaagagcctgtatgacagcctcatcaaggaccacgagaagctggagctgctgcacgagcggcaggcctctgaatatgagagcctcatcagcaagcacggcaccctgaagagcgcccacaagaacctggaggtggagcaccgggacctggaggaccgctacaaccagctgctgaagcagaagggccagctggaggacctggagaagatgctgaaggtggagcaggagaagatgctgctggagaacaagaaccatgaaacagtggccgctgagtacaagaagctgtgtggggagaatgaccggctgaaccacacctacagccagctgctgaaggagacagaggtgctgcagacagaccacaagaacctgaagagcctgctgaacaacagcaagctggagcagacccggctggaggccgagttcagcaagctgaaggagcagtaccagcagctggacatcaccagcaccaagctgaacaaccagtgtgagctgctgagccagctgaagggcaacctggaggaggagaacagacacctgctggaccagatccagaccctgatgctgcagaacagaaccctgctggagcagaacatggagagcaaggacctcttccacgtggagcagaggcagtacatcgacaagctgaatgagctgcggcggcagaaggagaagctggaggagaagatcatggaccagtacaagttctatgaccccagcccccccaggagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagcagcaccatgaatgacctggtgcagagcatggtgctggccggccagtggacaggcagcacagagaacctggaggtgcctgatgacatcagcacaggcaagaggaggaaggagctgggcgccatggccttcagcaccacagccatcaacttcagcacagtgaacagcagcgctggcttccgcagcaagcagctggtgaacaacaaggacaccaccagctttgaggacatcagcccccagggcgtgtctgatgacagcagcacaggcagccgggtgcacgccagcaggcctgccagcctggacagcggccgcaccagcaccagcaacagcaacaacaatgccagcctgcacgaggtgaaggccggggctgtgaacaaccagagccggccccagagccacagcagtggagagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggcccggtctgtgtctgggaagacccctggggacttctatgacaggaggaccaccaagccagagttcctgcggcccggccccaggaagacagaggacacctacttcatcagcagcgctgggaagcccaccccaggcacccagggcaagatcaagctggtgaaggagagcagcctgagccggcagagcaaggacagcaacccctatgccaccctgccccgggccagcagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148025 - DNA, 5613 bp, Artificial Sequence
  Description of Artificial Sequence: Synthetic coding sequence
atggagaatgagatcttcacccccctgctggagcagttcatgaccagccccctggtgacctgggtgaagaccttcggccccctggccgctggaaatggcaccaacctggatgaatatgtggccctggtggatggagtcttcctgaaccaggtgatgctgcagatcaaccccaagctggagagccagagggtgaacaagaaggtgaacaatgatgccagcctgaggatgcacaacctgagcatcctggtgcggcagatcaagttctactaccaggagaccctgcagcagctgatcatgatgagcctgcccaacgtgctgatcatcggcaagaaccccttcagcgagcagggcacagaggaggtgaagaagctgctgctgctgctgctgggctgtgctgtgcagtgccagaagaaggaggagttcatcgagcgcatccagggcctggactttgacaccaaggctgctgtggccgcccacatccaggaggtgacccacaaccaggagaatgtgtttgacctgcagtggatggaggtgacagacatgagccaggaggacatcgagcccctgctgaagaacatggccctgcacctgaagaggctgattgatgaaagagatgagcacagcgagaccatcatcgagctgtctgaggagagagatggcctgcacttcctgccccacgccagcagcagcgcccagagcccctgtggcagccctggcatgaagaggacagagagccggcagcacctgtctgtggagctggctgatgccaaggccaagatccggcggctgcggcaggagctggaggagaagacagagcagctgctggactgcaagcaggagctggagcagatggagattgagctgaagaggctgcagcaggagaacatgaacctgctgagtgatgcccggagcgccaggatgtacagagatgagctggatgccctgcgggagaaggctgtgcgggtggacaagctggagagcgaggtgagccgctacaaggagcggctgcatgacatcgagttctacaaggcccgggtggaggagctgaaggaggacaaccaggtgctgctggagaccaagaccatgctggaggaccagctggagggcacccgggcccggagtgacaagctgcacgagctggagaaggagaacctgcagctgaaggccaagctgcatgacatggagatggagcgggacatggacaggaagaagattgaggagctgatggaggagaacatgaccctggagatggcccagaagcagagcatggatgagagcctgcacctgggctgggagctggagcagatcagcaggaccagcgagctgtctgaggccccccagaagagcctgggccacgaggtgaatgagctgaccagcagccggctgctgaagctggagatggagaaccagagcctgaccaagacagtggaggagctgcggaccaccgtggacagcgtggagggcaatgccagcaagatcctgaagatggagaaggagaaccagaggctgagcaagaaggtggagatcctggagaatgagatcgtgcaggagaagcagagcctgcagaactgccagaacctgagcaaggacctgatgaaggagaaggcccagctggagaagaccatcgagaccctgagagaaaattctgagcggcagatcaagatcctggagcaggagaatgagcacctgaaccagacagtgagcagcctgcggcagaggagccagatctctgctgaggcccgggtgaaggacatcgagaaggagaacaagatcctgcacgagagcatcaaggagaccagcagcaagctgagcaagattgaatttgagaagaggcagatcaagaaggagctggagcactacaaggagaagggggagagagctgaggagctggagaatgagctgcaccacctggagaaggaaaatgagctgctgcagaagaagatcaccaacctgaagatcacctgtgagaagattgaggccctggagcaggagaacagcgagctggagagagaaaataggaagctgaagaagaccctggacagcttcaagaacctgaccttccagctggagagcctggagaaggagaacagccagctggatgaggagaacctggagctgcggagaaatgtggagagcctgaagtgtgcctccatgaagatggcccagctgcagctggagaacaaggagctggagagcgagaaggagcagctgaagaagggcctggagctgctgaaggccagcttcaagaagacagagcggctggaggtgtcctaccagggcctggacatcgagaaccagaggctgcagaagaccctggagaacagcaacaagaagatccagcagctggagagcgagctgcaggacctggagatggagaaccagaccctgcagaagaacctggaggagctgaagatcagcagcaagaggctggagcagctggagaaggagaacaagagcctggagcaggagaccagccagctggagaaggacaagaagcagctggagaaggagaacaagaggctgcggcagcaggccgagatcaaggacaccaccctggaggagaacaacgtgaagattggcaacctggagaaggagaacaagaccctgagcaaggagatcggcatctacaaggagagctgtgtgcggctgaaggagctggagaaggagaacaaggagctggtgaagagggccaccatcgacatcaagaccctggtgaccctgcgggaggacctggtgtctgagaagctgaagacccagcagatgaacaatgacctggagaagctgacccatgagctggagaagattggcctgaacaaggagcggctgctgcatgatgagcagagcacagatgaccgctacaagctgctggagagcaagctggagagcaccctgaagaagagcctggagatcaaggaggagaagattgctgccctggaggcccggctggaggagagcaccaactacaaccagcagctgcggcaggagctgaagacagtgaagaagaactatgaggccctgaagcagaggcaggatgaggagaggatggtgcagagcagcccccccatctctggagaggacaacaagtgggagcgggagagccaggagaccacccgggagctgctgaaggtgaaggacaggctcatcgaggtggagaggaacaatgccaccctgcaggccgagaagcaggccctgaagacccagctgaagcagctggagacccagaacaacaacctgcaggcccagatcctggccctgcagaggcagacagtgtccctgcaggagcagaacaccaccctgcagacccagaatgccaagctgcaggtggagaacagcaccctgaacagccagagcaccagcctgatgaaccagaatgcccagctgctgatccagcagagcagcctggagaatgaaaatgaatctgtcatcaaggagcgggaggacctgaagagcctgtatgacagcctcatcaaggaccacgagaagctggagctgctgcacgagcggcaggcctctgaatatgagagcctcatcagcaagcacggcaccctgaagagcgcccacaagaacctggaggtggagcaccgggacctggaggaccgctacaaccagctgctgaagcagaagggccagctggaggacctggagaagatgctgaaggtggagcaggagaagatgctgctggagaacaagaaccacgagaccgtggccgctgagtacaagaagctgtgtggagaaaatgaccggctgaaccacacctacagccagctgctgaaggagacagaggtgctgcagacagaccacaagaacctgaagagcctgctgaacaacagcaagctggagcagacccggctggaggccgagttcagcaagctgaaggagcagtaccagcagctggacatcaccagcaccaagctgaacaaccagtgtgagctgctgagccagctgaagggcaacctggaggaggagaacagacacctgctggaccagatccagaccctgatgctgcagaacagaaccctgctggagcagaacatggagagcaaggacctcttccacgtggagcagaggcagtacatcgacaagctgaatgagctgcggcggcagaaggagaagctggaggagaagatcatggaccagtacaagttctatgaccccagccccccaagaagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagctccatggtggccctgaagaggctgcccttcctgaggaaccggcccaaggacaaggacaagatgaaggcctgctaccgccgctccatgtccatgaatgacctggtgcagagcatggtgctggccggccagtggacaggcagcacagagaacctggaggtgcctgatgacatcagcacaggcaagaggaggaaggagctgggcgccatggccttcagcaccacagccatcaacttcagcacagtgaacagcagcgctggcttccgcagcaagcagctggtgaacaacaaggacaccaccagctttgaggacatcagcccccagggcgtgtctgatgacagcagcacaggcagccgggtgcacgccagcaggcctgccagcctggacagcggccgcaccagcaccagcaacagcaacaacaatgccagcctgcacgaggtgaaggccggggctgtgaacaaccagagccggccccagagccacagcagcggggagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggcccggtctgtgtctgggaagacccctggggacttctatgacaggaggaccaccaagccagagttcctgcggcccggccccaggaagacagaggacacctacttcatcagcagcgctgggaagcccaccccaggcacccagggcaagatcaagctggtgaaggagagcagcctgagccggcagagcaaggacagcaacccctatgccaccctgccccgggccagcagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148026 - DNA, 2667 bp, Artificial Sequence
  Description of Artificial Sequence: Synthetic coding sequence
ctgctggagagcaagctggagagcaccctgaagaagagcctggagatcaaggaggagaagattgctgccctggaggcccggctggaggagagcaccaactacaaccagcagctgcggcaggagctgaagacagtgaagaagaactatgaggccctgaagcagaggcaggatgaggagaggatggtgcagagcagcccccccatctctggagaggacaacaagtgggagcgggagagccaggagaccacccgggagctgctgaaggtgaaggacaggctcatcgaggtggagaggaacaatgccaccctgcaggccgagaagcaggccctgaagacccagctgaagcagctggagacccagaacaacaacctgcaggcccagatcctggccctgcagaggcagacagtgtccctgcaggagcagaacaccaccctgcagacccagaatgccaagctgcaggtggagaacagcaccctgaacagccagagcaccagcctgatgaaccagaatgcccagctgctgatccagcagagcagcctggagaatgaaaatgaatctgtcatcaaggagcgggaggacctgaagagcctgtatgacagcctcatcaaggaccacgagaagctggagctgctgcacgagcggcaggcctctgaatatgagagcctcatcagcaagcacggcaccctgaagagcgcccacaagaacctggaggtggagcaccgggacctggaggaccgctacaaccagctgctgaagcagaagggccagctggaggacctggagaagatgctgaaggtggagcaggagaagatgctgctggagaacaagaaccacgagaccgtggccgctgagtacaagaagctgtgtggagaaaatgaccggctgaaccacacctacagccagctgctgaaggagacagaggtgctgcagacagaccacaagaacctgaagagcctgctgaacaacagcaagctggagcagacccggctggaggccgagttcagcaagctgaaggagcagtaccagcagctggacatcaccagcaccaagctgaacaaccagtgtgagctgctgagccagctgaagggcaacctggaggaggagaacagacacctgctggaccagatccagaccctgatgctgcagaacagaaccctgctggagcagaacatggagagcaaggacctcttccacgtggagcagaggcagtacatcgacaagctgaatgagctgcggcggcagaaggagaagctggaggagaagatcatggaccagtacaagttctatgaccccagccccccaagaagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagcagcaccatgaatgacctggtgcagagcatggtgctggccggccagtggacaggcagcacagagaacctggaggtgcctgatgacatcagcacaggcaagaggaggaaggagctgggcgccatggccttcagcaccacagccatcaacttcagcacagtgaacagcagcgctggcttccgcagcaagcagctggtgaacaacaaggacaccaccagctttgaggacatcagcccccagggcgtgtctgatgacagcagcacaggcagccgggtgcacgccagcaggcctgccagcctggacagcggccgcaccagcaccagcaacagcaacaacaatgccagcctgcacgaggtgaaggccggggctgtgaacaaccagagccggccccagagccacagcagcggggagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggcccggtctgtgtctgggaagacccctggggacttctatgacaggaggaccaccaagccagagttcctgcggcccggccccaggaagacagaggacacctacttcatcagcagcgctgggaagcccaccccaggcacccagggcaagatcaagctggtgaaggagagcagcctgagccggcagagcaaggacagcaacccctatgccaccctgccccgggccagcagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148027 - DNA, 5391 bp, Artificial Sequence
  Description of Artificial Sequence: Synthetic coding sequence
atggagaatgagatcttcacccccctgctggagcagttcatgaccagccccctggtgacctgggtgaagaccttcggccccctggccgctggaaatggcaccaacctggatgaatatgtggccctggtggatggagtcttcctgaaccaggtgatgctgcagatcaaccccaagctggagagccagagggtgaacaagaaggtgaacaatgatgccagcctgaggatgcacaacctgagcatcctggtgcggcagatcaagttctactaccaggagaccctgcagcagctgatcatgatgagcctgcccaacgtgctgatcatcggcaagaaccccttcagcgagcagggcacagaggaggtgaagaagctgctgctgctgctgctgggctgtgctgtgcagtgccagaagaaggaggagttcatcgagcgcatccagggcctggactttgacaccaaggctgctgtggccgcccacatccaggaggtgacccacaaccaggagaatgtgtttgacctgcagtggatggaggtgacagacatgagccaggaggacatcgagcccctgctgaagaacatggccctgcacctgaagaggctgattgatgaaagagatgagcacagcgagaccatcatcgagctgtctgaggagagagatggcctgcacttcctgccccacgccagcagcagcgcccagagcccctgtggcagccctggcatgaagaggacagagagccggcagcacctgtctgtggagctggctgatgccaaggccaagatccggcggctgcggcaggagctggaggagaagacagagcagctgctggactgcaagcaggagctggagcagatggagattgagctgaagaggctgcagcaggagaacatgaacctgctgagtgatgcccggagcgccaggatgtacagagatgagctggatgccctgcgggagaaggctgtgcgggtggacaagctggagagcgaggtgagccgctacaaggagcggctgcatgacatcgagttctacaaggcccgggtggaggagctgaaggaggacaaccaggtgctgctggagaccaagaccatgctggaggaccagctggagggcacccgggcccggagtgacaagctgcacgagctggagaaggagaacctgcagctgaaggccaagctgcatgacatggagatggagcgggacatggacaggaagaagattgaggagctgatggaggagaacatgaccctggagatggcccagaagcagagcatggatgagagcctgcacctgggctgggagctggagcagatcagcaggaccagcgagctgtctgaggccccccagaagagcctgggccacgaggtgaatgagctgaccagcagccggctgctgaagctggagatggagaaccagagcctgaccaagacagtggaggagctgcggaccaccgtggacagcgtggagggcaatgccagcaagatcctgaagatggagaaggagaaccagaggctgagcaagaaggtggagatcctggagaatgagatcgtgcaggagaagcagagcctgcagaactgccagaacctgagcaaggacctgatgaaggagaaggcccagctggagaagaccatcgagaccctgagagaaaattctgagcggcagatcaagatcctggagcaggagaatgagcacctgaaccagacagtgagcagcctgcggcagaggagccagatctctgctgaggcccgggtgaaggacatcgagaaggagaacaagatcctgcacgagagcatcaaggagaccagcagcaagctgagcaagattgaatttgagaagaggcagatcaagaaggagctggagcactacaaggagaagggggagagagctgaggagctggagaatgagctgcaccacctggagaaggaaaatgagctgctgcagaagaagatcaccaacctgaagatcacctgtgagaagattgaggccctggagcaggagaacagcgagctggagagagaaaataggaagctgaagaagaccctggacagcttcaagaacctgaccttccagctggagagcctggagaaggagaacagccagctggatgaggagaacctggagctgcggagaaatgtggagagcctgaagtgtgcctccatgaagatggcccagctgcagctggagaacaaggagctggagagcgagaaggagcagctgaagaagggcctggagctgctgaaggccagcttcaagaagacagagcggctggaggtgtcctaccagggcctggacatcgagaaccagaggctgcagaagaccctggagaacagcaacaagaagatccagcagctggagagcgagctgcaggacctggagatggagaaccagaccctgcagaagaacctggaggagctgaagatcagcagcaagaggctggagcagctggagaaggagaacaagagcctggagcaggagaccagccagctggagaaggacaagaagcagctggagaaggagaacaagaggctgcggcagcaggccgagatcaaggacaccaccctggaggagaacaacgtgaagattggcaacctggagaaggagaacaagaccctgagcaaggagatcggcatctacaaggagagctgtgtgcggctgaaggagctggagaaggagaacaaggagctggtgaagagggccaccatcgacatcaagaccctggtgaccctgcgggaggacctggtgtctgagaagctgaagacccagcagatgaacaatgacctggagaagctgacccatgagctggagaagattggcctgaacaaggagcggctgctgcatgatgagcagagcacagatgaccgctacaagctgctggagagcaagctggagagcaccctgaagaagagcctggagatcaaggaggagaagattgctgccctggaggcccggctggaggagagcaccaactacaaccagcagctgcggcaggagctgaagacagtgaagaagaactatgaggccctgaagcagaggcaggatgaggagaggatggtgcagagcagcccccccatctctggagaggacaacaagtgggagcgggagagccaggagaccacccgggagctgctgaaggtgaaggacaggctcatcgaggtggagaggaacaatgccaccctgcaggccgagaagcaggccctgaagacccagctgaagcagctggagacccagaacaacaacctgcaggcccagatcctggccctgcagaggcagacagtgtccctgcaggagcagaacaccaccctgcagacccagaatgccaagctgcaggtggagaacagcaccctgaacagccagagcaccagcctgatgaaccagaatgcccagctgctgatccagcagagcagcctggagaatgaaaatgaatctgtcatcaaggagcgggaggacctgaagagcctgtatgacagcctcatcaaggaccacgagaagctggagctgctgcacgagcggcaggcctctgaatatgagagcctcatcagcaagcacggcaccctgaagagcgcccacaagaacctggaggtggagcaccgggacctggaggaccgctacaaccagctgctgaagcagaagggccagctggaggacctggagaagatgctgaaggtggagcaggagaagatgctgctggagaacaagaaccacgagaccgtggccgctgagtacaagaagctgtgtggagaaaatgaccggctgaaccacacctacagccagctgctgaaggagacagaggtgctgcagacagaccacaagaacctgaagagcctgctgaacaacagcaagctggagcagacccggctggaggccgagttcagcaagctgaaggagcagtaccagcagctggacatcaccagcaccaagctgaacaaccagtgtgagctgctgagccagctgaagggcaacctggaggaggagaacagacacctgctggaccagatccagaccctgatgctgcagaacagaaccctgctggagcagaacatggagagcaaggacctcttccacgtggagcagaggcagtacatcgacaagctgaatgagctgcggcggcagaaggagaagctggaggagaagatcatggaccagtacaagttctatgaccccagccccccaagaagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagctccatggtggccctgaagaggctgcccttcctgaggaaccggcccaaggacaaggacaagatgaaggcctgctaccgccgctccatgtccatgaatgacctggtgcagagcatggtgctggccggccagtggacaggcagcacagagaacctggaggtgcctgatgacatcagcacaggcaagaggaggaaggagctgggcgccatggccttcagcaccacagccatcaacttcagcacagtgaacagcagcgctggcttccgcagcaagcagctggtgaacaacaaggacaccaccagctttgaggacatcagcccccagggcgtgtctgatgacagcagcacaggcagccgggtgcacgccagcaggcctgccagcctggacagcggccgcaccagcaccagcaacagcaacaacaatgccagcctgcacgaggtgaaggccggggctgtgaacaaccagagccggccccagagccacagcagcggggagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggccagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148028 - DNA, 1119 bp, Artificial Sequence
  Description of Artificial Sequence: Synthetic coding sequence
atggaccagtacaagttctatgaccccagccccccaagaagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagcagcaacaccaccagctttgaggacatcagcccccagggcgtgtctgatgacagcagcacaggcagccgggtgcacgccggggctgtgaacaaccagagccggccccagagccacagcagcggggagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggcccggtctgtgtctgggaagacccctggggacttctatgacaggaggaccaccaagccagagttcctgcggcccggccccaggaagacagaggacacctacttcatcagcagcgctgggaagcccaccccaggcacccagggcaagatcaagctggtgaaggagagcagcctgagccggcagagcaaggacagcaacccctatgccaccctgccccgggccagcagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148029 - DNA, 5616 bp, Artificial Sequence
  Description of Artificial Sequence: Synthetic coding sequence
atggagaatgagatcttcacccccctgctggagcagttcatgaccagccccctggtgacctgggtgaagaccttcggccccctggccgctggaaatggcaccaacctggatgaatatgtggccctggtggatggagtcttcctgaaccaggtgatgctgcagatcaaccccaagctggagagccagagggtgaacaagaaggtgaacaatgatgccagcctgaggatgcacaacctgagcatcctggtgcggcagatcaagttctactaccaggagaccctgcagcagctgatcatgatgagcctgcccaacgtgctgatcatcggcaagaaccccttcagcgagcagggcacagaggaggtgaagaagctgctgctgctgctgctgggctgtgctgtgcagtgccagaagaaggaggagttcatcgagcgcatccagggcctggactttgacaccaaggctgctgtggccgcccacatccaggaggtgacccacaaccaggagaatgtgtttgacctgcagtggatggaggtgacagacatgagccaggaggacatcgagcccctgctgaagaacatggccctgcacctgaagaggctgattgatgaaagagatgagcacagcgagaccatcatcgagctgtctgaggagagagatggcctgcacttcctgccccacgccagcagcagcgcccagagcccctgtggcagccctggcatgaagaggacagagagccggcagcacctgtctgtggagctggctgatgccaaggccaagatccggcggctgcggcaggagctggaggagaagacagagcagctgctggactgcaagcaggagctggagcagatggagattgagctgaagaggctgcagcaggagaacatgaacctgctgagtgatgcccggagcgccaggatgtacagagatgagctggatgccctgcgggagaaggctgtgcgggtggacaagctggagagcgaggtgagccgctacaaggagcggctgcatgacatcgagttctacaaggcccgggtggaggagctgaaggaggacaaccaggtgctgctggagaccaagaccatgctggaggaccagctggagggcacccgggcccggagtgacaagctgcacgagctggagaaggagaacctgcagctgaaggccaagctgcatgacatggagatggagcgggacatggacaggaagaagattgaggagctgatggaggagaacatgaccctggagatggcccagaagcagagcatggatgagagcctgcacctgggctgggagctggagcagatcagcaggaccagcgagctgtctgaggccccccagaagagcctgggccacgaggtgaatgagctgaccagcagccggctgctgaagctggagatggagaaccagagcctgaccaagacagtggaggagctgcggaccaccgtggacagcgtggagggcaatgccagcaagatcctgaagatggagaaggagaaccagaggctgagcaagaaggtggagatcctggagaatgagatcgtgcaggagaagcagagcctgcagaactgccagaacctgagcaaggacctgatgaaggagaaggcccagctggagaagaccatcgagaccctgagagaaaattctgagcggcagatcaagatcctggagcaggagaatgagcacctgaaccagacagtgagcagcctgcggcagaggagccagatctctgctgaggcccgggtgaaggacatcgagaaggagaacaagatcctgcacgagagcatcaaggagaccagcagcaagctgagcaagattgaatttgagaagaggcagatcaagaaggagctggagcactacaaggagaagggggagagagctgaggagctggagaatgagctgcaccacctggagaaggaaaatgagctgctgcagaagaagatcaccaacctgaagatcacctgtgagaagattgaggccctggagcaggagaacagcgagctggagagagaaaataggaagctgaagaagaccctggacagcttcaagaacctgaccttccagctggagagcctggagaaggagaacagccagctggatgaggagaacctggagctgcggagaaatgtggagagcctgaagtgtgcctccatgaagatggcccagctgcagctggagaacaaggagctggagagcgagaaggagcagctgaagaagggcctggagctgctgaaggccagcttcaagaagacagagcggctggaggtgtcctaccagggcctggacatcgagaaccagaggctgcagaagaccctggagaacagcaacaagaagatccagcagctggagagcgagctgcaggacctggagatggagaaccagaccctgcagaagaacctggaggagctgaagatcagcagcaagaggctggagcagctggagaaggagaacaagagcctggagcaggagaccagccagctggagaaggacaagaagcagctggagaaggagaacaagaggctgcggcagcaggccgagatcaaggacaccaccctggaggagaacaacgtgaagattggcaacctggagaaggagaacaagaccctgagcaaggagatcggcatctacaaggagagctgtgtgcggctgaaggagctggagaaggagaacaaggagctggtgaagagggccaccatcgacatcaagaccctggtgaccctgcgggaggacctggtgtctgagaagctgaagacccagcagatgaacaatgacctggagaagctgacccatgagctggagaagattggcctgaacaaggagcggctgctgcatgatgagcagagcacagatgacagccgctacaagctgctggagagcaagctggagagcaccctgaagaagagcctggagatcaaggaggagaagattgctgccctggaggcccggctggaggagagcaccaactacaaccagcagctgcggcaggagctgaagacagtgaagaagaactatgaggccctgaagcagaggcaggatgaggagaggatggtgcagagcagcccccccatcagcggggaggacaacaagtgggagcgggagagccaggagaccacccgggagctgctgaaggtgaaggaccggctgattgaggtggagagaaataatgccaccctgcaggccgagaagcaggccctgaagacccagctgaagcagctggagacccagaacaacaacctgcaggcccagatcctggccctgcagaggcagacagtgtccctgcaggagcagaacaccaccctgcagacccagaatgccaagctgcaggtggagaacagcaccctgaacagccagagcaccagcctgatgaaccagaatgcccagctgctgatccagcagagcagcctggagaatgaaaatgaatctgtcatcaaggagcgggaggacctgaagagcctgtatgacagcctcatcaaggaccacgagaagctggagctgctgcacgagcggcaggcctctgaatatgagagcctcatcagcaagcacggcaccctgaagagcgcccacaagaacctggaggtggagcaccgggacctggaggaccgctacaaccagctgctgaagcagaagggccagctggaggacctggagaagatgctgaaggtggagcaggagaagatgctgctggagaacaagaaccatgaaacagtggccgctgagtacaagaagctgtgtggggagaatgaccggctgaaccacacctacagccagctgctgaaggagacagaggtgctgcagacagaccacaagaacctgaagagcctgctgaacaacagcaagctggagcagacccggctggaggccgagttcagcaagctgaaggagcagtaccagcagctggacatcaccagcaccaagctgaacaaccagtgtgagctgctgagccagctgaagggcaacctggaggaggagaacagacacctgctggaccagatccagaccctgatgctgcagaacagaaccctgctggagcagaacatggagagcaaggacctcttccacgtggagcagaggcagtacatcgacaagctgaatgagctgcggcggcagaaggagaagctggaggagaagatcatggaccagtacaagttctatgaccccagcccccccaggagaagaggcaactggatcaccctgaagatgaggaagctgatcaagagcaagaaggacatcaaccgggagcggcagaagagcctgaccctgacccccaccaggagtgacagcagcgagggcttcctgcagctgccccaccaggacagccaggacagcagctctgtgggcagcaacagcctggaggatggccagaccctgggcaccaagaagagctccatggtggccctgaagaggctgcccttcctgaggaaccggcccaaggacaaggacaagatgaaggcctgctacagaagatccatgtccatgaatgacctggtgcagagcatggtgctggccggccagtggacaggcagcacagagaacctggaggtgcctgatgacatcagcacaggcaagaggaggaaggagctgggcgccatggccttcagcaccacagccatcaacttcagcacagtgaacagcagcgctggcttccgcagcaagcagctggtgaacaacaaggacaccaccagctttgaggacatcagcccccagggcgtgtctgatgacagcagcacaggcagccgggtgcacgccagcaggcctgccagcctggacagcggccgcaccagcaccagcaacagcaacaacaatgccagcctgcacgaggtgaaggccggggctgtgaacaaccagagccggccccagagccacagcagtggagagttcagcctgctgcatgaccacgaggcctggagcagcagcggcagcagccccatccagtacctgaagaggcagaccaggagcagccctgtgctgcagcacaagatcagcgagaccctggagagccgccaccacaagatcaagacaggcagccctggcagcgaggtggtgaccctgcagcagttcctggaggagagcaacaagctgacctctgtgcagatcaagagcagcagccaggagaacctgctggatgaggtgatgaagagcctgtctgtgtccagtgacttcctgggcaaggacaagcctgtgtcctgtggcctggcccggtctgtgtctgggaagacccctggggacttctatgacaggaggaccaccaagccagagttcctgcggcccggccccaggaagacagaggacacctacttcatcagcagcgctgggaagcccaccccaggcacccagggcaagatcaagctggtgaaggagagcagcctgagccggcagagcaaggacagcaacccctatgccaccctgccccgggccagcagcgtcatcagcacagctgagggcaccaccaggaggaccagcatccatgacttcctgaccaaggacagccggctgcccatctctgtggacagccccccagctgctgctgacagcaacaccacagctgccagcaatgtggacaaggtgcaggagagcaggaacagcaagagccgcagccgggagcagcagagcagctag

SEQ ID NO: 148030 - DNA, 420 bp, Artificial Sequence
  Description of Artificial Sequence: Synthetic coding sequence
atgccctgtgccgcccggagccgcagctcctggaggaggtcctggaccaacacagcctgctggagcctgtgcccctgccccggccccaggagccccagccctgcccccatgaggcgggcccagagcagcctgtgcctgagagatgagaccctggccggcggccagaggaggaagctgagcagccgcttccctgtgggccgcagcagcgagagcttcagccctggggacaccccccggcagcgcttccggcagaggcaccctggccccctgggcgcccctgtgagccacagcaagggccctggggtgggctgggagaacagcgctgagaccctgcaggagcacgagacagatgccaaccgggagggccctgaggtgcaggagcctgagaagaggcccctgacccccagcctgagccagtag

SEQ ID NO: 148031 - DNA, 4431 bp, Artificial Sequence
  Description of Artificial Sequence: Synthetic coding sequence
atggagggcggcaagggcccccggctgcgggacttcctgagcggcagcctggccacctgggccctgggcctggccggcctggtgggggaggccgaggacagcgagggggaggaggaggaggaggaggaggagccccccctgtggctggagaagcgcttcctgcggctgagtgatggagccctgctgctgcgggtgctgggcatcatcgcccccagcagcagaggaggccccaggatgctgcggggcctggatggccctgctgcctggagggtgtggaacctgaaccacctgtggggccgcctgcgggacttctaccaggaggagctgcagctgctgatcctgagccccccaccagacctgcagaccctgggctttgaccccctgtctgaggaggccgtggagcagctggagggcgtgctgcggctgctgctgggcgcctctgtgcagtgtgagcaccgggagctgttcatccgccacatccagggcctgagcctggaggtgcagagcgagctggccgccgccatccaggaggtgacccagcctggagctggggtggtgctggccctgagcggccctgaccccggggagctggccccagctgagctggagatgctgagccgcagcctgatgggcaccctgagcaagctggcccgggagcgggacctgggcgcccagaggctggccgagctgctgctggagcgggagcccctgtgcctgcggcctgaggcccccagccgggccccagctgagggccccagccaccacctggccctgcagctggccaatgccaaggcccagctgcggcggctgcggcaggagctggaggagaaggccgagctgctgctggacagccaggccgaggtgcagggcctggaggccgagatccggcggctgcggcaggaggcccaggccctgagcggccaggccaagagagctgagctgtaccgggaggaggccgaggccctgcgggagcgggccggccgcctgccccggctgcaggaggagctgcggcgctgccgggagcggctgcaggccgctgaggcctacaagagccagctggaggaggagcgggtgctgagcggcgtgctggaggccagcaaggccctgctggaggagcagctggaggccgcccgggagcgctgtgcccggctgcacgagacccagcgggagaacctgctgctgcggacccggctgggggaggcccatgctgagctggacagcctgcggcaccaggtggaccagctggccgaggagaatgtggagctggagctggagctgcagaggagcctggagcccccacctggcagccctggagaggcccccctggccggggccgcccccagcctgcaggatgaggtgcgggaggccgaggccggccgcctgcggaccctggagagagaaaatcgggagctgcggggcctgctgcaggtgctgcagggccagcccggcggccagcaccccctgctggaggccccccgggaggaccctgtgctgcctgtgctggaggaggccccccagacccctgtggcctttgaccacagcccccagggcctggtgcagaaggccagagatggcggcccccaggccctggacctggcccccccagccctggacagcgtgctggaggccagcgctgagtgcccccaggccccagacagcgacccccaggaggccgagagccccctgcaggccgccgccatggacccccaggccagtgactggagcccccaggagagcggcagccctgtggagacccaggagagccctgagaaggccggccgccgcagcagcctgcagagccctgcctctgtggccccaccccagggccctggcaccaagatccaggccccccagctgctgggcggggagacagagggccgggaggccccccagggcgagctggtgcctgaggcctggggcctgcggcaggagggccctgagcacaagccaggccccagcgagcccagctctgtgcagctggaggagcaggagggccccaaccagggcctggacctggccaccggccaggccgaggcccgggagcatgaccagaggctggagggcaccgtgcgggaccctgcctggcagaagccccagcagaagtctgagggcgccctggaggtgcaggtgtgggagggccccatccctggagagagcctggccagcggcgtggccgagcaggaggccctgcgggaggaggtggcccagctgcggaggaaggccgaggccctgggagatgagctggaggcccaggccaggaagctggaggcccagaacacagaggccgcccggctgagcaaggagctggcccaggccaggagagctgaggccgaggcccaccgggaggccgaggcccaggcctgggagcaggcccggctgcgggaggccgtggaggccgccggccaggagctggagagcgccagccaggagcgggaggccctggtggaggccctggccgctgctggccgggagcggcggcagtgggagcgggagggcagccggctgcgggcccagagcgaggccgctgaggagaggatgcaggtgctggagagcgagggccggcagcacctggaggaggccgagcgggagcggcgggagaaggaggccctgcaggccgagctggagaaggctgtggtgcggggcaaggagctgggggaccggctggagcacctgcagcgggagctggagcaggccgccctggagcggcaggagttcctgcgggagaaggagagccagcaccagcgctaccagggcctggagcagaggctggaggccgagctgcaggccgccgccaccagcaaggaggaggccctgatggagctgaagacccgggccctgcagctggaggaggagctgttccagctgcggcagggccctgctggcctgggccccaagaagagagctgagccccagctggtggagacccagaatgtgcggctgattgaggtggagaggagcaatgccatgctggtggccgagaaggccgccctgcagggccagctgcagcacctggagggccagctgggcagcctgcagggccgggcccaggagctgctgctgcagagccagagggcccaggagcacagcagccggctgcaggccgagaagtctgtgctggagatccagggccaggagctgcacaggaagctggaggtgctggaggaggaggtgcgggccgcccggcagagccaggaggagacccggggccagcagcaggccctgctgcgggaccacaaggccctggcccagctgcagaggcggcaggaggccgagctggagggcctgctggtgcgccaccgggacctgaaggccaacatgagggccctggagctggcccaccgggagctgcagggcagacatgagcagctgcaggcccagagggcctctgtggaggcccaggaggtggccctgctggccgagcgggagcggctgatgcaggacggccaccggcagaggggcctggaggaggagctgcggcggctgcagagcgagcatgaccgggcccagatgctgctggccgagctgagccgggagcggggggagctgcagggcgagcggggggagctgcggggccgcctggcccggctggagctggagcgggcccagctggagatgcagagccagcagctgcgggagagcaaccagcagctggacctgagcgcctgccgcctgaccacccagtgtgagctgctgacccagctgcggagcgcccaggaggaggagaaccggcagctgctggccgaggtgcaggccctgagcagagaaaatcgggagctgctggagaggagcctggagagccgggaccacctgcaccgggagcagcgggagtacctggaccagctgaatgccctgcggcgggagaagcagaagctggtggagaagatcatggaccagtacagagtgctggagcctgtgcccctgcccaggaccaagaagggctcctggctggccgacaaggtgaagaggctgatgaggccccggcgggagggcggccccccaggcggcctgcggctgggcgcagatggagctggcagcacagagagcctgggcggccccccagagacagagctgcctgagggccgggaggctgatggcaccggcagccccagccctgcccccatgagaagagcccagagcagcctgtgcctgagagatgagaccctggccggcggccagaggaggaagctgagcagccgcttccctgtgggccgcagcagcgagagcttcagccctggggacaccccccggcagcgcttccggcagaggcaccctggccccctgggcgcccctgtgagccacagcaaaggacctggggtgggctgggagaacagcgctgagaccctgcaggagcatgaaacagatgccaaccgggagggccctgaggtgcaggagcctgagaagaggcccctgacccccagcctgagccagtag

SEQ ID NO: 148032 - DNA, 2139 bp, Artificial Sequence
  Description of Artificial Sequence: Synthetic coding sequence
atggccggcgtggccgcccaccgggcccacccccccttcaccgcccacatgaagaacagaggcctgcgggaggagctggagaaggctgtggtgcggggcaaggagctgggggaccggctggagcacctgcagcgggagctggagcaggccgccctggagcggcaggagttcctgcgggagaaggagagccagcaccagcgctaccagggcctggagcagaggctggaggccgagctgcaggccgccgccaccagcaaggaggaggccctgatggagctgaagacccgggccctgcagctggaggaggagctgttccagctgcggcagggccctgctggcctgggccccaagaagagagctgagccccagctggtggagacccagaatgtgcggctgattgaggtggagaggagcaatgccatgctggtggccgagaaggccgccctgcagggccagctgcagcacctggagggccagctgggcagcctgcagggccgggcccaggagctgctgctgcagagccagagggcccaggagcacagcagccggctgcaggccgagaagtctgtgctggagatccagggccaggagctgcacaggaagctggaggtgctggaggaggaggtgcgggccgcccggcagagccaggaggagacccggggccagcagcaggccctgctgcgggaccacaaggccctggcccagctgcagaggcggcaggaggccgagctggagggcctgctggtgcgccaccgggacctgaaggccaacatgagggccctggagctggcccaccgggagctgcagggcagacatgagcagctgcaggcccagagggcctctgtggaggcccaggaggtggccctgctggccgagcgggagcggctgatgcaggacggccaccggcagaggggcctggaggaggagctgcggcggctgcagagcgagcatgaccgggcccagatgctgctggccgagctgagccgggagcggggggagctgcagggcgagcggggggagctgcggggccgcctggcccggctggagctggagcgggcccagctggagatgcagagccagcagctgcgggagagcaaccagcagctggacctgagcgcctgccgcctgaccacccagtgtgagctgctgacccagctgcggagcgcccaggaggaggagaaccggcagctgctggccgaggtgcaggccctgagcagagaaaatcgggagctgctggagaggagcctggagagccgggaccacctgcaccgggagcagcgggagtacctggaccagctgaatgccctgcggcgggagaagcagaagctggtggagaagatcatggaccagtacagagtgctggagcctgtgcccctgcccaggaccaagaagggctcctggctggccgacaagggccccctgcccaggcacccctgtgccggcccccgggcccccagcgcctgtggcatgaggccctggcaggccggcagcggcggcaacagcgcccagggcagccgctggggcgaggccctgagccacagcgccctgggcacccccctgggcaatgacagcgacagcgccatccaggccccctggggccggcccagccccacagccaaggacctggtgtgggatggccgcacccccctgcggccctgcaggaacaccaagcagatgcccacagagcgggccctgcgctacagaaacagaagaaatgtgcccagcccccaccccagcgccagtgacacagtgggcacagctggcctgggcgtgcagcccagccgccactggagcgtgtctgggggcccccggcagcccaagagcagcggcagccagggcccccagggcgagagcctggacaaggaggcctgggccctgcggagcagcacagtgtctgctggggcccggcgctggagctgggatgaatgtgtggacagaggagatggctggccaccccgggccgcccctggctggagcagcggcagcagccgctggctgcccctgcggcagaggagcctgggggaccccccagctgagggcggctggcaggagctggcccgggagcccccagccctgagccgctgggaggccgagagccagtgctggggcaccgtggcctgggccgacctggagccctag

SEQ ID NO: 148033 - DNA, 4077 bp, Artificial Sequence
  Description of Artificial Sequence: Synthetic coding sequence
atggagggcggcaagggcccccggctgcgggacttcctgagcggcagcctggccacctgggccctgggcctggccggcctggtgggggaggccgaggacagcgagggggaggaggaggaggaggaggaggagccccccctgtggctggagaagcgcttcctgcggctgagtgatggagccctgctgctgcgggtgctgggcatcatcgcccccagcagcagaggaggccccaggatgctgcggggcctggatggccctgctgcctggagggtgtggaacctgaaccacctgtggggccgcctgcgggacttctaccaggaggagctgcagctgctgatcctgagccccccaccagacctgcagaccctgggctttgaccccctgtctgaggaggccgtggagcagctggagggcgtgctgcggctgctgctgggcgcctctgtgcagtgtgagcaccgggagctgttcatccgccacatccagggcctgagcctggaggtgcagagcgagctggccgccgccatccaggaggtgacccagcctggagctggggtggtgctggccctgagcggccctgaccccggggagctggccccagctgagctggagatgctgagccgcagcctgatgggcaccctgagcaagctggcccgggagcgggacctgggcgcccagaggctggccgagctgctgctggagcgggagcccctgtgcctgcggcctgaggcccccagccgggccccagctgagggccccagccaccacctggccctgcagctggccaatgccaaggcccagctgcggcggctgcggcaggagctggaggagaaggccgagctgctgctggacagccaggccgaggtgcagggcctggaggccgagatccggcggctgcggcaggaggcccaggccctgagcggccaggccaagagagctgagctgtaccgggaggaggccgaggccctgcgggagcgggccggccgcctgccccggctgcaggaggagctgcggcgctgccgggagcggctgcaggccgctgaggcctacaagagccagctggaggaggagcgggtgctgagcggcgtgctggaggccagcaaggccctgctggaggagcagctggaggccgcccgggagcgctgtgcccggctgcacgagacccagcgggagaacctgctgctgcggacccggctgggggaggcccatgctgagctggacagcctgcggcaccaggtggaccagctggccgaggagaatgtggagctggagctggagctgcagaggagcctggagcccccacctggcagccctggagaggcccccctggccggggccgcccccagcctgcaggatgaggtgcgggaggccgaggccggccgcctgcggaccctggagagagaaaatcgggagctgcggggcctgctgcaggtgctgcagggccagcccggcggccagcaccccctgctggaggccccccgggaggaccctgtgctgcctgtgctggaggaggccccccagacccctgtggcctttgaccacagcccccagggcctggtgcagaaggccagagatggcggcccccaggccctggacctggcccccccagccctggacagcgtgctggaggccagcgctgagtgcccccaggccccagacagcgacccccaggaggccgagagccccctgcaggccgccgccatggacccccaggccagtgactggagcccccaggagagcggcagccctgtggagacccaggagagccctgagaaggccggccgccgcagcagcctgcagagccctgcctctgtggccccaccccagggccctggcaccaagatccaggccccccagctgctgggcggggagacagagggccgggaggccccccagggcgagctggtgcctgaggcctggggcctgcggcaggagggccctgagcacaagccaggccccagcgagcccagctctgtgcagctggaggagcaggagggccccaaccagggcctggacctggccaccggccaggccgaggcccgggagcatgaccagaggctggagggcaccgtgcgggaccctgcctggcagaagccccagcagaagtctgagggcgccctggaggtgcaggtgtgggagggccccatccctggagagagcctggccagcggcgtggccgagcaggaggccctgcgggaggaggtggcccagctgcggaggaaggccgaggccctgggagatgagctggaggcccaggccaggaagctggaggcccagaacacagaggccgcccggctgagcaaggagctggcccaggccaggagagctgaggccgaggcccaccgggaggccgaggcccaggcctgggagcaggcccggctgcgggaggccgtggaggccgccggccaggagctggagagcgccagccaggagcgggaggccctggtggaggccctggccgctgctggccgggagcggcggcagtgggagcgggagggcagccggctgcgggcccagagcgaggccgctgaggagaggatgcaggtgctggagagcgagggccggcagcacctggaggaggccgagcgggagcggcgggagaaggaggccctgcaggccgagctggagaaggctgtggtgcggggcaaggagctgggggaccggctggagcacctgcagcgggagctggagcaggccgccctggagcggcaggagttcctgcgggagaaggagagccagcaccagcgctaccagggcctggagcagaggctggaggccgagctgcaggccgccgccaccagcaaggaggaggccctgatggagctgaagacccgggccctgcagctggaggaggagctgttccagctgcggcagggccctgctggcctgggccccaagaagagagctgagccccagctggtggagacccagaatgtgcggctgattgaggtggagaggagcaatgccatgctggtggccgagaaggccgccctgcagggccagctgcagcacctggagggccagctgggcagcctgcagggccgggcccaggagctgctgctggccgagcgggagcggctgatgcaggacggccaccggcagaggggcctggaggaggagctgcggcggctgcagagcgagcatgaccgggcccagatgctgctggccgagctgagccgggagcggggggagctgcagggcgagcggggggagctgcggggccgcctggcccggctggagctggagcgggcccagctggagatgcagagccagcagctgcgggagagcaaccagcagctggacctgagcgcctgccgcctgaccacccagtgtgagctgctgacccagctgcggagcgcccaggaggaggagaaccggcagctgctggccgaggtgcaggccctgagcagagaaaatcgggagctgctggagaggagcctggagagccgggaccacctgcaccgggagcagcgggagtacctggaccagctgaatgccctgcggcgggagaagcagaagctggtggagaagatcatggaccagtacagagtgctggagcctgtgcccctgcccaggaccaagaagggctcctggctggccgacaaggtgaagaggctgatgaggccccggcgggagggcggccccccaggcggcctgcggctgggcgcagatggagctggcagcacagagagcctgggcggccccccagagacagagctgcctgagggccgggaggctgatggcaccggcagccccagccctgcccccatgagaagagcccagagcagcctgtgcctgagagatgagaccctggccggcggccagaggaggaagctgagcagccgcttccctgtgggccgcagcagcgagagcttcagccctggggacaccccccggcagcgcttccggcagaggcaccctggccccctgggcgcccctgtgagccacagcaaaggacctggggtgggctgggagaacagcgctgagaccctgcaggagcatgaaacagatgccaaccgggagggccctgaggtgcaggagcctgagaagaggcccctgacccccagcctgagccagtag

SEQ ID NO: 148034 - DNA, 684 bp, Artificial Sequence
  Description of Artificial Sequence: Synthetic coding sequence
atgggcggcaccaccagcacccggcgggtgacctttgaagcagatgaaaatgaaaacatcaccgtggtgaagggcatccggctgtctgaaaatgtgattgacaggatgaaggagagcagccccagcggcagcaagagccagcgctacagcggggcctatggagcctctgtgtctgatgaggagctgaagagaagagtggccgaggagctggccctggagcaggccaagaaggagagcgaggaccagaagaggctgaagcaggccaaggagctggaccgggagagagctgctgccaatgagcagctgacccgggccatcctgcgggagcgcatctgcagcgaggaggagcgggccaaggccaagcacctggcccggcagctggaggagaaggacagagtgctgaagaagcaggatgccttctacaaggagcagctggcccggctggaggagaggagcagcgagttctacagagtgaccacagagcagtaccagaaggctgctgaggaggtggaggccaagttcaagagatatgagagccaccctgtgtgtgccgacctgcaggccaagatcctgcagtgctaccgggagaacacccaccagaccctgaagtgcagcgccctggccacccagtacatgcactgtgtgaaccacgccaagcagagcatgctggagaagggcggctag

SEQ ID NO: 148035 - DNA, 417 bp, Artificial Sequence
  Description of Artificial Sequence: Synthetic coding sequence
atgggcggcaccaccagcacccggcgggtgacctttgaagcagatgaaaatgaaaacatcaccgtggtgaagggcatccggctgtctgaaaatgtgattgacaggatgaaggagagcagccccagcggcagcaagagccagcgctacagcggggcctatggagcctctgtgtctgatgaggagctgaagagaagagtggccgaggagctggccctggagcaggccaagaaggagagcgaggaccagaagaggctgaagcaggccaaggagctggaccgggagagagctgctgccaatgagcagctgacccgggccatcctgcgggagcgcatctgcagcgaggaggagcgggccaaggccaagcacctgatcaaggtggagctgctgtgggtgaagccaggagtgctgacagcctag

SEQ ID NO: 148036 - DNA, 333 bp, Artificial Sequence
  Description of Artificial Sequence: Synthetic coding sequence
atgaagtgtgaggagacccacgcccccaacagcaactgggtgtatgtgatgctgcccagcaagaagacagtgaggatgcccagcgtgacccagaggctgcgggaccctgacatcaacccctgcctgtctgagagtgatgccagcacccgctgcctggatgagaacaactatgaccgggagcgctgcagcacctacttcctgcgctacaagaactgccgccgcttctggaacagcatcgtgatgcagaggaggaagaatggagtgaagcccttcatgcccacagctgctgagagagatgagatcctgcgggctgtgggcaacatgccctactag

SEQ ID NO: 148037 - DNA, 258 bp, Artificial Sequence
  Description of Artificial Sequence: Synthetic coding sequence
atgcccagcgtgacccagaggctgcgggaccctgacatcaacccctgcctgtctgagagtgatgccagcacccgctgcctggatgagaacaactatgaccgggagcgctgcagcacctacttcctgcgctacaagaactgccgccgcttctggaacagcatcgtgatgcagaggaggaagaatggagtgaagcccttcatgcccacagctgctgagagagatgagatcctgcgggctgtgggcaacatgccctactag

SEQ ID NO: 148038 - DNA, 285 bp, Artificial Sequence
  Description of Artificial Sequence: Synthetic coding sequence
atgctgcccagcaagaagacagtgaggatgcccagcgtgacccagaggctgcgggaccctgacatcaacccctgcctgtctgagagtgatgccagcacccgctgcctggatgagaacaactatgaccgggagcgctgcagcacctacttcctgcgctacaagaactgccgccgcttctggaacagcatcgtgatgcagaggaggaagaatggagtgaagcccttcatgcccacagctgctgagagagatgagatcctgcgggctgtgggcaacatgccctactag

SEQ ID NO: 148039 - DNA, 135 bp, Artificial Sequence
  Description of Artificial Sequence: Synthetic coding sequence
atgcccagcgtgacccagaggctgcgggaccctgacatcaacccctgcctgtctgagagtgatgccagcacccgctgcctggatgagaacaactatgaccgggagcgctgcagcacctacttcctgcgctactag

SEQ ID NO: 148040 - DNA, 294 bp, Artificial Sequence
  Description of Artificial Sequence: Synthetic coding sequence
atgcaccagaccaggacaggcaagaagacagtgaggatgcccagcgtgacccagaggctgcgggaccctgacatcaacccctgcctgtctgagagtgatgccagcacccgctgcctggatgagaacaactatgaccgggagcgctgcagcacctacttcctgcgctacaagaactgccgccgcttctggaacagcatcgtgatgcagaggaggaagaatggagtgaagcccttcatgcccacagctgctgagagagatgagatcctgcgggctgtgggcaacatgccctactag

SEQ ID NO: 148041 - DNA, 207 bp, Artificial Sequence
  Description of Artificial Sequence: Synthetic coding sequence
atgcaccagaccaggacaggcaagaagacagtgaggatgcccagcgtgacccagaggctgcgggaccctgacatcaacccctgcctgagcatcctcttctacctgctgaatgatgccagcctcatctctgtgaggaacctgatgctgcccccagatgtgtggatgaagatcaccatgaccgggaagggcgtgcccctgaccagctag

SEQ ID NO: 148042 - DNA, 264 bp, Artificial Sequence
  Description of Artificial Sequence: Synthetic coding sequence
atgagcacctctgtgccccagggccacacctggacccagagggtgaagaaggatgatgaggaggaggaccccctggaccagctgatcagccgcagcggctgtgccgccagccactttgctgtgcaggagtgcatggcccagcaccaggactggaggcagtgccagccccaggtgcaggccttcaaggactgcatgtctgagcagcaggcccggcggcaggaggagctgcagaggcggcaggagcaggccggggcccaccactag

SEQ ID NO: 148043 - DNA, 264 bp, Artificial Sequence; identical to SEQ ID NO: 148042
  Description of Artificial Sequence: Synthetic coding sequence

SEQ ID NO: 148044 - DNA, 291 bp, Artificial Sequence
  Description of Artificial Sequence: Synthetic coding sequence
atgttctaccgcctgcccatccccaggatgagcacctctgtgccccagggccacacctggacccagagggtgaagaaggatgatgaggaggaggaccccctggaccagctgatcagccgcagcggctgtgccgccagccactttgctgtgcaggagtgcatggcccagcaccaggactggaggcagtgccagccccaggtgcaggccttcaaggactgcatgtctgagcagcaggcccggcggcaggaggagctgcagaggcggcaggagcaggccggggcccaccactag

SEQ ID NO: 148045 - DNA, 264 bp, Artificial Sequence; identical to SEQ ID NO: 148042
  Description of Artificial Sequence: Synthetic coding sequence

SEQ ID NO: 148046 - DNA, 1731 bp, Artificial Sequence
  Description of Artificial Sequence: Synthetic coding sequence
atggccgccagcgagaccgtgcggctgcggctgcagtttgactacccacctccagccaccccccactgcacagccttctggctgctggtggacctgaaccgctgccgggtggtgacagacctgatcagcctcatccggcagagatttggcttcagcagcggggccttcctgggcctgtacctggagggcggcctgctgcccccagctgagagcgcccggctggtgcgggacaatgactgcctgcgggtgaagctggaggagcggggcgtggccgagaacagcgtggtgatcagcaatggagacatcaacctgagcctgaggaaggccaagaagagggccttccagctggaggagggggaggagacagagccagactgcaagtacagcaagaagcactggaagagccgggagaacaacaacaacaatgagaaggtgctggacctggagcccaaggctgtgacagaccagacagtgtccaagaagaacaagaggaagaacaaggccacctgtggcaccgtgggagatgacaatgaggaggccaagaggaagagccccaagaagaaggagaagtgtgagtacaagaagaaggccaagaaccccaagagccccaaggtgcaggccgtgaaggactgggccaaccagcgctgcagcagccccaagggcagcgccaggaacagcctggtgaaggccaagaggaaaggatctgtgtctgtgtgcagcaaggagagccccagcagcagcagcgagagcgagagctgtgatgagagcatcagtgatggccccagcaaggtgaccctggaggccaggaacagcagcgagaagctgcccacagagctgagcaaggaggagcccagcaccaagaacaccacagctgacaagctggccatcaagctgggcttcagcctgacccccagcaagggcaagaccagcggcaccaccagcagcagcagtgacagcagcgctgagagtgatgaccagtgcctgatgagcagcagcaccccagaatgtgccgccggcttcctgaagacagtgggcctgtttgctggccggggccggcccggccctggcctgagcagccagacagctggagctgctggctggaggaggagcggcagcaatggaggcggccaggcccctggggccagccccagcgtgtccctgcctgccagcctgggccggggctggggccgggaggagaacctcttctcctggaagggggccaagggccggggcatgaggggccggggccggggccggggccaccctgtgtcctgtgtggtgaacagaagcacagacaaccagaggcagcagcagctgaatgatgtggtgaagaacagcagcaccatcatccagaaccctgtggagacccccaagaaggactacagcctgctgcccctgctggccgccgccccccaggtgggggagaagatcgccttcaagctgctggagctgaccagcagctacagcccagatgtgtctgactacaaggagggccgcatcctgagccacaaccctgagacccagcaggtggacatcgagatcctgagcagcctgcctgccctgcgggagcccgggaagtttgacctggtgtaccacaatgaaaatggagctgaggtggtggagtatgctgtgacccaggagagcaagatcaccgtcttctggaaggagctgattgaccccaggctcatcatcgagagccccagcaacaccagcagcacagagcccgcctag

SEQ ID NO: 148047 - DNA, 519 bp, Artificial Sequence
  Description of Artificial Sequence: Synthetic coding sequence
atggccagtgatgagggcaagctgtttgtgggcggcctgagctttgacaccaatgagcagagcctggagcaggtgttcagcaaatatggccagatcagcgaggtggtggtggtgaaggaccgggagacccagaggagccggggctttggatttgtgacctttgaaaatattgatgatgccaaggatgccatgatggccatgaatggcaagtctgtggatggccggcagatccgggtggaccaggccggcaagagcagtgacaacagaagccggggctacagaggaggcagcgctgggggccggggcttcttccggggcggccggggccggggccggggcttcagcagaggaggaggagaccggggctatggaggcaacagatttgagagccgcagcggcggctatggaggcagccgggactactacagcagccgcagccagagcggcggctacagcgacaggagcagcggcggcagctacagagacagctatgacagctatgccacccacaatgaatag

SEQ ID NO: 148048 - DNA, 792 bp, Artificial Sequence
  Description of Artificial Sequence: Synthetic coding sequence
atggccagtgatgagggcaagctgtttgtgggcggcctgagctttgacaccaatgagcagagcctggagcaggtgttcagcaaatatggccagatcagcgaggtggtggtggtgaaggaccgggagacccagaggagccggggctttggatttgtgacctttgaaaatattgatgatgccaaggatgccatgatggccatgaatggcaagtctgtggatggccggcagatccgggtggaccaggccggcggcggggaccggggctatggaggcaacagatttgagagccgcagcggcggctatggaggcagccgggactactacagcagccgcagccagagcggcggctacagcgacaggagcagcggcggcagctacagagacagctatgacagctatggcaagagccacagcgagggcgccaccctgctgtggccagctgtgggcgcccgcttcaccctggtgcccagccccagcaccctgggctggaccctgcggccctgccactgtgcctgcccagaggaggcccacctgagcagccagagccacttctacagaaggacccagaagcccaatgaaacagaccagaagggcaaaggagagcggggccctgctggccagagcgcccgctgcatgtgtggcagaagacctgccagcctgggctgcggcggctggctgctgcccggccggcggccccggcccggcctggccagcggcgtgaagctgcccctggtggcctctgtgcccctgcactgtgcctgcttcctgagcagcgccacccacaatgaatag

SEQ ID NO: 148049 - DNA, 735 bp, Artificial Sequence
  Description of Artificial Sequence: Synthetic coding sequence
atgagcagccgctggagccgcagcagccagagcacagacaggagcctgaagtctgtggatggccggcagatccgggtggaccaggccggcaagagcagtgacaacagaagccggggctaccggggcggcagcgctgggggccggggcttcttccggggcggccggggccggggccggggcttcagccggggcggcggggaccggggctacggcggcaacagatttgagagccgcagcggcggctacggcggcagccgggactactacagcagccgcagccagagcggcggctacagcgacaggagcagcggcggcagctacagagacagctatgacagctatggcaagagccacagcgagggcgccaccctgctgtggccagctgtgggcgcccgcttcaccctggtgcccagccccagcaccctgggctggaccctgcggccctgccactgtgcctgcccagaggaggcccacctgagcagccagagccacttctacagaaggacccagaagcccaatgaaacagaccagaagggcaagggggagcggggccctgctggccagagcgcccgctgcatgtgtggccggcggcctgccagcctgggctgcggcggctggctgctgcctggaagaagacccaggcctggcctggccagcggcgtgaagctgcccctggtggcctctgtgcccctgcactgtgcctgcttcctgagcagcgccacccacaatgaatag

SEQ ID NO: 148050 - DNA, 519 bp, Artificial Sequence; identical to SEQ ID NO: 148047
  Description of Artificial Sequence: Synthetic coding sequence

SEQ ID NO: 148051 - DNA, 2304 bp, Artificial Sequence
  Description of Artificial Sequence: Synthetic coding sequence
atgagctttgaccccaacctgctgcacaacaacggccacaacggctaccccaacggcaccagcgctgccctgcgggagactggagtcatcgagaagctgctgaccagctatggcttcatccagtgcagcgagcggcaggcccggctcttcttccactgcagccagtacaatggaaacctgcaggacctgaaggtgggagatgatgtggagtttgaggtgtccagtgacagaagaacaggcaagcccatcgctgtgaagctggtgaagatcaagcaggagatcctgcctgaggagaggatgaatggccaggaggtgttctacctgacctacaccccagaagatgtggagggcaatgtgcagctggagactggagacaagatcaactttgtgattgacaacaacaagcacactggagctgtgtctgccaggaacatcatgctgctgaagaagaagcaggcccgctgccagggcgtggtgtgtgccatgaaggaggccttcggcttcatcgagagaggagatgtggtgaaggagatcttcttccactacagcgagttcaagggggacctggagaccctgcagcctggagatgatgtggagttcaccatcaaggacagaaatggcaaggaggtggccacagatgtgcggctgctgccccagggcaccgtcatctttgaggacatcagcattgagcactttgagggcaccgtgaccaaggtgatccccaaggtgcccagcaagaaccagaatgaccccctgcccggccgcatcaaggtggactttgtgatccccaaggagctgccctttggagacaaggacaccaagagcaaggtgaccctgctggagggggaccacgtgcgcttcaacatcagcacagacagaagagacaagctggagcgggccaccaacatcgaggtgctgagcaacaccttccagttcaccaatgaggcccgggagatgggcgtgattgctgccatgagagatggcttcggcttcatcaagtgtgtggacagagatgtgaggatgttcttccacttcagcgagatcctggatggcaaccagctgcacatcgcagatgaggtggagttcaccgtggtgcctgacatgctgagcgcccagagaaatcatgccatccgcatcaagaagctgcccaagggcaccgtgtccttccacagccacagcgaccaccgcttcctgggcaccgtggagaaggaggccaccttcagcaaccccaagaccaccagccccaacaagggcaaggagaaggaggccgaggatggcatcatcgcctatgatgactgtggggtgaagctgaccatcgccttccaggccaaggatgtggagggcagcaccagcccccagatcggggacaaggtggagttcagcatcagtgacaagcagaggcctggccagcaggtggccacctgtgtgcggctgctgggcaggaacagcaacagcaagaggctgctgggctacgtggccaccctgaaggacaactttggcttcatcgagacagccaaccacgacaaggagatcttcttccactacagcgagttctctggagatgtggacagcctggagctgggggacatggtggagtacagcctgagcaaaggaaaaggaaacaaggtgtctgctgagaaggtgaacaagacccacagcgtgaatggcatcacagaggaggccgaccccaccatctacagcggcaaggtgatccggcccctgcggtctgtggaccccacccagacagagtaccagggcatgattgagatcgtggaggagggggacatgaagggggaggtgtacccctttggaattgtgggcatggccaacaagggggactgcctgcagaagggggagagcgtgaagttccagctgtgtgtgctgggccagaatgcccagaccatggcctacaacatcacccccctgcggcgggccaccgtggagtgtgtgaaggaccagtttggcttcatcaactatgaggtgggggacagcaagaagctgttcttccacgtgaaggaggtgcaggacggcatcgagctgcaggccggagatgaggtggagttcagcgtcatcctgaaccagaggacaggcaagtgcagcgcctgcaatgtgtggagggtgtgtgagggccccaaggctgtggccgcccccaggccagaccggctggtgaaccggctgaagaacatcaccctggatgatgccagcgccccccggctgatggtgctgcggcagccccggggccctgacaacagcatgggctttggagctgagaggaagatccggcaggccggggtcatcgactag

SEQ ID NO: 148052 - DNA, 2304 bp, Artificial Sequence; identical to SEQ ID NO: 148051
  Description of Artificial Sequence: Synthetic coding sequence

SEQ ID NO: 148053 - DNA, 2397 bp, Artificial Sequence
  Description of Artificial Sequence: Synthetic coding sequence
atgagctttgaccccaacctgctgcacaacaacggccacaacggctaccccaacggcaccagcgctgccctgcgggagactggagtcatcgagaagctgctgaccagctatggcttcatccagtgcagcgagcggcaggcccggctcttcttccactgcagccagtacaatggaaacctgcaggacctgaaggtgggagatgatgtggagtttgaggtgtccagtgacagaagaacaggcaagcccatcgctgtgaagctggtgaagatcaagcaggagatcctgcctgaggagaggatgaatggccaggtggtgtgtgctgtgccccacaacctggagagcaagagccctgctgcccctggccagagccccactggatctgtgtgctatgaaagaaatggagaggtgttctacctgacctacaccccagaagatgtggagggcaatgtgcagctggagaccggggacaagatcaacttcgtcatcgacaacaacaagcacactggagctgtgtctgccaggaacatcatgctgctgaagaagaagcaggcccgctgccagggcgtggtgtgtgccatgaaggaggccttcggcttcatcgagagaggagatgtggtgaaggagatcttcttccactacagcgagttcaagggggacctggagaccctgcagcctggagatgatgtggagttcaccatcaaggacagaaatggcaaggaggtggccacagatgtgcggctgctgccccagggcaccgtcatctttgaggacatcagcattgagcactttgagggcaccgtgaccaaggtgatccccaaggtgcccagcaagaaccagaatgaccccctgcccggccgcatcaaggtggactttgtgatccccaaggagctgccctttggagacaaggacaccaagagcaaggtgaccctgctggagggggaccacgtgcgcttcaacatcagcacagaccggcgggacaagctggagcgggccaccaacatcgaggtgctgagcaacaccttccagttcaccaatgaggcccgggagatgggcgtgattgctgccatgagagatggcttcggcttcatcaagtgtgtggacagagatgtgaggatgttcttccacttcagcgagatcctggatggcaaccagctgcacatcgcagatgaggtggagttcaccgtggtgcctgacatgctgagcgcccagaggaaccacgccatccgcatcaagaagctgcccaagggcaccgtgtccttccacagccacagcgaccaccgcttcctgggcaccgtggagaaggaggccaccttcagcaaccccaagaccaccagccccaacaagggcaaggagaaggaggctgaagatggcatcatcgcctatgatgactgtggggtgaagctgaccatcgccttccaggccaaggatgtggagggcagcaccagcccccagattggagacaaggtggagttcagcatcagtgacaagcagaggcctggccagcaggtggccacctgtgtgcggctgctgggcaggaacagcaacagcaagaggctgctgggctacgtggccaccctgaaggacaactttggcttcattgaaacagccaaccacgacaaggagatcttcttccactacagcgagttctctggagatgtggacagcctggagctgggggacatggtggagtacagcctgagcaagggcaagggcaacaaggtgtctgctgagaaggtgaacaagacccacagcgtgaatggcatcacagaggaggccgaccccaccatctacagcggcaaggtgatccggcccctgcggtctgtggaccccacccagacagagtaccagggcatgattgaaattgtggaggagggggacatgaagggggaggtgtaccccttcggcatcgtgggcatggccaacaagggggactgcctgcagaagggggagagcgtgaagttccagctgtgtgtgctgggccagaatgcccagaccatggcctacaacatcacccccctgcggcgggccaccgtggagtgtgtgaaggaccagtttggcttcatcaactatgaggtgggggacagcaagaagctgttcttccacgtgaaggaggtgcaggacggcatcgagctgcaggccggagatgaggtggagttcagcgtcatcctgaaccagaggactggaaaatgttctgcctgcaatgtgtggagggtgtgtgagggccccaaggctgtggccgcccccaggccagaccggctggtgaaccggctgaagaacatcaccctggatgatgccagcgccccccggctgatggtgctgcggcagccccggggccctgacaacagcatgggctttggagctgagaggaagatccggcaggccggcgtgattgattag

SEQ ID NO: 148054 - DNA, 2442 bp, Artificial Sequence
  Description of Artificial Sequence: Synthetic coding sequence
atggagaatgtgttcaccgtgtccagtgacccccaccccagccctgctgccccacccagcctgagcctgcccctgagcagcagcagcaccagcagcggcaccaagaagcagaagaggacccccacctaccagaggtccatgagctttgaccccaacctgctgcacaacaacggccacaacggctaccccaacggcaccagcgctgccctgcgggagactggagtcatcgagaagctgctgaccagctatggcttcatccagtgcagcgagcggcaggcccggctcttcttccactgcagccagtacaatggaaacctgcaggacctgaaggtgggagatgatgtggagtttgaggtgtccagtgacagaagaacaggcaagcccatcgctgtgaagctggtgaagatcaagcaggagatcctgcctgaggagaggatgaatggccaggaggtgttctacctgacctacaccccagaagatgtggagggcaatgtgcagctggagactggagacaagatcaactttgtgattgacaacaacaagcacactggagctgtgtctgccaggaacatcatgctgctgaagaagaagcaggcccgctgccagggcgtggtgtgtgccatgaaggaggccttcggcttcatcgagagaggagatgtggtgaaggagatcttcttccactacagcgagttcaagggggacctggagaccctgcagcctggagatgatgtggagttcaccatcaaggacagaaatggcaaggaggtggccacagatgtgcggctgctgccccagggcaccgtcatctttgaggacatcagcattgagcactttgagggcaccgtgaccaaggtgatccccaaggtgcccagcaagaaccagaatgaccccctgcccggccgcatcaaggtggactttgtgatccccaaggagctgccctttggagacaaggacaccaagagcaaggtgaccctgctggagggggaccacgtgcgcttcaacatcagcacagacagaagagacaagctggagcgggccaccaacatcgaggtgctgagcaacaccttccagttcaccaatgaggcccgggagatgggcgtgattgctgccatgagagatggcttcggcttcatcaagtgtgtggacagagatgtgaggatgttcttccacttcagcgagatcctggatggcaaccagctgcacatcgcagatgaggtggagttcaccgtggtgcctgacatgctgagcgcccagagaaatcatgccatccgcatcaagaagctgcccaagggcaccgtgtccttccacagccacagcgaccaccgcttcctgggcaccgtggagaaggaggccaccttcagcaaccccaagaccaccagccccaacaagggcaaggagaaggaggccgaggatggcatcatcgcctatgatgactgtggggtgaagctgaccatcgccttccaggccaaggatgtggagggcagcaccagcccccagatcggggacaaggtggagttcagcatcagtgacaagcagaggcctggccagcaggtggccacctgtgtgcggctgctgggcaggaacagcaacagcaagaggctgctgggctacgtggccaccctgaaggacaactttggcttcatcgagacagccaaccacgacaaggagatcttcttccactacagcgagttctctggagatgtggacagcctggagctgggggacatggtggagtacagcctgagcaaaggaaaaggaaacaaggtgtctgctgagaaggtgaacaagacccacagcgtgaatggcatcacagaggaggccgaccccaccatctacagcggcaaggtgatccggcccctgcggtctgtggaccccacccagacagagtaccagggcatgattgagatcgtggaggagggggacatgaagggggaggtgtacccctttggaattgtgggcatggccaacaagggggactgcctgcagaagggggagagcgtgaagttccagctgtgtgtgctgggccagaatgcccagaccatggcctacaacatcacccccctgcggcgggccaccgtggagtgtgtgaaggaccagtttggcttcatcaactatgaggtgggggacagcaagaagctgttcttccacgtgaaggaggtgcaggacggcatcgagctgcaggccggagatgaggtggagttcagcgtcatcctgaaccagaggacaggcaagtgcagcgcctgcaatgtgtggagggtgtgtgagggccccaaggctgtggccgcccccaggccagaccggctggtgaaccggctgaagaacatcaccctggatgatgccagcgccccccggctgatggtgctgcggcagccccggggccctgacaacagcatgggctttggagctgagaggaagatccggcaggccggggtcatcgactag

SEQ ID NO: 148055 - DNA, 2535 bp, Artificial Sequence
  Description of Artificial Sequence: Synthetic coding sequence
atggagaatgtgttcaccgtgtccagtgacccccaccccagccctgctgccccacccagcctgagcctgcccctgagcagcagcagcaccagcagcggcaccaagaagcagaagaggacccccacctaccagaggtccatgagctttgaccccaacctgctgcacaacaacggccacaacggctaccccaacggcaccagcgctgccctgcgggagactggagtcatcgagaagctgctgaccagctatggcttcatccagtgcagcgagcggcaggcccggctcttcttccactgcagccagtacaatggaaacctgcaggacctgaaggtgggagatgatgtggagtttgaggtgtccagtgacagaagaacaggcaagcccatcgctgtgaagctggtgaagatcaagcaggagatcctgcctgaggagaggatgaatggccaggtggtgtgtgctgtgccccacaacctggagagcaagagccctgctgcccctggccagagccccactggatctgtgtgctatgaaagaaatggagaggtgttctacctgacctacaccccagaagatgtggagggcaatgtgcagctggagaccggggacaagatcaacttcgtcatcgacaacaacaagcacactggagctgtgtctgccaggaacatcatgctgctgaagaagaagcaggcccgctgccagggcgtggtgtgtgccatgaaggaggccttcggcttcatcgagagaggagatgtggtgaaggagatcttcttccactacagcgagttcaagggggacctggagaccctgcagcctggagatgatgtggagttcaccatcaaggacagaaatggcaaggaggtggccacagatgtgcggctgctgccccagggcaccgtcatctttgaggacatcagcattgagcactttgagggcaccgtgaccaaggtgatccccaaggtgcccagcaagaaccagaatgaccccctgcccggccgcatcaaggtggactttgtgatccccaaggagctgccctttggagacaaggacaccaagagcaaggtgaccctgctggagggggaccacgtgcgcttcaacatcagcacagaccggcgggacaagctggagcgggccaccaacatcgaggtgctgagcaacaccttccagttcaccaatgaggcccgggagatgggcgtgattgctgccatgagagatggcttcggcttcatcaagtgtgtggacagagatgtgaggatgttcttccacttcagcgagatcctggatggcaaccagctgcacatcgcagatgaggtggagttcaccgtggtgcctgacatgctgagcgcccagaggaaccacgccatccgcatcaagaagctgcccaagggcaccgtgtccttccacagccacagcgaccaccgcttcctgggcaccgtggagaaggaggccaccttcagcaaccccaagaccaccagccccaacaagggcaaggagaaggaggctgaagatggcatcatcgcctatgatgactgtggggtgaagctgaccatcgccttccaggccaaggatgtggagggcagcaccagcccccagattggagacaaggtggagttcagcatcagtgacaagcagaggcctggccagcaggtggccacctgtgtgcggctgctgggcaggaacagcaacagcaagaggctgctgggctacgtggccaccctgaaggacaactttggcttcattgaaacagccaaccacgacaaggagatcttcttccactacagcgagttctctggagatgtggacagcctggagctgggggacatggtggagtacagcctgagcaagggcaagggcaacaaggtgtctgctgagaaggtgaacaagacccacagcgtgaatggcatcacagaggaggccgaccccaccatctacagcggcaaggtgatccggcccctgcggtctgtggaccccacccagacagagtaccagggcatgattgaaattgtggaggagggggacatgaagggggaggtgtaccccttcggcatcgtgggcatggccaacaagggggactgcctgcagaagggggagagcgtgaagttccagctgtgtgtgctgggccagaatgcccagaccatggcctacaacatcacccccctgcggcgggccaccgtggagtgtgtgaaggaccagtttggcttcatcaactatgaggtgggggacagcaagaagctgttcttccacgtgaaggaggtgcaggacggcatcgagctgcaggccggagatgaggtggagttcagcgtcatcctgaaccagaggactggaaaatgttctgcctgcaatgtgtggagggtgtgtgagggccccaaggctgtggccgcccccaggccagaccggctggtgaaccggctgaagaacatcaccctggatgatgccagcgccccccggctgatggtgctgcggcagccccggggccctgacaacagcatgggctttggagctgagaggaagatccggcaggccggcgtgattgattag

SEQ ID NO: 148056 - DNA, 141 bp, Artificial Sequence
  Description of Artificial Sequence: Synthetic coding sequence
atgagctttgaccccaacctgctgcacaacaacggccacaacggctaccccaacggcaccagcgctgccctgcgggagactggagtcatcgagaagctgctgaccagctatggcttcatccagtgcagcgagcggcagtag

SEQ ID NO: 148057 - DNA, 24 bp, Artificial Sequence
  Description of Artificial Sequence: Synthetic coding sequence
atgagctttgaccccaacctgtag

SEQ ID NO: 148058 - DNA, 2007 bp, Artificial Sequence
  Description of Artificial Sequence: Synthetic coding sequence
atgaatggccaggaggtgttctacctgacctacaccccagaagatgtggagggcaatgtgcagctggagaccggggacaagatcaacttcgtcatcgacaacaacaagcacactggagctgtgtctgccaggaacatcatgctgctgaagaagaagcaggcccgctgccagggcgtggtgtgtgccatgaaggaggccttcggcttcatcgagagaggagatgtggtgaaggagatcttcttccactacagcgagttcaagggggacctggagaccctgcagcctggagatgatgtggagttcaccatcaaggacagaaatggcaaggaggtggccacagatgtgcggctgctgccccagggcaccgtcatctttgaggacatcagcattgagcactttgagggcaccgtgaccaaggtgatccccaaggtgcccagcaagaaccagaatgaccccctgcccggccgcatcaaggtggactttgtgatccccaaggagctgccctttggagacaaggacaccaagagcaaggtgaccctgctggagggggaccacgtgcgcttcaacatcagcacagaccggcgggacaagctggagcgggccaccaacatcgaggtgctgagcaacaccttccagttcaccaatgaggcccgggagatgggcgtgattgctgccatgagagatggcttcggcttcatcaagtgtgtggacagagatgtgaggatgttcttccacttcagcgagatcctggatggcaaccagctgcacatcgcagatgaggtggagttcaccgtggtgcctgacatgctgagcgcccagaggaaccacgccatccgcatcaagaagctgcccaagggcaccgtgtccttccacagccacagcgaccaccgcttcctgggcaccgtggagaaggaggccaccttcagcaaccccaagaccaccagccccaacaagggcaaggagaaggaggctgaagatggcatcatcgcctatgatgactgtggggtgaagctgaccatcgccttccaggccaaggatgtggagggcagcaccagcccccagattggagacaaggtggagttcagcatcagtgacaagcagaggcctggccagcaggtggccacctgtgtgcggctgctgggcaggaacagcaacagcaagaggctgctgggctacgtggccaccctgaaggacaactttggcttcattgaaacagccaaccacgacaaggagatcttcttccactacagcgagttctctggagatgtggacagcctggagctgggggacatggtggagtacagcctgagcaagggcaagggcaacaaggtgtctgctgagaaggtgaacaagacccacagcgtgaatggcatcacagaggaggccgaccccaccatctacagcggcaaggtgatccggcccctgcggtctgtggaccccacccagacagagtaccagggcatgattgaaattgtggaggagggggacatgaagggggaggtgtaccccttcggcatcgtgggcatggccaacaagggggactgcctgcagaagggggagagcgtgaagttccagctgtgtgtgctgggccagaatgcccagaccatggcctacaacatcacccccctgcggcgggccaccgtggagtgtgtgaaggaccagtttggcttcatcaactatgaggtgggggacagcaagaagctgttcttccacgtgaaggaggtgcaggacggcatcgagctgcaggccggagatgaggtggagttcagcgtcatcctgaaccagaggactggaaaatgttctgcctgcaatgtgtggagggtgtgtgagggccccaaggctgtggccgcccccaggccagaccggctggtgaaccggctgaagaacatcaccctggatgatgccagcgccccccggctgatggtgctgcggcagccccggggccctgacaacagcatgggctttggagctgagaggaagatccggcaggccggcgtgattgattag

SEQ ID NO: 148059 - DNA, 288 bp, Artificial Sequence
  Description of Artificial Sequence: Synthetic coding sequence
atgagctttgaccccaacctgctgcacaacaacggccacaacggctaccccaacggcaccagcgctgccctgcgggagactggagtcatcgagaagctgctgaccagctatggcttcatccagtgcagcgagcggcaggcccggctcttcttccactgcagccagtacaatggaaacctgcaggacctgaaggtgggagatgatgtggagtttgaggtgtccagtgacagaagaacaggcaagcccatcgctgtgaagctggtgaagatcaagcaggagatcctgtag

SEQ ID NO: 148060 - DNA, 2397 bp, Artificial Sequence; identical to SEQ ID NO: 148053
  Description of Artificial Sequence: Synthetic coding sequence

SEQ ID NO: 148061 - DNA, 1329 bp, Artificial Sequence
  Description of Artificial Sequence: Synthetic coding sequence
atggaggccagccgctgccgcctgagccccagcggggacagcgtcttccacgaggagatgatgaagatgaggcaggccaagctggactaccagaggctgctgctggagaagaggcagaggaagaagaggctggagcccttcatggtgcagcccaaccctgaggcccggctgcggcgggccaagccccgggccagtgatgagcagacccccctggtgaactgccacaccccccacagcaatgtcatcctgcacggcattgatggccctgctgctgtgctgaagccagatgaggtgcacgcccccagcgtgagcagctctgtggtggaggaggatgctgaaaatacagtggacacagccagcaagccaggcctgcaggagcggctgcagaagcatgacatcagcgagagcgtgaactttgatgaggagacagatggcatcagccagagcgcctgcctggagcggcccaacagcgccagcagccagaacagcacagacaccggcaccagcggcagcgccacagctgcccagcctgctgacaacctgctgggggacattgatgacctggaggactttgtgtacagccctgccccccagggcgtgacagtgcgctgccgcatcatccgggacaagaggggcatggaccggggcctcttccccacctactacatgtacctggagaaggaggagaaccagaagatcttcctgctggccgccaggaagaggaagaagagcaagacagccaactacctgatcagcattgatcctgtggacctgagccgggagggggagagctatgtgggcaagctgcggagcaacctgatgggcaccaagttcaccgtgtatgaccggggcatctgccccatgaagggccggggcctggtgggcgccgcccacacccggcaggagctggccgccatctcctatgagaccaacgtgctgggcttcaagggccccaggaagatgtctgtcatcatccctggcatgaccctgaaccacaagcagatcccctaccagccccagaacaaccacgacagcctgctgagccgctggcagaacagaaccatggagaacctggtggagctgcacaacaaggcccctgtgtggaacagcgacacccagagctatgtgctgaacttccggggccgggtgacccaggcctctgtgaagaacttccagatcgtgcacaagaatgaccctgactacatcgtgatgcagtttggccgggtggctgatgatgtgttcaccctggactacaactaccccctgtgtgctgtgcaggccttcggcatcggcctgagcagctttgacagcaagctggcctgtgagtag

SEQ ID NO: 148062 - DNA, 912 bp, Artificial Sequence
  Description of Artificial Sequence: Synthetic coding sequence
atgtctgaggccggggaggccaccaccaccaccaccaccaccctgccccaggcccccacagaggccgctgctgctgccccccaggaccctgcccccaagagccctgtgggcagcggggccccccaggccgccgccccagccccagctgcccacgtggccggcaaccctggaggagatgctgccccagctgccactggaacagctgctgctgccagcctggccacagctgctggctctgaagatgctgagaagaaggtgctggccaccaaggtgctgggcaccgtgaagtggttcaacgtgagaaatggctacggcttcatcaacagaaatgacaccaaggaggatgtgtttgtgcaccagacagccatcaagaagaacaaccccaggaagtacctgcggtctgtgggagatggagagaccgtggagtttgatgtggtggagggggagaagggagctgaggccgccaacgtgacaggcccagatggagtgcctgtggagggcagccgctatgctgctgacagaagacgctaccgccggggctactacggcagaagaagaggccccccaagaaatgctggggagattggagagatgaaggatggagtgcctgagggcgcccagctgcagggccctgtgcacaggaaccccacctaccggccccgctaccgcagccggggccccccccggcccaggcctgccccagctgtgggggaggccgaggacaaggagaaccagcaggccaccagcggccccaaccagcccagcgtgagaagaggctacagaagaccctacaactacagaagaagaccccggcccccaaatgcccccagccaggacggcaaggaggccaaggccggggaggcccccacagaaaatcctgccccacccacccagcagagcagcgctgagtag

SEQ ID NO: 148063 - DNA, 339 bp, Artificial Sequence
  Description of Artificial Sequence: Synthetic coding sequence
atggagaagatcctgatcctgctgctggtggccctgtctgtggcctatgctgcccctggcccccggggcatcatcatcaacctggagaatggagagctgtgcatgaacagcgcccagtgcaagagcaactgctgccagcacagcagcgccctgggcctggcccgctgcacctccatggccagcgagaacagtgaatgttctgtgaagaccctgtatggcatctactacaagtgcccctgtgagcggggcctgacctgtgagggggacaagaccatcgtgggcagcatcaccaacaccaactttggcatctgccatgatgctggccgcagcaagcagtag

SEQ ID NO: 148064 - DNA, 216 bp, Artificial Sequence
  Description of Artificial Sequence: Synthetic coding sequence
atggagaagatcctgatcctgctgctggtggccctgtctgtggcctatgctgcccctggcccccggggcatcatcatcaacctgaccctgtatggcatctactacaagtgcccctgtgagcggggcctgacctgtgagggggacaagaccatcgtgggcagcatcaccaacaccaactttggcatctgccatgatgctggccgcagcaagcagtag

SEQ ID NO: 148065 - DNA, 408 bp, Artificial Sequence
  Description of Artificial Sequence: Synthetic coding sequence
atgcagctgacctgggccagcatcagcctggtgacccgctgctggccccagacccccaccttccaggacctgctggcctgcctgggcgcccgggccctgcccggccccccaggggcccctggaagagatggcagcaagggggagcggggggcccctggcccccggggcagccctggccccccaggcagctttgacttcctgctgctgatgctggccgacatcagaaatgacatcacagagctgcaggagaaggtgtttggccacaggacccacagcagcgctgaggagttccccctgccccaggagttccccagctacccagaggccatggacctgggcagcggagatgaccaccccaggagaacagagacccgggacctgcgggccccccgggacttctacccctag

SEQ ID NO: 148066 - DNA, 1221 bp, Artificial Sequence
  Description of Artificial Sequence: Synthetic coding sequence
atggtgcccccaccacccagcagaggaggagctgcccggggccagctgggccgcagcctgggccccctgctgctgctgctggccctgggccacacctggacctaccgggaggagccagaagatggagaccgggagatctgcagcgagagcaagatcgccaccaccaagtacccctgcctgaagagcagtggagagctgaccacctgctacaggaagaagtgctgcaagggctacaagtttgtgctgggccagtgcatccctgaggactatgatgtgtgtgccgaggccccctgtgagcagcagtgcacagacaactttggccgggtgctgtgcacctgctacccaggctaccgctatgaccgggagcggcacaggaagcgggagaagccctactgcctggacattgatgaatgtgccagcagcaatggcaccctgtgtgcccacatctgcatcaacaccctgggcagctaccgctgtgagtgccgggagggctacatccgggaggatgatggcaagacctgcaccaggggggacaagtacccaaatgacaccggccacgagaagtctgagaacatggtgaaggccggcacctgctgtgccacctgcaaggagttctaccagatgaagcagacagtgctgcagctgaagcagaagatcgccctgctgcccaacaatgctgctgacctgggcaagtacatcaccggggacaaggtgctggccagcaacacctacctgcccggccccccaggcctgcccggcggccagggccccccaggcagccctggccccaagggcagccctggcttccctggcatgcctggccccccaggccagcccggcccccggggctccatgggccccatgggccccagcccagacctgagccacatcaagcagggcagaagaggccctgtgggccccccaggggcccctggaagagatggcagcaaaggagagcggggggcccctggcccccggggcagccctggccccccaggcagctttgacttcctgctgctgatgctggccgacatcagaaatgacatcacagagctgcaggagaaggtgtttggccacaggacccacagcagcgctgaggagttccccctgccccaggagttccccagctacccagaggccatggacctgggcagcggagatgaccaccccaggagaacagagacccgggacctgcgggccccccgggacttctacccctag

SEQ ID NO: 148067 - DNA, 699 bp, Artificial Sequence
  Description of Artificial Sequence: Synthetic coding sequence
atgtggcccccaggccgcagcatcaccgtgaagctgcgggagaagacagtgtccaggaagctggagatgaatggccccagcgccttccagggcctcatctgtgggaagtacaacggcatgtgcctgcagggccctgctggggtgcccggcagagatggcagccctggggccaacggcatccctggcaccccaggcatccctggaagagatggcttcaagggggagaagggggagtgcctgcgggagagctttgaggagagctggacccccaactacaagcagtgctcctggagcagcctgaactacggcatcgacctgggcaagattgctgaatgtaccttcaccaagatgaggagcaacagcgccctgcgggtgctcttcagcggcagcctgcggctgaagtgcagaaatgcctgctgccagcgctggtacttcaccttcaacggggctgaatgttctggccccctgcccatcgaggccatcatctacctggaccagggcagccctgagatgaacagcaccatcaacatccacaggaccagctctgtggagggcctgtgtgagggcatcggggccggcctggtggatgtggccatctgggtgggcacctgcagcgactaccccaagggagatgccagcacaggctggaacagcgtgagccgcatcatcatcgaggagctgcccaactacctgttctag

SEQ ID NO: 148068 - DNA, 732 bp, Artificial Sequence
  Description of Artificial Sequence: Synthetic coding sequence
atgaggccccagggccctgctgccagcccccagaggctgcggggcctgctgctgctgctgctgctgcagctgcctgcccccagcagcgccagcgagatccccaagggcaagcagaaggcccagctgcggcagcgggaggtggtggacctgtacaacggcatgtgcctgcagggccctgctggggtgcccggcagagatggcagccctggggccaacggcatccctggcaccccaggcatccctggaagagatggcttcaagggggagaagggggagtgcctgcgggagagctttgaggagagctggacccccaactacaagcagtgctcctggagcagcctgaactacggcatcgacctgggcaagattgctgaatgtaccttcaccaagatgaggagcaacagcgccctgcgggtgctcttcagcggcagcctgcggctgaagtgcagaaatgcctgctgccagcgctggtacttcaccttcaacggggctgaatgttctggccccctgcccatcgaggccatcatctacctggaccagggcagccctgagatgaacagcaccatcaacatccacaggaccagctctgtggagggcctgtgtgagggcatcggggccggcctggtggatgtggccatctgggtgggcacctgcagcgactaccccaagggagatgccagcacaggctggaacagcgtgagccgcatcatcatcgaggagctgcccaagtag

SEQ ID NO: 148069 - DNA, 690 bp, Artificial Sequence
  Description of Artificial Sequence: Synthetic coding sequence
atgtggcccccaggccgcagcatcaccgtgaagctgcgggagaagacagtgtccaggaagctggagatgaatggccccagcgccttccagggcctcatctgtgggaagtacaacggcatgtgcctgcagggccctgctggggtgcccggcagagatggcagccctggggccaacggcatccctggcaccccaggcatccctggaagagatggcttcaagggggagaagggggagtgcctgcgggagagctttgaggagagctggacccccaactacaagcagtgctcctggagcagcctgaactacggcatcgacctgggcaagattgctgaatgtaccttcaccaagatgaggagcaacagcgccctgcgggtgctcttcagcggcagcctgcggctgaagtgcagaaatgcctgctgccagcgctggtacttcaccttcaacggggctgaatgttctggccccctgcccatcgaggccatcatctacctggaccagggcagccctgagatgaacagcaccatcaacatccacaggaccagctctgtggagggcctgtgtgagggcatcggggccggcctggtggatgtggccatctgggtgggcacctgcagcgactaccccaagggagatgccagcacaggctggaacagcgtgagccgcatcatcatcgaggagctgcccaagtag

SEQ ID NO: 148070 - DNA, 5037 bp, Artificial Sequence
  Description of Artificial Sequence: Synthetic coding sequence
atgcaccctggcctgtggctgctgctggtgaccctgtgcctgacagaggagctggccgctgctggggagaagagctatggcaagccctgtggcggccaggactgcagcggcagctgccagtgcttccctgagaagggggcccggggccggcccggccccatcggcatccagggccccaccggcccccagggcttcaccggcagcacaggcctgagcggcctgaagggggagcggggcttccctggcctgctgggcccctacggccccaagggggacaagggccccatgggcgtgcccggcttcctgggcatcaatggcatccctggccaccctggccagcccggcccccggggccccccaggcctggatggctgcaatggcacccagggcgctgtgggcttccctggcccagatggctacccaggcctgctgggccccccaggcctgcccggccagaagggcagcaagggggaccctgtgctggcccctggcagcttcaagggcatgaagggggaccccggcctgcccggcctggatggcatcaccggcccccagggcgcccctggcttccctggagctgtgggccctgctggccccccaggcctgcagggccccccaggccccccaggccccctgggcccagatggcaacatgggcctgggcttccagggcgagaagggcgtgaagggagatgtgggcctgcccggccctgctggccccccacccagcactggagagctggagttcatgggcttccccaagggcaagaagggcagcaagggggagcccggccccaagggcttccctggcatcagcggccccccaggcttccctggcctgggcaccactggagagaagggggagaagggggagaagggcatccctggcctgcccggcccccggggccccatgggcagcgagggcgtgcagggccccccaggccagcagggcaagaagggcaccctgggcttccctggcctgaatggcttccagggcatcgagggccagaagggggacatcggcctgcccggcccagatgtgttcattgatattgatggagctgtgatcagcggcaaccctggggaccccggggtgcccggcctgcccggcctgaagggagatgagggcatccagggcctgcggggccccagcggcgtgcccggcctgcctgccctgtctggagtgcctggggccctgggcccccagggcttccctggcctgaagggggaccagggcaaccctggccgcaccaccatcggggccgccggcctgcccggcagagatggcctgcccggccccccaggccccccaggcccccccagccctgagtttgaaacagagaccctgcacaacaaggagagcggcttccctggcctgcggggggagcagggccccaagggcaacctgggcctgaagggcatcaagggggacagcggcttctgtgcctgtgatggcggcgtgcccaacacaggccccccaggagagcccggccccccaggcccctggggcctgattggcctgcccggcctgaagggggcccggggggaccggggcagcggcggggcccagggccctgctggggcccctggcctggtgggccccctgggccccagcggccccaagggcaagaagggggagcccatcctgagcaccatccagggcatgcctggggacagaggagacagcggcagccagggcttccggggcgtgattggagagcccgggaaggatggagtgcccggcctgcccggcctgcccggcctgcctggagatggcggccagggcttccctggagagaagggcctgcccggcctgcccggggagaagggccaccctggccccccaggcctgcctggaaatggcctgcccggcctgcccggcccccggggcctgcccggggacaagggcaaggatggcctgcccggccagcagggcctgcccggcagcaagggcatcaccctgccctgcatcatccctggcagctatggccccagcggcttccctggcaccccaggcttccctggccccaagggcagccggggcctgcccggcaccccaggccagcccggcagcagcggcagcaaaggagagcccggcagccctggcctggtgcacctgcctgagctgcccggcttccctggccccagaggagagaagggcctgcccggcttccctggcctgcccgggaaggatggcctgcccggcatgattggcagccctggcctgcccggcagcaagggggccactggagacatctttggagcagaaaatggagcccctggagagcagggcctgcagggcctgaccggccacaagggcttcctgggggacagcggcctgcccggcctgaagggcgtgcacggcaagccaggcctgctgggccccaagggggagcggggcagccctggcaccccaggccaggtgggccagcccggcaccccaggcagcagcggcccctacggcatcaagggcaagagcggcctgcccggggcccctggcttccctggcatcagcggccaccctgggaagaagggcacccggggcaagaagggccccccaggcagcatcgtgaagaagggcctgcccggcctgaagggcctgcccggcaaccctggcctggtgggcctgaagggcagccctggcagccctggggtggccggcctgcctgccctgagcggccccaagggggagaagggctctgtgggctttgtgggcttccctggcatccctggcctgcccggcatccctggcacccggggcctgaagggcatccctggcagcacaggcaagatgggccccagcggccgggccggcaccccaggagagaagggggaccggggcaaccctggccctgtgggcatccccagcccccggcggcccatgagcaacctgtggctgaagggggacaagggcagccagggcagcgctggcagcaatggcttccctggccccaggggggacaagggggaggccggccggcccggccccccaggcctgcccggggcccctggcctgcccggcatcatcaagggcgtgtctgggaagccaggccccccaggcttcatgggcatccggggcctgcccggcctgaagggcagcagcggcatcaccggcttccctggcatgcctggagagagcggcagccagggcatccggggcagccctggcctgcccggggccagcggcctgcccggcctgaagggggacaatggccagacagtggagatcagcggcagccctggccccaagggccagcccggggagagcggcttcaagggcaccaagggcagagatggcctgattggcaacatcggcttccctggcaacaagggggaggatggcaaggtgggcgtgtctggagatgtgggcctgcccggggcccctggcttccctggggtggccggcatgagaggagagcccggcctgcccggcagcagcggccaccagggcgccatcggccccctgggcagccctggcctgattggccccaagggcttccctggcttccctggcctgcacggcctgaatggcctgcccggcaccaagggcacccacggcaccccaggccccagcatcactggagtgcccggccctgctggcctgcccggccccaagggggagaagggctacccaggcattggaattggagcccctgggaagccaggcctgcggggccagaagggggaccggggcttccctggcctgcagggccctgctggcctgcccggggcccctggcatcagcctgcccagcctgattgctggccagcccggggaccccggccggcccggcctggatggagagcggggccggcccggccctgctggccccccaggccccccaggccccagcagcaaccagggcgacaccggggaccccggcttccctggcatccctggcttcagcggcctgcctggagagctgggcctgaagggcatgagaggagagcccggcttcatgggcaccccaggcaaggtgggccccccaggggaccccggcttccctggcatgaagggcaaggccggcccccggggcagcagcggcctgcagggcgaccccggccagacccccacagctgaggccgtgcaggtgcccccaggccccctgggcctgcccggcattgatggcatccctggcctgactggagaccccggggcccagggccctgtgggcctgcagggcagcaagggcctgcccggcatccctgggaaggatggccccagcggcctgcccggccccccaggggccctgggggaccccggcctgcccggcctgcagggccccccaggctttgaaggagcccctggccagcagggccccttcggcatgcctggcatgcctggccagagcatgagggtgggctacaccctggtgaagcacagccagagcgagcaggtgcccccctgccccatcggcatgagccagctgtgggtgggctacagcctgctgtttgtggagggccaggagaaggcccacaaccaggacctgggctttgctggcagctgcctgccccgcttcagcaccatgcccttcatctactgcaacatcaatgaggtgtgccactacgccaggagaaatgacaagagctactggctgagcaccacagcccccatccccatgatgcctgtgtcccagacccagatcccccagtacatcagccgctgcagcgtgtgtgaggcccccagccaggccatcgctgtgcacagccaggacatcaccatcccccagtgccccctgggctggaggagcctgtggattggctacagcttcctgatgcacacagctgctggagctgagggcggcggccagagcctggtgtccccaggcagctgcctggaggacttccgggccacccccttcatcgagtgcagcggggcccggggcacctgccactactttgccaacaagtacagcttctggctgaccaccgtggaggagcggcagcagtttggagagctgcctgtgtctgagaccctgaaggccggccagctgcacaccagggtgagccgctgccaggtgtgcatgaagagcctgtag

SEQ ID NO: 148071 - DNA, 3087 bp, Artificial Sequence
  Description of Artificial Sequence: Synthetic coding sequence
atgagagctgcccgggccctgctgcccctgctgctgcaggcctgctggacagctgcccaggatgagcctgagacccccagggctgtggccttccaggactgccctgtggacctcttctttgtgctggacaccagcgagagcgtggccctgcggctgaagccctatggagccctggtggacaaggtgaagagcttcaccaagcgcttcatcgacaacctgcgggaccgctactaccgctgtgacaggaacctggtgtggaatgctggggccctgcactacagtgatgaggtggagatcatccagggcctgaccaggatgcctgggggcagagatgccctgaagagctctgtggatgctgtgaagtactttgggaagggcacctacacagactgtgccatcaagaagggcctggagcagctgctggtgggcggcagccacctgaaggagaacaagtacctgattgtggtgacagatggccaccccctggagggctacaaggagccctgtggcggcctggaggatgctgtgaatgaggccaagcacctgggcgtgaaggtgttttctgtggccatcaccccagaccacctggagccccggctgagcatcatcgccacagaccacacctacagaagaaacttcaccgctgctgactggggccagagcagagatgctgaggaggccatcagccagaccatcgacaccatcgtggacatgatcaagaacaacgtggagcaggtgtgctgcagctttgagtgccagcctgcccggggccccccaggcctgcggggggaccccggctttgaaggagagcggggcaagccaggcctgcctggagagaagggggaggccggggaccccggccggcctggggacctgggccctgtgggctaccagggcatgaagggggagaagggcagcagaggagagaagggcagccggggccccaagggctacaagggggagaagggcaagaggggcattgatggagtggatggagtgaagggggagatgggctacccaggcctgcccggctgcaagggcagccctggctttgatggcatccagggccccccaggccccaagggggaccccggggccttcggcctgaagggggagaagggggagcccggggctgatggagaggccggccggcccggcagcagcggccccagcggagatgagggccagcctggagagcccggccccccaggagagaagggggaggccggagatgagggcaaccctggcccagatggagcccctggagagcggggcggccctggagagcggggcccccggggcaccccaggcacccggggccccaggggggaccctggagaggccggcccccagggcgaccagggccgggagggccctgtgggcgtgcctggggaccccggggaggccggccccatcggccccaagggctacagaggagatgagggccccccaggcagcgagggcgcccggggggcccctggccctgctggccccccaggggaccccggcctgatgggagagcggggggaggatggccctgctggaaatggaacagagggcttccctggcttccctggctacccaggcaacagaggagcccctggcatcaatggcaccaagggctacccaggcctgaagggagatgaaggagaggccggggaccctggagatgacaacaatgacatcgccccccggggcgtgaagggggccaagggctaccggggccctgagggcccccagggccccccaggccaccagggccccccaggcccagatgaatgtgagatcctggacatcatcatgaagatgtgcagctgctgtgagtgcaagtgtggccccatcgacctgctgtttgtgctggacagcagcgagagcatcggcctgcagaactttgaaattgccaaggactttgtggtgaaggtgattgaccggctgagcagagatgagctggtgaagtttgagcccggccagagctatgctggggtggtgcagtacagccacagccagatgcaggagcacgtgtccctgcggagccccagcatcagaaatgtgcaggagctgaaggaggccatcaagagcctgcagtggatggccggcggcaccttcaccggggaggccctgcagtacacccgggaccagctgctgccccccagccccaacaacagaattgccctggtgatcacagatggccgcagtgacacccagagggacaccacccccctgaatgtgctgtgcagccctggcatccaggtggtgtctgtgggcatcaaggatgtgtttgacttcatccctggcagtgaccagctgaatgtcatcagctgccagggcctggcccccagccagggccggcccggcctgagcctggtgaaggaaaattatgcagagctgctggaggatgccttcctgaagaatgtgacagcccagatctgcatcgacaagaagtgcccagactacacctgccccatcaccttcagcagccctgctgacatcaccatcctgctggatggcagcgcctctgtgggcagccacaactttgacaccaccaagagatttgccaagaggctggccgagcgcttcctgacagctggccgcacagatcctgcccatgatgtgcgggtggccgtggtgcagtacagcggcaccggccagcagaggcctgagcgggccagcctgcagttcctgcagaactacacagccctggccagcgctgtggatgccatggacttcatcaatgatgccacagatgtgaatgatgccctgggctacgtgacccgcttctaccgggaggccagcagcggggccgccaagaagaggctgctgctcttcagtgatggcaacagccagggcgccaccccagctgccatcgagaaggctgtgcaggaggcccagagagctggcatcgagatctttgtggtggtggtgggccggcaggtgaatgagccccacatccgggtgctggtgacaggcaagacagcagaatatgatgtggcctacggggagagccacctgttccgggtgcccagctaccaggccctgctgcggggcgtcttccaccagacagtgtccaggaaggtggccctgggctag

SEQ ID NO: 148072 - DNA, 1770 bp, Artificial Sequence
  Description of Artificial Sequence: Synthetic coding sequence
atgagagctgcccgggccctgctgcccctgctgctgcaggcctgctggacagctgcccaggatgagcctgagacccccagggctgtggccttccaggactgccctgtggacctcttctttgtgctggacaccagcgagagcgtggccctgcggctgaagccctatggagccctggtggacaaggtgaagagcttcaccaagcgcttcatcgacaacctgcgggaccgctactaccgctgtgacaggaacctggtgtggaatgctggggccctgcactacagtgatgaggtggagatcatccagggcctgaccaggatgcctgggggcagagatgccctgaagagctctgtggatgctgtgaagtactttgggaagggcacctacacagactgtgccatcaagaagggcctggagcagctgctggtgggcggcagccacctgaaggagaacaagtacctgattgtggtgacagatggccaccccctggagggctacaaggagccctgtggcggcctggaggatgctgtgaatgaggccaagcacctgggcgtgaaggtgttttctgtggccatcaccccagaccacctggagccccggctgagcatcatcgccacagaccacacctacagaagaaacttcaccgctgctgactggggccagagcagagatgctgaggaggccatcagccagaccatcgacaccatcgtggacatgatcaagaacaacgtggagcaggtgtgctgcagctttgagtgccagcctgcccggggccccccaggcctgcggggggaccccggctttgaaggagagcggggcaagccaggcctgcctggagagaagggggaggccggggaccccggccggcctggggacctgggccctgtgggctaccagggcatgaagggggagaagggcagcagaggagagaagggcagccggggccccaagggctacaagggggagaagggcaagaggggcattgatggagtggatggagtgaagggggagatgggctacccaggcctgcccggctgcaagggcagccctggctttgatggcatccagggccccccaggccccaagggggaccccggggccttcggcctgaagggggagaagggggagcccggggctgatggagaggccggccggcccggcagcagcggccccagcggagatgagggccagcctggagagcccggccccccaggagagaagggggaggccggagatgagggcaaccctggcccagatggagcccctggagagcggggcggccctggagagcggggcccccggggcaccccaggcacccggggccccaggggggaccctggagaggccggcccccagggcgaccagggccgggagggccctgtgggcgtgcctggggaccccggggaggccggccccatcggccccaagggctacagaggagatgagggccccccaggcagcgagggcgcccggggggcccctggccctgctggccccccaggggaccccggcctgatgggagagcggggggaggatggccctgctggaaatggaacagagggcttccctggcttccctggctacccaggcaacagaggagcccctggcatcaatggcaccaagggctacccaggcctgaagggagatgaaggagaggccggggaccctggagatgacaacaatgacatcgccccccggctgctgcgggtgctgctggtgacaggcctggacctgggccccacagccctggaggccgctgctgaccagcactag

SEQ ID NO: 148073 - DNA, 324 bp, Artificial Sequence
  Description of Artificial Sequence: Synthetic coding sequence
atgagagctgcccgggccctgctgcccctgctgctgcaggcctgctggacagctgcccaggatgagcctgagacccccagggctgtggccttccaggactgccctgtggacctcttctttgtgctggacaccagcgagagcgtggccctgcggctgaagccctatggagccctggtggacaaggtgaagagcttcaccaagcgcttcatcgacaacctgcgggaccgctactaccgctgtgacaggaacctggtgtggaatgctggggccctgcactacagtgatgaggtggagatcatccagggcctgaccaggatgccctag

SEQ ID NO: 148074 - DNA, 3060 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagcccagacaccacagaaagaaacaacaactgcccagagaagacagactgccccatccacgtgtactttgtgctggacaccagcgagagcgtgaccatgcagagccccacagacatcctgctcttccacatgaagcagtttgtgccccagttcatcagccagctgcagaatgagttctacctggaccaggtggccctgtcctggaggtatggaggcctgcacttcagtgaccaggtggaggtgttcagccccccaggcagtgaccgggccagcttcatcaagaacctgcagggcatcagcagcttcagaagaggcaccttcacagactgtgccctggccaacatgacagagcagatccggcaggacaggagcaaaggaacagtgcactttgctgtggtgatcacagatggccacgtgacaggcagcccctgtggcggcatcaagctgcaggccgagcgggcccgggaggagggcatccggctgtttgctgtggcccccaaccagaacctgaaggagcagggcctgcgggacatcgccagcacccctcatgagctgtacagaaatgactatgccaccatgctgcctgacagcacagaaattgaccaggacaccatcaaccgcatcatcaaggtgatgaagcatgaggcctatggagagtgctacaaggtgtcctgcctggagatccctggccccagcggccccaagggctaccggggccagaagggggccaagggcaacatgggagagcccggggagcccggccagaagggccggcagggcgaccccggcatcgagggccccatcggcttccctggccccaagggcgtgcccggcttcaagggggagaagggggagtttggagcagatggcaggaagggggcccctggcctggccggcaagaatggaacagatggccagaagggcaagctgggcagaattggccccccaggctgcaagggggaccccggcaacagaggaccagatggctacccaggagaggccggcagccctggagagcggggggaccagggcggcaagggggaccccggccggcccggccggcggggccccccaggagaaattggagccaagggcagcaagggctaccagggcaacagcggggcccctggcagccctggggtgaagggggccaagggcggccctggcccccggggccccaagggggagcctggaagaagaggagaccccggcaccaagggcagccctggcagtgatggccccaagggggagaagggggaccccggccctgagggcccccggggcctggccggggaggtgggcaacaagggggccaagggggaccggggcctgcccggcccccggggcccccagggcgccctgggggagcccgggaagcagggcagcagaggagaccctggagatgctggccccaggggggacagcggccagcccggccccaagggggaccccggccggcccggcttctcctacccaggccccaggggggcccctggagagaagggggagcccggcccccggggccctgagggcggccgcggggactttggcctgaagggggagcccggcaggaaaggagagaagggggagcctgctgaccccggccccccaggagagcccggcccccggggcccccggggcgtgcccggccctgagggggagcccggccccccaggggaccccggcctgacagaatgtgatgtgatgacctacgtgcgggagacctgtggctgctgtgactgtgagaagagatgtggggccctggatgtggtgtttgtgattgacagcagcgagagcatcggctacaccaacttcaccctggagaagaactttgtgatcaacgtggtgaaccggctgggcgccatcgccaaggaccccaagtctgagaccggcaccagggtgggcgtggtgcagtacagccatgagggcacctttgaggccatccagctggatgatgaaagaattgacagcctgagcagcttcaaggaggccgtgaagaacctggagtggattgctgggggcacctggaccccatctgccctgaagtttgcctatgacaggctcatcaaggagagccggcggcagaagaccagggtgtttgctgtggtgatcacagatggaagacatgaccccagagatgatgacctgaacctgcgggccctgtgtgacagagatgtgacagtgacagccatcggcattggagacatgttccacgagaagcatgaaagtgagaacctgtacagcatcgcctgtgacaagccccagcaggtgaggaacatgaccctcttcagtgacctggtggccgagaagttcattgatgacatggaggatgtgctgtgcccagacccccagatcgtgtgcccagacctgccctgccagacagagctgtctgtggcccagtgcacccagaggcctgtggacatcgtgttcctgctggatggcagcgagcggctgggggagcagaacttccacaaggccaggagatttgtggagcaggtggcccggcggctgaccctggccaggagagatgatgaccccctgaatgcccgggtggccctgctgcagtttggaggccctggagagcagcaggtggccttccccctgagccacaacctgacagccatccacgaggccctggagaccacccagtacctgaacagcttcagccacgtgggcgccggcgtggtgcacgccatcaatgccatcgtgcgcagcccccggggcggggccaggagacatgctgagctgagctttgtgttcctgacagatggagtgactggaaatgacagcctgcacgagagcgcccacagcatgaggaagcagaatgtggtgcccaccgtgctggccctgggcagtgatgtggacatggatgtgctgaccaccctgagcctgggggacagagctgctgtgttccacgagaaggactatgacagcctggcccagcccggcttctttgaccgcttcatccgctggatctgctag

SEQ ID NO: 148075 - DNA, 2487 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagcccagacaccacagaaagaaacaacaactgcccagagaagacagactgccccatccacgtgtactttgtgctggacaccagcgagagcgtgaccatgcagagccccacagacatcctgctcttccacatgaagcagtttgtgccccagttcatcagccagctgcagaatgagttctacctggaccaggtggccctgtcctggaggtatggaggcctgcacttcagtgaccaggtggaggtgttcagccccccaggcagtgaccgggccagcttcatcaagaacctgcagggcatcagcagcttcagaagaggcaccttcacagactgtgccctggccaacatgacagagcagatccggcaggacaggagcaaaggaacagtgcactttgctgtggtgatcacagatggccacgtgacaggcagcccctgtggcggcatcaagctgcaggccgagcgggcccgggaggagggcatccggctgtttgctgtggcccccaaccagaacctgaaggagcagggcctgcgggacatcgccagcacccctcatgagctgtacagaaatgactatgccaccatgctgcctgacagcacagaaattgaccaggacaccatcaaccgcatcatcaaggtgatgaagcatgaggcctatggagagtgctacaaggtgtcctgcctggagatccctggccccagcggccccaagggctaccggggccagaagggggccaagggcaacatgggagagcccggggagcccggccagaagggccggcagggcgaccccggcatcgagggccccatcggcttccctggccccaagggcgtgcccggcttcaagggggagaagggggagtttggagcagatggcaggaagggggcccctggcctggccggcaagaatggaacagatggccagaagggcaagctgggcagaattggccccccaggctgcaagggggaccccggcaacagaggaccagatggctacccaggagaggccggcagccctggagagcggggggaccagggcggcaagggggaccccggccggcccggccggcggggccccccaggagaaattggagccaagggcagcaagggctaccagggcaacagcggggcccctggcagccctggggtgaagggggccaagggcggccctggcccccggggccccaagggggagcctggaagaagaggagaccccggcaccaagggcagccctggcagtgatggccccaagggggagaagggggaccccggccctgagggcccccggggcctggccggggaggtgggcaacaagggggccaagggggaccggggcctgcccggcccccggggcccccagggcgccctgggggagcccgggaagcagggcagcagaggagaccctggagatgctggccccaggggggacagcggccagcccggccccaagggggaccccggccggcccggcttctcctacccaggccccaggggggcccctggagagaagggggagcccggcccccggggccctgagggcggccgcggggactttggcctgaagggggagcccggcaggaaaggagagaagggggagcctgctgaccccggccccccaggagagcccggcccccggggcccccggggcgtgcccggccctgagggggagcccggccccccaggggaccccggcctgacagaatgtgatgtgatgacctacgtgcgggagacctgtggctgctgtgactgtgagaagagatgtggggccctggatgtggtgtttgtgattgacagcagcgagagcatcggctacaccaacttcaccctggagaagaactttgtgatcaacgtggtgaaccggctgggcgccatcgccaaggaccccaagtctgagaccggcaccagggtgggcgtggtgcagtacagccatgagggcacctttgaggccatccagctggatgatgaaagaattgacagcctgagcagcttcaaggaggccgtgaagaacctggagtggattgctgggggcacctggaccccatctgccctgaagtttgcctatgacaggctcatcaaggagagccggcggcagaagaccagggtgtttgctgtggtgatcacagatggaagacatgaccccagagatgatgacctgaacctgcgggccctgtgtgacagagatgtgacagtgacagccatcggcattggagacatgttccacgagaagcatgaaagtgagaacctgtacagcatcgcctgtgacaagccccagcaggtgaggaacatgaccctcttcagtgacctggtggccgagaagttcattgatgacatggaggatgtgctgtgcccagacccccagatcgtgtgcccagacctgccctgccagacaggcctggatggagctgtgctgtgctag

SEQ ID NO: 148076 - DNA, 2757 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagcccagacaccacagaaagaaacaacaactgcccagagaagacagactgccccatccacgtgtactttgtgctggacaccagcgagagcgtgaccatgcagagccccacagacatcctgctcttccacatgaagcagtttgtgccccagttcatcagccagctgcagaatgagttctacctggaccaggtggccctgtcctggaggtatggaggcctgcacttcagtgaccaggtggaggtgttcagccccccaggcagtgaccgggccagcttcatcaagaacctgcagggcatcagcagcttcagaagaggcaccttcacagactgtgccctggccaacatgacagagcagatccggcaggacaggagcaaaggaacagtgcactttgctgtggtgatcacagatggccacgtgacaggcagcccctgtggcggcatcaagctgcaggccgagcgggcccgggaggagggcatccggctgtttgctgtggcccccaaccagaacctgaaggagcagggcctgcgggacatcgccagcacccctcatgagctgtacagaaatgactatgccaccatgctgcctgacagcacagaaattgaccaggacaccatcaaccgcatcatcaaggtgatgaagcatgaggcctatggagagtgctacaaggtgtcctgcctggagatccctggccccagcggccccaagggctaccggggccagaagggggccaagggcaacatgggagagcccggggagcccggccagaagggccggcagggcgaccccggcatcgagggccccatcggcttccctggccccaagggcgtgcccggcttcaagggggagaagggggagtttggagcagatggcaggaagggggcccctggcctggccggcaagaatggaacagatggccagaagggcaagctgggcagaattggccccccaggctgcaagggggaccccggcaacagaggaccagatggctacccaggagaggccggcagccctggagagcggggggaccagggcggcaagggggaccccggccggcccggccggcggggccccccaggagaaattggagccaagggcagcaagggctaccagggcaacagcggggcccctggcagccctggggtgaagggggccaagggcggccctggcccccggggccccaagggggagcctggaagaagaggagaccccggcaccaagggcagccctggcagtgatggccccaagggggagaagggggaccccggccctgagggcccccggggcctggccggggaggtgggcaacaagggggccaagggggaccggggcctgcccggcccccggggcccccagggcgccctgggggagcccgggaagcagggcagcagaggagaccctggagatgctggccccaggggggacagcggccagcccggccccaagggggaccccggccggcccggcttctcctacccaggccccaggggggcccctggagagaagggggagcccggcccccggggccctgagggcggccgcggggactttggcctgaagggggagcccggcaggaaaggagagaagggggagcctgctgaccccggccccccaggagagcccggcccccggggcccccggggcgtgcccggccctgagggggagcccggccccccaggggaccccggcctgacagaatgtgatgtgatgacctacgtgcgggagacctgtggctgctgtgactgtgagaagagatgtggggccctggatgtggtgtttgtgattgacagcagcgagagcatcggctacaccaacttcaccctggagaagaactttgtgatcaacgtggtgaaccggctgggcgccatcgccaaggaccccaagtctgagaccggcaccagggtgggcgtggtgcagtacagccatgagggcacctttgaggccatccagctggatgatgaaagaattgacagcctgagcagcttcaaggaggccgtgaagaacctggagtggattgctgggggcacctggaccccatctgccctgaagtttgcctatgacaggctcatcaaggagagccggcggcagaagaccagggtgtttgctgtggtgatcacagatggaagacatgaccccagagatgatgacctgaacctgcgggccctgtgtgacagagatgtgacagtgacagccatcggcattggagacatgttccacgagaagcatgaaagtgagaacctgtacagcatcgcctgtgacaagccccagcaggtgaggaacatgaccctcttcagtgacctggtggccgagaagttcattgatgacatggaggatgtgctgtgcccagacccccagatcgtgtgcccagacctgccctgccagacagatgccccctggccaggaggagagccccctgtgaccttcctgaggacagaggagggcccagatgccaccttccccaggaccatccccctcatccagcagctgctgaatgccacagagctgacccaggaccctgctgcctacagccagctggtggccgtgctggtgtacacagctgagcgggccaagtttgccactggagtggagcggcaggactggatggagctgttcatcgacaccttcaagctggtgcaccgggacatcgtgggggaccctgagacagccctggccctgtgctag

SEQ ID NO: 148077 - DNA, 2757 bp, Artificial Sequence; identical to SEQ ID NO: 148076
  Description of Artificial Sequence: Synthetic coding sequence

SEQ ID NO: 148078 - DNA, 2487 bp, Artificial Sequence; identical to SEQ ID NO: 148075
  Description of Artificial Sequence: Synthetic coding sequence

SEQ ID NO: 148079 - DNA, 543 bp, Artificial Sequence
  Description of Artificial Sequence: Synthetic coding sequence
atgctgcagggcacctgcagcgtgctgctgctgtggggcatcctgggcgccatccaggcccagcagcaggaggtgatcagcccagacaccacagaaagaaacaacaactgcccagagaagacagactgccccatccacgtgtactttgtgctggacaccagcgagagcgtgaccatgcagagccccacagacatcctgctcttccacatgaagcagtttgtgccccagttcatcagccagctgcagaatgagttctacctggaccaggtggccctgtcctggaggtatggaggcctgcacttcagtgaccaggtggaggtgttcagccccccaggcagtgaccgggccagcttcatcaagaacctgcagggcatcagcagcttcagaagaggcaccttcacagactgtgccctggccaacatgacagagcagatccggcaggacaggagcaaaggaacagtgcactttgctgtggtgatcacagatggccacgtgacaggcagcccctgtggcggcatcaagctgcaggccgagcgggcctag

SEQ ID NO: 148080 - DNA, 2235 bp, Artificial Sequence
  Description of Artificial Sequence: Synthetic coding sequence
atggctgtgctgcccggccccctgcagctgctgggcgtgctgctgaccatcagcctgagcagcatccgcctcatccaggccggggcctactacggcatcaagcccctgcccccccagatccccccccagatgccaccccagatcccccagtaccagcccctgggccagcaggtgccccacatgcccctggccaaggatggcctggccatgggcaaggagatgccccacctgcagtatggcaaggagtacccccacctgccccagtacatgaaggagatccagcctgcccccaggatgggcaaggaggccgtgcccaagaagggcaaggagatccccctggccagcctgcggggggagcagggccccagaggagagcccggcccccggggccccccaggccccccaggcctgcccggccacggcatccctggcatcaagggcaagccaggcccccagggctacccaggagtgggcaagccaggcatgcctggcatgcctgggaagccaggggccatgggcatgcctggggccaagggggagatcggccagaagggggagatcggccccatgggcatccctggcccccagggccccccaggcccccacggcctgcccggcatcggcaagccaggcggccctggcctgcccggccagcccggccccaagggggaccggggccccaagggcctgcccggcccccagggcctgcggggccccaagggggacaagggcttcggcatgcctggggcccctggggtgaagggccccccaggcatgcacggccccccaggccctgtgggcctgcccggggtgggcaagccaggagtgacaggcttccctggcccccagggccccctgggcaagccaggggcccctggagagcccggcccccagggccccatcggcgtgcctggggtgcagggccccccaggcatccctggcatcggcaagccaggccaggacggcatccctggccagcccggcttccctgggggcaaaggagagcagggcctgcccggcctgcccggccccccaggcctgcccggcatcggcaagccaggcttccctggccccaagggggaccggggcatgggcggcgtgcctggggccctgggccccagaggagagaagggccccatcggggcccctggcattggaggccccccaggagagcccggcctgcccggcatccctggccccatgggccccccaggggccatcggcttccctggccccaagggggagggcggcatcgtgggcccccagggccccccaggccccaagggggagcccggcctgcagggcttccctgggaagccaggcttcctgggggaggtgggccccccaggcatgaggggcctgcccggccccatcggccccaagggggaggccggccagaagggcgtgcccggcctgcccggggtgcccggcctgctgggccccaagggggagcccggcatccctggggaccagggcctgcagggccccccaggcatccctggcatcggcggccccagcggccccatcggccccccaggcatccctggccccaagggggagcccggcctgcccggccccccaggcttccctggcatcggcaagccaggagtggccggcctgcacggccccccaggcaagccaggggccctgggcccccagggccagcccggcctgcccggccccccaggccccccaggccccccaggccccccagctgtgatgccacccaccccaccaccccagggcgagtacctgcctgacatgggcctgggcattgatggagtgaagccccctcatgcctatggagccaagaagggcaagaatggaggccctgcctatgagatgcctgccttcaccgctgagctgacagcccccttcccccctgtgggcgcccctgtgaagttcaacaagctgctgtacaacggccggcagaactacaacccccagacaggcatcttcacctgtgaggtgcctggggtgtactactttgcctaccacgtgcactgcaagggcggcaatgtgtgggtggccctcttcaagaacaatgaacctgtgatgtacacctatgatgagtacaagaagggcttcctggaccaggccagcggcagcgctgtgctgctgctgcggcctggggacagagtcttcctgcagatgcccagcgagcaggccgccggcctgtatgccggccagtatgtgcacagcagcttcagcggctacctgctgtaccccatgtag

SEQ ID NO: 148081 - DNA, 2235 bp, Artificial Sequence; identical to SEQ ID NO: 148080
  Description of Artificial Sequence: Synthetic coding sequence

SEQ ID NO: 148082 - DNA, 345 bp, Artificial Sequence
  Description of Artificial Sequence: Synthetic coding sequence
atggctgtgctgcccggccccctgcagctgctgggcgtgctgctgaccatcagcctgagcagcatccgcctcatccaggccggggcctactacggcatcaagcccctgcccccccagatccccccccagatgccaccccagatcccccagtaccagcccctgggccagcaggtgccccacatgcccctggccaaggatggcctggccatgggcaaggagatgccccacctgcagtatggcaaggagtacccccacctgccccagtacatgaaggagatccagcctgcccccaggatgggcaaggaggccgtgcccaagaagggcaaggagatccccctggcctag

SEQ ID NO: 148083 - DNA, 2061 bp, Artificial Sequence
  Description of Artificial Sequence: Synthetic coding sequence
atggtggccgagaggacccacaaggccgccgccaccggggcccggggccctggagagctgggcgcccctggcaccgtggccctggtggccgcccgggcagagcggggggcccggctgcccagccctggcagctgtggcctgctgaccctggccctgtgcagcctggccctgagcctgctggcccacttcagaacagctgagctgcaggcccgggtgctgcggctggaggccgagcggggggagcagcagatggagacagccatcctgggccgggtgaaccagctgctggatgagaagtggaagctgcacagcagaagaagaagagaggcccccaagaccagccctggctgcaactgccccccaggccccccaggccccaccggccggcccggcctgcccggggacaagggggccatcggcatgcctggccgggtgggcagccctggagatgctggcctgagcatcatcggcccccggggccccccaggccagcccggcacccggggcttccctggcttccctggccccatcggcctggatggcaagccaggccaccctggccccaagggggacatgggcctgactggacctcctggccagcccggcccccagggccagaagggggagaagggccagtgtggggagtacccccaccggctgctgcccctgctgaacagcgtgcggctggcccctcctcctgtgatcaagaggaggaccttccagggcgagcagagccaggccagcatccagggccccccaggccccccaggccccccaggccccagcggccccctgggccaccctggcctgcccggccccatgggccccccaggcctgcccggccccccaggccccaagggggaccccggcatccagggctaccacggcaggaagggggagcggggcatgcctggcatgcctgggaagcacggggccaagggggcccctggcattgctgtggccggcatgaagggggagcccggcatccctggcaccaagggggagaagggagctgagggcagccctggcctgcccggcctgctgggccagaagggggagaagggagatgctggcaacagcattggaggcggccgcggggagcccggccccccaggcctgcccggccccccaggccccaagggggaggccggcgtggatggccaggtgggccccccaggccagcccggggacaagggggagagaggagctgctggggagcagggcccagatggccccaagggcagcaagggggagcctggaaaaggagagatggtggactacaacggcaacatcaatgaggccctgcaggagatccgcaccctggccctgatgggccccccaggcctgcccggccagatcggccccccaggggcccctggcatccctggccagaagggggagatcggcctgcccggccccccaggccatgatggagagaagggcccccggggcaagccaggggacatgggccccccaggcccccagggccccccaggcaaggatggccccccaggagtgaagggagaaaatggccaccctggcagccctggagagaagggggagaagggggagaccggccaggccggcagccctggagagaagggggaggccggggagaagggcaaccctggagctgaggtgcccggcctgcccggccctgagggccccccaggccccccaggcctgcagggcgtgcccggccccaagggggaggccggcctggatggagccaagggggagaagggcttccagggcgagaagggggaccggggccccctgggcctgcccggcaccccaggccccatcggcgtgcccggccctgctggccccaagggggagcggggcagcaaaggagaccccggcatgacaggccccaccggggctgctggcctgcccggcctgcacggccccccaggggacaagggcaacagaggagagcggggcaagaagggcagccggggccccaagggggacaagggggaccagggcgcccctggcctggatgccccctgccccctgggagaagatggcctgcctgtgcagggctgctggaacaagtag

SEQ ID NO: 148084 - DNA, 1338 bp, Artificial Sequence
  Description of Artificial Sequence: Synthetic coding sequence
atgacaggcagcagcttcagcctggcccacctgctgatcatcagcggcctgctgtgctacagcgctggctgcctggccctgcccagcctggaccagaagaagaggggcggccacaaggcctgctgcctgctgaccccacctcctcctcctctcttccccccacccttcttccggggcggccgcagccccctgctgagcccagacatgaagaacctgatgctggagctggagaccagccagagcccctgcatgcagggcagcctgggcagccctggccccccaggcccccagggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagggccagaagggggacagcggcgtgatgggccccccaggcaagccaggccccagcggccagcccggccggcccggccccccaggccccccacctgctggccagctgatcatgggccccaagggggagcggggcttccctggccccccaggccgctgcctgtgtggccccaccatgaatgtgaacaaccccagctatggagagagcgtgtatggccccagcagcccccgggtgcctgtgatctttgtggtgaacaaccaggaggagctggagcggctgaacacccagaatgccatcgccttccggcgggaccagaggagcctgtacttcaaggacagcctgggctggctgcccatccagctgacccccttctaccctgtggactacacagctgaccagcacggcacctgtggagatggcctgctgcagcccggggaggagtgtgatgatggcaacagtgatgtgggagatgactgcatccgctgccaccgggcctactgtggagatggccacagacatgaaggagtggaggactgtgatggcagtgactttggctacctgacctgtgagacctacctgcccggcagctatggagacctgcagtgcacccagtactgctacatcgacagcaccccctgccgctacttcacctag

SEQ ID NO: 148085 - DNA, 876 bp, Artificial Sequence
  Description of Artificial Sequence: Synthetic coding sequence
atggtggtgctgaaccccatgaccctgggcatctacctgcagctgttcttcctgagcatcgtgtcccagcccaccttcatcaacagcgtgctgcccatctctgctgccctgcccagcctggaccagaagaagaggggcggccacaaggcctgctgcctgctgaccccacctcctcctcctctcttccccccacccttcttccggggcggccgcagccccctgctgagcccagacatgaagaacctgatgctggagctggagaccagccagagcccctgcatgcagggcagcctgggcagccctggccccccaggcccccagggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagagcagcaggaccccctgcaccctgcccaggaggcctcctgtgccctgtggccagggcagccgcagccctgtgacagtggtggccggcaaggagagccaggcctgcctgctgcccaggtttgaggaggactacatcagcagcggcacagagcggggctag

SEQ ID NO: 148086 - DNA, 1266 bp, Artificial Sequence
  Description of Artificial Sequence: Synthetic coding sequence
atggtggtgctgaaccccatgaccctgggcatctacctgcagctgttcttcctgagcatcgtgtcccagcccaccttcatcaacagcgtgctgcccatctctgctgccctgcccagcctggaccagaagaagaggggcggccacaaggcctgctgcctgctgaccccacctcctcctcctctcttccccccacccttcttccggggcggccgcagccctggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagggccagaagggggacagcggcgtgatgggccccccaggcaagccaggccccagcggccagcccggccggcccggccccccaggccccccacctgctggccagctgatcatgggccccaagggggagcggggcttccctggccccccaggccgctgcctgtgtggccccaccatgaatgtgaacaaccccagctatggagagagcgtgtatggccccagcagcccccgggtgcctgtgatctttgtggtgaacaaccaggaggagctggagcggctgaacacccagaatgccatcgccttccggcgggaccagaggagcctgtacttcaaggacagcctgggctggctgcccatccagctgacccccttctaccctgtggactacacagctgaccagcacggcacctgtggagatggcctgctgcagcccggggaggagtgtgatgatggcaacagtgatgtgggagatgactgcatccgctgccaccgggcctactgtggagatggccacagacatgaaggagtggaggactgtgatggcagtgactttggctacctgacctgtgagacctacctgcccggcagctatggagacctgcagtgcacccagtactgctacatcgacagcaccccctgccgctacttcacctag

SEQ ID NO: 148087 - DNA, 1341 bp, Artificial Sequence
  Description of Artificial Sequence: Synthetic coding sequence
atggtggtgctgaaccccatgaccctgggcatctacctgcagctgttcttcctgagcatcgtgtcccagcccaccttcatcaacagcgtgctgcccatctctgctgccctgcccagcctggaccagaagaagaggggcggccacaaggcctgctgcctgctgaccccacctcctcctcctctcttccccccacccttcttccggggcggccgcagccccctgctgagcccagacatgaagaacctgatgctggagctggagaccagccagagcccctgcatgcagggcagcctgggcagccctggccccccaggcccccagggccccccaggcctgcccgggaagacaggccccaagggggagaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagggccagaagggggacagcggcgtgatgggccccccaggcaagccaggccccagcggccagcccggccggcccggccccccaggccccccacctgctggccagctgatcatgggccccaagggggagcggggcttccctggccccccaggccgctgcctgtgtggccccaccatgaatgtgaacaaccccagctatggagagagcgtgtatggccccagcagcccccgggtgcctgtgatctttgtggtgaacaaccaggaggagctggagcggctgaacacccagaatgccatcgccttcagaagagaccagaggagcctgtacttcaaggacagcctgggctggctgcccatccagctgacccccttctaccctgtggactacacagctgaccagcacggcacctgtggagatggcctgctgcagcctggagaggagtgtgatgatggcaacagtgatgtgggagatgactgcatccgctgccaccgggcctactgtggagatggccacagacatgagggcgtggaggactgtgatggcagtgactttggctacctgacctgtgagacctacctgcccggcagctatggagacctgcagtgcacccagtactgctacatcgacagcaccccctgccgctacttcacctag

SEQ ID NO: 148088 - DNA, 1368 bp, Artificial Sequence
  Description of Artificial Sequence: Synthetic coding sequence
atggtggtgctgaaccccatgaccctgggcatctacctgcagctgttcttcctgagcatcgtgtcccagcccaccttcatcaacagcgtgctgcccatctctgctgccctgcccagcctggaccagaagaagaggggcggccacaaggcctgctgcctgctgaccccacctcctcctcctctcttccccccacccttcttccggggcggccgcagccccctgctgagcccagacatgaagaacctgatgctggagctggagaccagccagagcccctgcatgcagggcagcctgggcagccctggccccccaggcccccagggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagggccagaagggggacagcggcgtgatgggccccccaggcaagccaggccccagcggccagcccggccggcccggccccccaggccccccacctgctggccagctgatcatgggccccaagggggagcggggcttccctggccccccaggccgctgcctgtgtggccccaccatgaatgtgaacaaccccagctatggagagagcgtgtatggccccagcagcccccgggtgcctgtgatctttgtggtgaacaaccaggaggagctggagcggctgaacacccagaatgccatcgccttccggcgggaccagaggagcctgtacttcaaggacagcctgggctggctgcccatccagctgacccccttctaccctgtggactacacagctgaccagcacggcacctgtggagatggcctgctgcagcccggggaggagtgtgatgatggcaacagtgatgtgggagatgactgcatccgctgccaccgggcctactgtggagatggccacagacatgaaggagtggaggactgtgatggcagtgactttggctacctgacctgtgagacctacctgcccggcagctatggagacctgcagtgcacccagtactgctacatcgacagcaccccctgccgctacttcacctag

SEQ ID NO: 148089 - DNA, 1338 bp, Artificial Sequence; identical to SEQ ID NO: 148084
  Description of Artificial Sequence: Synthetic coding sequence

SEQ ID NO: 148090 - DNA, 585 bp, Artificial Sequence
  Description of Artificial Sequence: Synthetic coding sequence
atcagcggcctgctgtgctacagcgctggctgcctggccctgcccagcctggaccagaagaagagaggaggccacaaggcctgctgcctgctgaccccacctcctccacccctcttccccccacccttcttccggggcggccgcagccctggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagggcttccctggcttccctggcatgctgggccagaagggggagatgggccccaagggggagcccggcattgctggccaccggggccccaccggccggcctgggaagaggggcaagcagggccagaagggggacagcggcgtgatgggccccccatag

SEQ ID NO: 148091 - DNA, 1338 bp, Artificial Sequence
  Description of Artificial Sequence: Synthetic coding sequence
atgacaggcagcagcttcagcctggcccacctgctgatcatcagcggcctgctgtgctacagcgctggctgcctggccctgcccagcctggaccagaagaagaggggcggccacaaggcctgctgcctgctgaccccacctcctcctcctctcttccccccacccttcttccggggcggccgcagccccctgctgagcccagacatgaagaacctgatgctggagctggagaccagccagagcccctgcatgcagggcagcctgggcagccctggccccccaggcccccagggccccccaggcctgcccgggaagacaggccccaagggggagaagggggagctgggccggcccggcaggaagggccggcccggccccccaggagtgcccggcatgcctggccccatcggctggccaggccctgagggccccagaggagagaagggggacctgggcatgatgggcctgcccggcagccggggccccatgggcagcaagggctacccaggcagcagaggagagaagggcagcagaggagagaagggggacctgggccccaagggggagaagtgcaaccccctgctgctgctcttccccagcttccagggcgagatgggccccaagggggagcccggcattgctggccaccggggccccaccggccggcctgggaagaggggcaagcagggccagaagggggacagcggcgtgatgggccccccaggcaagccaggccccagcggccagcccggccggcccggccccccaggccccccacctgctggccagctgatcatgggccccaagggggagcggggcttccctggccccccaggccgctgcctgtgtggccccaccatgaatgtgaacaaccccagctatggagagagcgtgtatggccccagcagcccccgggtgcctgtgatctttgtggtgaacaaccaggaggagctggagcggctgaacacccagaatgccatcgccttccggcgggaccagaggagcctgtacttcaaggacagcctgggctggctgcccatccagctgacccccttctaccctgtggactacacagctgaccagcacggcacctgtggagatggcctgctgcagcccggggaggagtgtgatgatggcaacagtgatgtgggagatgactgcatccgctgccaccgggcctactgtggagatggccacagacatgaaggagtggaggactgtgatggcagtgactttggctacctgacctgtgagacctacctgcccggcagctatggagacctgcagtgcacccagtactgctacatcgacagcaccccctgccgctacttcacctag

SEQ ID NO: 148092 - DNA, 2061 bp, Artificial Sequence
  Description of Artificial Sequence: Synthetic coding sequence
atggctgacagaagaagagcctggaacacagaagatgacctgcctgtgtacctggcccggcccggcagcgctgcccagaccccccggcagaagtatggaggcatgtttgctgctgtggagggcgcctatgagaacaagaccatcgactttgatgcctacagcgtgggcagaagaggcagcgcccggacccccaggtctgctggccgcccagatgctgtgggcctgcccggccctgggggcagcgaggacacagccagtgatgtgtctgagcccagcggcagcgctgtgagcagccctggagagagagatgagcggccccccaccctgcgcatccggcggcctgccccccgggacctgcccctgggccgggacaatggccagagcgaccggctgctgatcaagggcggccgcatcatcaatgatgaccagagcctgtatgcagatgtgtacctggaggatggcctcatcaagcagattggagaaaatctcatcgtgcctgggggcgtgaagaccatcgaggccaatggaaggatggtgattcctgggggcattgatgtgaacacctacctgcagaagcccagccagggcatgacagctgctgatgacttcttccagggcaccagggctgccctggtgggcggcaccaccatgatcatcgaccacgtggtgcctgagcccggcagcagcctgctgaccagctttgagaagtggcatgaggccgctgacaccaagagctgctgtgactacagcctgcacgtggacatcacctcctggtatgatggagtgcgggaggagctggaggtgctggtgcaggacaagggcgtgaacagcttccaggtgtacatggcctacaaggatgtgtaccagatgtctgacagccagctgtatgaggccttcaccttcctgaagggcctgggcgctgtgatcctggtgcatgctgaaaatggagacctgattgcccaggagcagaagaggatcctggagatgggcatcaccggccctgagggccacgccctgagcaggcctgaggagctggaggccgaggccgtgttccgggccatcaccatcgccggccgcatcaactgccctgtgtacatcaccaaggtgatgagcaagtctgctgctgacatcatcgccctggccaggaagaagggccccctggtgtttggagagcccatcgccgccagcctgggcacagatggcacccactactggagcaagaactgggccaaggctgctgcctttgtgaccagcccccccctgagcccagaccccaccaccccagactacctgaccagcctgctggcctgtggggacctgcaggtgactggaagtggccactgcccctacagcacagcccagaaggctgtgggcaaggacaacttcaccctcatccctgagggcgtgaatggcatcgaggagaggatgacagtggtgtgggacaaggctgtggccaccgggaagatggatgagaaccagtttgtggccgtgaccagcaccaatgctgccaagatcttcaacctgtaccccaggaagggcagaattgctgtgggcagtgatgctgatgtggtgatctgggaccctgacaagctgaagaccatcacagccaagagccacaagtctgctgtggagtacaacatctttgagggcatggagtgccacggcagccccctggtggtgatcagccagggcaagatcgtgtttgaagatggcaacatcaacgtgaacaagggcatgggccgcttcatccccaggaaggccttccctgagcacctgtaccagagggtgaagatccggaacaaggtgtttggcctgcagggcgtgtcccggggcatgtatgatggccctgtgtatgaggtgcctgccacccccaagtatgccaccccagcccccagcgccaagagcagccccagcaagcaccagcccccacccatccggaacctgcaccagagcaacttcagcctgagcggggcccagattgatgacaacaaccccaggagaacaggccaccgcatcgtggcccctcctgggggccgcagcaacatcaccagcctgggctag

SEQ ID NO: 148093 - DNA, 1719 bp, Artificial Sequence
  Description of Artificial Sequence: Synthetic coding sequence
atgagctaccagggcaagaagagcatcccccacatcaccagtgaccggctgctgatcaagggcggccgcatcatcaatgatgaccagagcctgtatgcagatgtgtacctggaggatggcctcatcaagcagattggagaaaatctcatcgtgcctgggggcgtgaagaccatcgaggccaatggaaggatggtgattcctgggggcattgatgtgaacacctacctgcagaagcccagccagggcatgacagctgctgatgacttcttccagggcaccagggctgccctggtgggcggcaccaccatgatcatcgaccacgtggtgcctgagcccggcagcagcctgctgaccagctttgagaagtggcatgaggccgctgacaccaagagctgctgtgactacagcctgcacgtggacatcacctcctggtatgatggagtgcgggaggagctggaggtgctggtgcaggacaagggcgtgaacagcttccaggtgtacatggcctacaaggatgtgtaccagatgtctgacagccagctgtatgaggccttcaccttcctgaagggcctgggcgctgtgatcctggtgcatgctgaaaatggagacctgattgcccaggagcagaagaggatcctggagatgggcatcaccggccctgagggccacgccctgagcaggcctgaggagctggaggccgaggccgtgttccgggccatcaccatcgccggccgcatcaactgccctgtgtacatcaccaaggtgatgagcaagtctgctgctgacatcatcgccctggccaggaagaagggccccctggtgtttggagagcccatcgccgccagcctgggcacagatggcacccactactggagcaagaactgggccaaggctgctgcctttgtgaccagcccccccctgagcccagaccccaccaccccagactacctgaccagcctgctggcctgtggggacctgcaggtgactggaagtggccactgcccctacagcacagcccagaaggctgtgggcaaggacaacttcaccctcatccctgagggcgtgaatggcatcgaggagaggatgacagtggtgtgggacaaggctgtggccaccgggaagatggatgagaaccagtttgtggccgtgaccagcaccaatgctgccaagatcttcaacctgtaccccaggaagggcagaattgctgtgggcagtgatgctgatgtggtgatctgggaccctgacaagctgaagaccatcacagccaagagccacaagtctgctgtggagtacaacatctttgagggcatggagtgccacggcagccccctggtggtgatcagccagggcaagatcgtgtttgaagatggcaacatcaacgtgaacaagggcatgggccgcttcatccccaggaaggccttccctgagcacctgtaccagagggtgaagatccggaacaaggtgtttggcctgcagggcgtgtcccggggcatgtatgatggccctgtgtatgaggtgcctgccacccccaagtatgccaccccagcccccagcgccaagagcagccccagcaagcaccagcccccacccatccggaacctgcaccagagcaacttcagcctgagcggggcccagattgatgacaacaaccccaggagaacaggccaccgcatcgtggcccctcctgggggccgcagcaacatcaccagcctgggctag

SEQ ID NO: 148094 - DNA, 1713 bp, Artificial Sequence
  Description of Artificial Sequence: Synthetic coding sequence
atgcagaagatgaacaatgaggtggtggacaagagtgaccggctgctgatcaagggcggccgcatcatcaatgatgaccagagcctgtatgcagatgtgtacctggaggatggcctcatcaagcagattggagaaaatctcatcgtgcctgggggcgtgaagaccatcgaggccaatggaaggatggtgattcctgggggcattgatgtgaacacctacctgcagaagcccagccagggcatgacagctgctgatgacttcttccagggcaccagggctgccctggtgggcggcaccaccatgatcatcgaccacgtggtgcctgagcccggcagcagcctgctgaccagctttgagaagtggcatgaggccgctgacaccaagagctgctgtgactacagcctgcacgtggacatcacctcctggtatgatggagtgcgggaggagctggaggtgctggtgcaggacaagggcgtgaacagcttccaggtgtacatggcctacaaggatgtgtaccagatgtctgacagccagctgtatgaggccttcaccttcctgaagggcctgggcgctgtgatcctggtgcatgctgaaaatggagacctgattgcccaggagcagaagaggatcctggagatgggcatcaccggccctgagggccacgccctgagcaggcctgaggagctggaggccgaggccgtgttccgggccatcaccatcgccggccgcatcaactgccctgtgtacatcaccaaggtgatgagcaagtctgctgctgacatcatcgccctggccaggaagaagggccccctggtgtttggagagcccatcgccgccagcctgggcacagatggcacccactactggagcaagaactgggccaaggctgctgcctttgtgaccagcccccccctgagcccagaccccaccaccccagactacctgaccagcctgctggcctgtggggacctgcaggtgactggaagtggccactgcccctacagcacagcccagaaggctgtgggcaaggacaacttcaccctcatccctgagggcgtgaatggcatcgaggagaggatgacagtggtgtgggacaaggctgtggccaccgggaagatggatgagaaccagtttgtggccgtgaccagcaccaatgctgccaagatcttcaacctgtaccccaggaagggcagaattgctgtgggcagtgatgctgatgtggtgatctgggaccctgacaagctgaagaccatcacagccaagagccacaagtctgctgtggagtacaacatctttgagggcatggagtgccacggcagccccctggtggtgatcagccagggcaagatcgtgtttgaagatggcaacatcaacgtgaacaagggcatgggccgcttcatccccaggaaggccttccctgagcacctgtaccagagggtgaagatccggaacaaggtgtttggcctgcagggcgtgtcccggggcatgtatgatggccctgtgtatgaggtgcctgccacccccaagtatgccaccccagcccccagcgccaagagcagccccagcaagcaccagcccccacccatccggaacctgcaccagagcaacttcagcctgagcggggcccagattgatgacaacaaccccaggagaacaggccaccgcatcgtggcccctcctgggggccgcagcaacatcaccagcctgggctag

SEQ ID NO: 148095 - DNA, 1719 bp, Artificial Sequence; identical to SEQ ID NO: 148093
  Description of Artificial Sequence: Synthetic coding sequence

SEQ ID NO: 148096 - DNA, 834 bp, Artificial Sequence
  Description of Artificial Sequence: Synthetic coding sequence
atgaatggatttgccagcctgctgcggaggaaccagttcatcctgctggtgctcttcctgctgcagatccagagcctgggcctggacatcgacagccggcccacagctgaggtgtgtgccacccacaccatcagccctggccccaagggagatgatggagagaagggggaccccggggaggagggcaagcacggcaaggtgggccgcatgggccccaagggcatcaagggggagctgggggacatgggagaccagggcaacatcggcaagacaggccccatcggcaagaagggggacaagggggagaagggcctgctgggcatccctggagagaagggcaaggccggcaccgtgtgtgactgtggccgctacaggaagtttgtgggccagctggacatcagcatcgcccggctgaagacctccatgaagtttgtgaagaatgtgattgctggcatccgggagacagaggagaagttctactacatcgtgcaggaggagaagaactaccgggagagcctgacccactgccgcatccggggcggcatgctggccatgcccaaggatgaggccgccaacaccctgattgctgactatgtggccaagagcggcttcttccgggtcttcatcggcgtgaatgacctggagcgggagggccagtacatgttcacagacaacacccccctgcagaactacagcaactggaatgaaggagagcccagcgacccctacggccacgaggactgtgtggagatgctgagcagcggccgctggaatgacacagagtgccacctgaccatgtactttgtgtgtgagttcatcaagaagaagaagtag

SEQ ID NO: 148097 - DNA, 807 bp, Artificial Sequence
  Description of Artificial Sequence: Synthetic coding sequence
atgaccccagccctgtgccgcagcagcagcctggccagcaagggcatgagggagcggcgggagaccaaggcccccccagatggcctggaggagagcgccccccgggagaagaagcagagccagcctgtggtgacagccagtgacatcagcaagaggaagtgcaccagcagctttgtggagatgggcagccagggcgacatgggagacaagggccagaagggctctgtgggcagacatggcaagattggccccatcggcagcaagggggagaagggggacagcggggacatcggccccccaggccccaatggagagcccggcctgccctgtgaatgttcccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaagctgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148098 - DNA, 816 bp, Artificial Sequence
  Description of Artificial Sequence: Synthetic coding sequence
atgaggggcaacctggccctggtgggcgtgctgatcagcctggccttcctgagcctgctgcccagcggccacccccagcctgctggagatgatgcctgcagcgtgcagatcctggtgcccggcctgaagggagatgctggggagaagggggacaagggggcccctggccggcccggccgggtgggccccaccggggagaagggggacatgggagacaagggccagaagggctctgtgggccgccacggcaagattggccccatcggcagcaaaggagagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148099 - DNA, 744 bp, Artificial Sequence
  Description of Artificial Sequence: Synthetic coding sequence
atgaggggcaacctggccctggtgggcgtgctgatcagcctggccttcctgagcctgctgcccagcggccacccccagcctgctggagatgatgcctgcagcgtgcagatcctggtgcccggcctgaagggagatgctggggagaagggggacaagggggcccctggccggcccggccgggtgggccccaccggggagaagggggagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148100 - DNA, 858 bp, Artificial Sequence
  Description of Artificial Sequence: Synthetic coding sequence
atgaagaagcagaggggcgtgggcgtgctgcctgccctgaggatgaggggcaacctggccctggtgggcgtgctgatcagcctggccttcctgagcctgctgcccagcggccacccccagcctgctggagatgatgcctgcagcgtgcagatcctggtgcccggcctgaagggagatgctggggagaagggggacaagggggcccctggccggcccggccgggtgggccccaccggggagaagggggacatgggagacaagggccagaagggctctgtgggccgccacggcaagattggccccatcggcagcaaaggagagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148101 - DNA, 666 bp, Artificial Sequence
  Description of Artificial Sequence: Synthetic coding sequence
atgtggtgggtgccccccagcccctacggctgcctgccctgtgccctgcccggggacatgggagacaagggccagaagggctctgtgggccgccacggcaagattggccccatcggcagcaaaggagagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148102 - DNA, 666 bp, Artificial Sequence
  Description of Artificial Sequence: Synthetic coding sequence
atgtggtgggtgccccccagcccctacggctgcctgccctgtgccctgcctggagatgctggggagaagggggacaagggggcccctggccggcccggccgggtgggccccaccggggagaagggggagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148103 - DNA, 594 bp, Artificial Sequence
  Description of Artificial Sequence: Synthetic coding sequence
atgtggtgggtgccccccagcccctacggctgcctgccctgtgccctgcctggagagaagggggacagcggggacatcggccccccaggccccaacggggagcccggcctgccctgtgagtgcagccagctgaggaaggccatcggggagatggacaaccaggtgtcccagctgaccagcgagctgaagttcatcaagaatgctgtggccggcgtgcgggagacagagagcaagatctacctgctggtgaaggaggagaagagatatgcagatgcccagctgagctgccagggccggggcggcaccctgtccatgcccaaggatgaggccgccaacggcctgatggccgcctacctggcccaggccggcctggcccgggtcttcatcggcatcaatgacctggagaaggagggcgcctttgtgtacagcgaccacagccccatgaggaccttcaacaagtggaggtctggagagcccaacaatgcctatgatgaggaggactgtgtggagatggtggccagcggcggctggaatgatgtggcctgccacaccaccatgtacttcatgtgtgaatttgacaaggagaacatgtag

SEQ ID NO: 148104 - DNA, 2229 bp, Artificial Sequence
  Description of Artificial Sequence: Synthetic coding sequence
atgaaggatgactttgctgaggaggaggaggtgcagagctttggctacaagagatttggcatccaggagggcacccagtgcaccaagtgcaagaacaactgggccctgaagttcagcatcatcctgctgtacatcctgtgtgccctgctgaccatcaccgtggccatcctgggctacaaggtggtggagaagatggacaacgtgactggaggcatggagaccagccggcagacctatgatgacaagctgacagctgtggagagtgacctgaagaagctgggggaccagacaggcaagaaggccatcagcaccaacagcgagctgagcaccttcagaagtgacatcctggacctgcggcagcagctgcgggagatcacagagaagaccagcaagaacaaggacaccctggagaagctgcaggccagcggagatgccctggtggaccggcagagccagctgaaggagaccctggagaacaacagcttcctgatcaccaccgtgaacaagaccctgcaggcctacaacggctacgtgaccaacctgcagcaggacacctctgtgctgcagggcaacctgcagaaccagatgtacagccacaacgtggtgatcatgaacctgaacaacctgaacctgacccaggtgcagcagaggaacctgatcaccaacctgcagaggtctgtggatgacaccagccaggccatccagaggatcaagaatgacttccagaacctgcagcaggtgttcctgcaggccaagaaggacacagactggctgaaggagaaggtgcagagcctgcagaccctggccgccaacaacagcgccctggccaaggccaacaatgacaccctggaggacatgaacagccagctgaacagcttcaccggccagatggagaacatcaccaccatcagccaggccaatgagcagaacctgaaggacctgcaggacctgcacaaggatgctgagaacagaacagccatcaagttcaaccagctggaggagcgcttccagctgtttgaaacagacatcgtgaacatcatcagcaacatctcctacacagcccaccacctgcggaccctgaccagcaacctgaatgaggtgaggaccacctgcacagacaccctgaccaagcacacagatgacctgaccagcctgaacaacaccctggccaacatccggctggacagcgtgtccctgaggatgcagcaggacctgatgaggagccggctggacacagaggtggccaacctgagcgtcatcatggaggagatgaagctggtggacagcaagcacggccagctgatcaagaacttcaccatcctgcagggccccccaggcccccggggccccaggggggaccggggcagccagggccccccaggccccactggaaacaagggccagaagggggagaagggggagcccggccccccaggccctgctggggagcggggccccatcggccctgctggccccccaggagagcggggcggcaagggcagcaagggcagccagggccccaagggcagccggggcagccctgggaagccaggcccccagggcagcagcggggaccccggccccccaggccccccaggcaaggagggcctgcccggcccccagggccccccaggcttccagggcctgcagggcaccgtgggggagcccggggtgcccggcccccggggcctgcccggcctgcccggggtgcccggcatgcctggccccaagggccccccaggccccccaggccccagcggggctgtggtgcccctggccctgcagaatgagcccaccccagccccagaagataatggctgccccccccactggaagaacttcacagacaagtgctactacttctctgtggagaaggagatctttgaagatgccaagctgttctgtgaggacaagagcagccacctggtgttcatcaacacccgggaggagcagcagtggatcaagaagcagatggtgggccgggagagccactggattggcctgacagattctgagcgggagaatgagtggaagtggctggatggcaccagcccagactacaagaactggaaggccggccagcctgacaactggggccacggccacggccctggagaggactgtgccggcctcatctatgccggccagtggaatgacttccagtgtgaagatgtgaacaacttcatctgtgagaaggaccgggagaccgtgctgagcagcgccctgtag

SEQ ID NO: 148105 - DNA, 2919 bp, Artificial Sequence
  Description of Artificial Sequence: Synthetic coding sequence
atgggccctggggtgctgctgctgctgctggtggccacagcctggcacggccagggcatccctgtgattgagcccagcgtgcctgagctggtggtgaagccaggggccaccgtgaccctgcgctgtgtgggcaatggatctgtggagtgggatggcccccccagcccccactggaccctgtacagtgatggcagcagcagcatcctgagcaccaacaatgccaccttccagaacacaggcacctaccgctgcacagagcccggggaccccctgggcggcagcgctgccatccacctgtatgtgaaggaccctgcccggccctggaatgtgctggcccaggaggtggtggtgtttgaggaccaggatgccctgctgccctgcctgctgacagatcctgtgctggaggccggcgtgtccctggtgcgggtgcggggccggcccctgatgaggcacaccaactacagcttcagcccctggcacggcttcaccatccaccgggccaagttcatccagagccaggactaccagtgcagcgccctgatgggcggcaggaaggtgatgagcatcagcatccggctgaaggtgcagaaggtgattcctggccccccagccctgaccctggtgcctgctgagctggtgcgcatccggggggaggccgcccagatcgtgtgcagcgccagctctgtggatgtgaactttgatgtgttcctgcagcacaacaacaccaagctggccatcccccagcagagcgacttccacaacaaccgctaccagaaggtgctgaccctgaacctggaccaggtggacttccagcacgccggcaactacagctgtgtggccagcaatgtgcagggcaagcacagcacctccatgttcttccgggtggtggagagcgcctacctgaacctgagcagcgagcagaacctgatccaggaggtgacagtgggggagggcctgaacctgaaggtgatggtggaggcctacccaggcctgcagggcttcaactggacctacctgggccccttcagtgaccaccagcctgagcccaagctggccaatgccaccaccaaggacacctaccgccacaccttcaccctgagcctgccccggctgaagcccagcgaggccggccgctacagcttcctggccaggaaccctgggggctggagggccctgacctttgagctgaccctgcgctacccacctgaggtgtctgtcatctggaccttcatcaatggcagcggcaccctgctgtgtgccgccagcggctacccccagcccaacgtgacctggctgcagtgcagcggccacacagacagatgtgatgaggcccaggtgctgcaggtgtgggatgacccctacccagaggtgctgagccaggagcccttccacaaggtgacagtgcagagcctgctgactgtggagaccctggagcacaaccagacctatgagtgccgggcccacaacagcgtgggcagcggctcctgggccttcatccccatctctgctggggcccacacccaccccccagatgagttcctgttcacccctgtggtggtggcctgcatgagcatcatggccctgctgctgctgctgctgctgctgctgctgtacaagtacaagcagaagcccaagtaccaggtgcgctggaagatcatcgagagctatgagggcaacagctacaccttcatcgaccccacccagctgccctacaatgagaagtgggagttccccaggaacaacctgcagtttgggaagaccctgggcgctggggccttcggcaaggtggtggaggccacagccttcggcctgggcaaggaggatgctgtgctgaaggtggccgtgaagatgctgaagagcacagcccacgcagatgagaaggaggccctgatgtctgagctgaagatcatgagccacctgggccagcacgagaacatcgtgaacctgctgggcgcctgcacccatggaggccctgtgctggtgatcacagagtactgctgctacggggacctgctgaacttcctgcggaggaaggccgaggccatgctgggccccagcctgagccctggccaggaccctgagggcggcgtggactacaagaacatccacctggagaagaagtatgtgcggcgggacagcggcttcagcagccagggcgtggacacctacgtggagatgaggcctgtgtccaccagcagcaatgacagcttcagcgagcaggacctggacaaggaggatggccggcccctggagctgcgggacctgctgcacttcagcagccaggtggcccagggcatggccttcctggccagcaagaactgcatccacagagatgtggccgccagaaatgtgctgctgaccaacggccacgtggccaagatcggggactttggcctggcccgggacatcatgaatgacagcaactacatcgtgaagggaaatgcccggctgcctgtgaagtggatggcccctgagagcatctttgactgtgtgtacacagtgcagagtgatgtgtggagctatggcatcctgctgtgggagatcttcagcctgggcctgaacccctacccaggcatcctggtgaacagcaagttctacaagctggtgaaggatggctaccagatggcccagcctgcctttgcccccaagaacatctacagcatcatgcaggcctgctgggccctggagcccacccaccggcccaccttccagcagatctgcagcttcctgcaggagcaggcccaggaggaccggcgggagcgggactacaccaacctgcccagcagcagccgcagcggcggcagcggcagcagcagcagcgagctggaggaggagagcagcagcgagcacctgacctgctgtgagcagggcgacatcgcccagcccctgctgcagcccaacaactaccagttctgctag

SEQ ID NO: 148106 - DNA, 1506 bp, Artificial Sequence
  Description of Artificial Sequence: Synthetic coding sequence
atgaggcacaccaactacagcttcagcccctggcacggcttcaccatccaccgggccaagttcatccagagccaggactaccagtgcagcgccctgatgggcggcaggaaggtgatgagcatcagcatccggctgaaggtgcagaaggtgattcctggccccccagccctgaccctggtgcctgctgagctggtgcgcatccggggggaggccgcccagatcgtgtgcagcgccagctctgtggatgtgaactttgatgtgttcctgcagcacaacaacaccaagctggccatcccccagcagagcgacttccacaacaaccgctaccagaaggtgctgaccctgaacctggaccaggtggacttccagcacgccggcaactacagctgtgtggccagcaatgtgcagggcaagcacagcacctccatgttcttccgggtggtggagagcgcctacctgaacctgagcagcgagcagaacctgatccaggaggtgacagtgggggagggcctgaacctgaaggtgatggtggaggcctacccaggcctgcagggcttcaactggacctacctgggccccttcagtgaccaccagcctgagcccaagctggccaatgccaccaccaaggacacctaccgccacaccttcaccctgagcctgccccggctgaagcccagcgaggccggccgctacagcttcctggccaggaaccctgggggctggagggccctgacctttgagctgaccctgcgctacccacctgaggtgtctgtcatctggaccttcatcaatggcagcggcaccctgctgtgtgccgccagcggctacccccagcccaacgtgacctggctgcagtgcagcggccacacagacagatgtgatgaggcccaggtgctgcaggtgtgggatgacccctacccagaggtgctgagccaggagcccttccacaaggtgacagtgcagagcctgctgactgtggagaccctggagcacaaccagacctatgagtgccgggcccacaacagcgtgggcagcggctcctgggccttcatccccatctctgctggggcccacacccaccccccagatgagttcctgttcacccctgtggtggtggcctgcatgagcatcatggccctgctgctgctgctgctgctgctgctgctgtacaagtacaagcagaagcccaagtaccaggtgcgctggaagatcatcgagagctatgagggcaacagctacaccttcatcgaccccacccagctgccctacaatgagaagtgggagttccccaggaacaacctgcagtttgggaagaccctgggcgctggggccttcggcaaggtggtggaggccacagccttcggcctgggcaaggaggatgctgtgctgaaggtggccgtgaagatgctgaagagcacagcccacgcagatgagaaggaggccagcggcctgtaccagagcgctgagcagcagcagaagcgctggcagaggcagcagcagcagtag

SEQ ID NO: 148107 - DNA, 2016 bp, Artificial Sequence
  Description of Artificial Sequence: Synthetic coding sequence
atgggccctggggtgctgctgctgctgctggtggccacagcctggcacggccagggcatccctgtgattgagcccagcgtgcctgagctggtggtgaagccaggggccaccgtgaccctgcgctgtgtgggcaatggatctgtggagtgggatggcccccccagcccccactggaccctgtacagtgatggcagcagcagcatcctgagcaccaacaatgccaccttccagaacacaggcacctaccgctgcacagagcccggggaccccctgggcggcagcgctgccatccacctgtatgtgaaggaccctgcccggccctggaatgtgctggcccaggaggtggtggtgtttgaggaccaggatgccctgctgccctgcctgctgacagatcctgtgctggaggccggcgtgtccctggtgcgggtgcggggccggcccctgatgaggcacaccaactacagcttcagcccctggcacggcttcaccatccaccgggccaagttcatccagagccaggactaccagtgcagcgccctgatgggcggcaggaaggtgatgagcatcagcatccggctgaaggtgcagaaggtgattcctggccccccagccctgaccctggtgcctgctgagctggtgcgcatccggggggaggccgcccagatcgtgtgcagcgccagctctgtggatgtgaactttgatgtgttcctgcagcacaacaacaccaagctggccatcccccagcagagcgacttccacaacaaccgctaccagaaggtgctgaccctgaacctggaccaggtggacttccagcacgccggcaactacagctgtgtggccagcaatgtgcagggcaagcacagcacctccatgttcttccgggtggtggagagcgcctacctgaacctgagcagcgagcagaacctgatccaggaggtgacagtgggggagggcctgaacctgaaggtgatggtggaggcctacccaggcctgcagggcttcaactggacctacctgggccccttcagtgaccaccagcctgagcccaagctggccaatgccaccaccaaggacacctaccgccacaccttcaccctgagcctgccccggctgaagcccagcgaggccggccgctacagcttcctggccaggaaccctgggggctggagggccctgacctttgagctgaccctgcgctacccacctgaggtgtctgtcatctggaccttcatcaatggcagcggcaccctgctgtgtgccgccagcggctacccccagcccaacgtgacctggctgcagtgcagcggccacacagacagatgtgatgaggcccaggtgctgcaggtgtgggatgacccctacccagaggtgctgagccaggagcccttccacaaggtgacagtgcagagcctgctgactgtggagaccctggagcacaaccagacctatgagtgccgggcccacaacagcgtgggcagcggctcctgggccttcatccccatctctgctggggcccacacccaccccccagatgagttcctgttcacccctgtggtggtggcctgcatgagcatcatggccctgctgctgctgctgctgctgctgctgctgtacaagtacaagcagaagcccaagtaccaggtgcgctggaagatcatcgagagctatgagggcaacagctacaccttcatcgaccccacccagctgccctacaatgagaagtgggagttccccaggaacaacctgcagtttgggaagaccctgggcgctggggccttcggcaaggtggtggaggccacagccttcggcctgggcaaggaggatgctgtgctgaaggtggccgtgaagatgctgaagagcacagcccacgcagatgagaaggaggccctgatgtctgagctgaagatcatgagccacctgggccagcacgagaacatcgtgaacctgctgggcgcctgcacccatggaggcaccgtggccagccctgcccgggtgtggacccccatgtggaggtag

SEQ ID NO: 148108 - DNA, 921 bp, Artificial Sequence
  Description of Artificial Sequence: Synthetic coding sequence
atgggccctggggtgctgctgctgctgctggtggccacagcctggcacggccagggcatccctgtgattgagcccagcgtgcctgagctggtggtgaagccaggggccaccgtgaccctgcgctgtgtgggcaatggatctgtggagtgggatggcccccccagcccccactggaccctgtacagtgatggcagcagcagcatcctgagcaccaacaatgccaccttccagaacacaggcacctaccgctgcacagagcccggggaccccctgggcggcagcgctgccatccacctgtatgtgaaggaccctgcccggccctggaatgtgctggcccaggaggtggtggtgtttgaggaccaggatgccctgctgccctgcctgctgacagatcctgtgctggaggccggcgtgtccctggtgcgggtgcggggccggcccctgatgaggcacaccaactacagcttcagcccctggcacggcttcaccatccaccgggccaagttcatccagagccaggactaccagtgcagcgccctgatgggcggcaggaaggtgatgagcatcagcatccggctgaaggtgcagaaggtgattcctggccccccagccctgaccctggtgcctgctgagctggtgcgcatccggggggaggccgcccagatcgtgtgcagcgccagctctgtggatgtgaactttgatgtgttcctgcagcacaacaacaccaagctggccatcccccagcagagcgacttccacaacaaccgctaccagaaggtgctgaccctgaacctggaccaggtggacttccagcacgccggcaactacagctgtgtggccagcaatgtgcagggcaagcacagcacctccatgttcttccgggtggtgggcacccccagccccagcctgtgcccagcctag

SEQ ID NO: 148109 - DNA, 1134 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctgatcaacgtgtctggggacctggagaaccgctacaacttccccagcagcgagccccgggccaagcacagcgtgaagatccgggctgctgatgtgcgcatcctgaactggagctcctggagcgaggccattgaatttgaccacctgggcggcatccacccccggggccgggagcggctgccccggcggggcctggaccgggagggcaactacctgcggccccggggctgcagaaatggcatggacatcagcgccagcgccacccggggcaactgcttcctggatgatgctgtgaacctgtacatcatcttctacgtgttcatctag

SEQ ID NO: 148110 - DNA, 702 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattggcagcctgggctacagcggctgcagccggcagttccacaggagcaagaccaactag

SEQ ID NO: 148111 - DNA, 1002 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctgatcaacgtgtctggggacctggagaaccgctacaacttccccagcagcgagccccgggccaagcacagcgtgaagatccgggctgctgatgtgcgcatcctgaactggagctcctggagcgaggccattgaatttggcagcctgggctacagcggctgcagccggcagttccacaggagcaagaccaactag

SEQ ID NO: 148112 - DNA, 1002 bp, Artificial Sequence; identical to SEQ ID NO: 148111
  Description of Artificial Sequence: Synthetic coding sequence

SEQ ID NO: 148113 - DNA, 861 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctggtggtgctgaccaccggcaccagcgccctgtgcaccttcatgtgcagctag

SEQ ID NO: 148114 - DNA, 1233 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctgatcaacgtgtctggggacctggagaaccgctacaacttccccagcagcgagccccgggccaagcacagcgtgaagatccgggctgctgatgtgcgcatcctgaactggagctcctggagcgaggccattgaatttggaagtgatgatggcaacctgggctctgtgtacatctacgtgctgctgattgtgggcaccctggtgtgtggcatcgtgctgggcttcctgttcaagcgcttcctgcgcatccagaggctcttcccccctgtgccccagatcaaggacaagctgaatgacaaccacgaggtggaggatgagatgggcccccagaggcaccaccgctgtggctggaacctgtaccccaccccaggccccagccctggcagcggcagcagcccccggctgggcagcgagagcagcctgtag

SEQ ID NO: 148115 - DNA, 1203 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctgatcaacgtgtctggggacctggagaaccgctacaacttccccagcagcgagccccgggccaagcacagcgtgaagatccgggctgctgatgtgcgcatcctgaactggagctcctggagcgaggccattgaatttggaagtgatgatggcaacctgggctctgtgtacatctacgtgctgctgattgtgggcaccctggtgtgtggcatcgtgctgggcttcctgttcaagcgcttcctgcgcatccagaggctcttcccccctgtgccccagatcaaggacaagctgaatgacaaccacgaggtggaggatgagatcatctgggaggagttcaccccagaggagggcaagggctaccgggaggaggtgctgactgtgaaggagatcacctag

SEQ ID NO: 148116 - DNA, 1203 bp, Artificial Sequence; identical to SEQ ID NO: 148115
  Description of Artificial Sequence: Synthetic coding sequence

SEQ ID NO: 148117 - DNA, 717 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagtag

SEQ ID NO: 148118 - DNA, 1305 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcccggcacagagaacctgctgatcaacgtgtctggggacctggagaaccgctacaacttccccagcagcgagccccgggccaagcacagcgtgaagatccgggctgctgatgtgcgcatcctgaactggagctcctggagcgaggccattgaatttggcagccacagcgtgacccaggccggcgtgcagtggcacaacctgggcagcctgcagccccccagcccccggctgaagcgcttcagctgcctgcggctgcccggcagtgatgatggcaacctgggctctgtgtacatctacgtgctgctgattgtgggcaccctggtgtgtggcatcgtgctgggcttcctgttcaagcgcttcctgcgcatccagaggctcttcccccctgtgccccagatcaaggacaagctgaatgacaaccacgaggtggaggatgagatcatctgggaggagttcaccccagaggagggcaagggctaccgggaggaggtgctgactgtgaaggagatcacctag

SEQ ID NO: 148119 - DNA, 567 bp, Artificial Sequence
  Description of Artificial Sequence: Synthetic coding sequence
atgctgctgctggtgaccagcctgctgctgtgtgagctgccccacccagccttcctgctgatccctgagaagagtgacctgaggacagtggccccagccagcagcctgaatgtgcgctttgacagcaggaccatgaacctgtcctgggactgccaggagaacaccaccttcagcaagtgcttcctgacagacaagaagaacagagtggtggagccccggctgagcaacaatgaatgtagctgcaccttccgggagatctgcctgcatgaaggagtgacctttgaggtgcacgtgaacaccagccagaggggcttccagcagaagctgctgtaccccaacagcggccgggagggcacagctgcccagaacttcagctgcttcatctacaatgctgacctgatgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagctag

SEQ ID NO: 148120 - DNA, 1203 bp, Artificial Sequence; identical to SEQ ID NO: 148115
  Description of Artificial Sequence: Synthetic coding sequence

SEQ ID NO: 148121 - DNA, 804 bp, Artificial Sequence
  Description of Artificial Sequence: Synthetic coding sequence
atgaactgcacctgggcccggggccccacagcccccagagatgtgcagtacttcctgtacatccggaacagcaagagaagaagagagatccgctgcccctactacatccaggacagcggcacccacgtgggctgccacctggacaacctgagcggcctgaccagcaggaactacttcctggtgaatggcaccagccgggagatcggcatccagttctttgacagcctgctggacaccaagaagattgagcgcttcaacccccccagcaatgtgacagtgcgctgcaacaccacccactgcctggtgcgctggaagcagcccaggacctaccagaagctgagctacctggacttccagtaccagctggatgtgcacaggaagaacacccagcctggaacagagaacctgctgatcaacgtgtctggggacctggagaaccgctacaacttccccagcagcgagccccgggccaagcacagcgtgaagatccgggcagcagatgtgcgcatcctgaactggagctcctggagcgaggccatcgagtttggaagtgatgatggcaacctgggctctgtgtacatctacgtgctgctgattgtgggcaccctggtgtgtggcatcgtgctgggcttcctgttcaagcgcttcctgcgcatccagaggctcttcccccctgtgccccagatcaaggacaagctgaatgacaaccacgaggtggaggatgagatcatctgggaggagttcaccccagaggagggcaagggctaccgggaggaggtgctgactgtgaaggagatcacctag

SEQ ID NO: 148122 - DNA, 2712 bp, Artificial Sequence
  Description of Artificial Sequence: Synthetic coding sequence
atggtgctggcccagggcctgctgtccatggccctgctggccctgtgctgggagaggagcctggccggggctgaggagaccatccccctgcagaccctgcgctgctacaatgactacaccagccacatcacctgccgctgggccgacacccaggatgcccagaggctggtgaatgtgaccctcatcagaagagtgaatgaagacctgctggagcctgtgtcctgtgacctgagtgatgacatgccctggagcgcctgcccccacccccgctgtgtgccccggcgctgcgtcatcccctgccagagctttgtggtgacagatgtggactacttctccttccagcctgaccggcccctgggcacccggctgactgtgaccctgacccagcacgtgcagcccccagagccccgggacctgcagatcagcacagaccaggaccacttcctgctgacctggagcgtggccctgggcagcccccagagccactggctgagccctggggacctggagtttgaggtggtgtacaagaggctgcaggacagctgggaggatgctgccatcctgctgagcaacaccagccaggccaccctgggccctgagcacctgatgcccagcagcacctacgtggcccgggtgaggacccggctggcccctggcagccggctgagcggccggcccagcaagtggagccctgaggtgtgctgggacagccagcctggagatgaggcccagccccagaacctggagtgcttctttgatggagctgctgtgctgagctgctcctgggaggtgaggaaggaggtggccagctctgtgtcctttggcctcttctacaagcccagcccagatgctggcagcgctgtgctgctgcgggaggaggagtgcagccctgtgctgcgggagggcctgggcagcctgcacaccaggcaccactgccagatccctgtgcctgaccctgccacccacggccagtacatcgtgtctgtgcagccccggcgggcagagaagcacatcaagagctctgtgaacatccagatggccccacccagcctgaatgtgaccaaggatggagacagctacagcctgcgctgggagaccatgaagatgagatatgagcacatcgaccacacctttgagatccagtacaggaaggacacagccacctggaaggacagcaagacagagaccctgcagaatgcccacagcatggccctgcctgccctggagcccagcacccgctactgggcccgggtgcgggtgaggaccagcaggacaggctacaacggcatctggagcgagtggagcgaggcccgctcctgggacacagagagcgtgctgcccatgtgggtgctggccctgattgtcatcttcctgaccatcgctgtgctgctggccctgcgcttctgtggcatctacggctaccgcctgcggaggaagtgggaggagaagatccccaaccccagcaagagccacctgttccagaatggatctgctgagctgtggcccccaggctccatgtctgccttcaccagcggcagccccccccaccagggcccctggggcagccgcttccctgagctggagggcgtcttccctgtgggctttggagacagcgaggtgagccccctgaccatcgaggaccccaagcacgtgtgtgacccccccagcggccctgacaccaccccagctgccagtgacctgcccacagagcagccccccagcccccagcccggccccccagctgccagccacaccccagagaagcaggccagcagctttgacttcaacggcccctacctgggccccccccacagccgcagcctgcctgacatcctgggccagcctgagcccccccaggagggcggcagccagaagagccccccacctggcagcctggagtacctgtgcctgcctgctgggggccaggtgcagctggtgcccctggcccaggccatgggccctggccaggccgtggaggtggagcggcggcccagccagggcgctgctggcagccccagcctggagagcggcggcggccctgcccccccagccctgggcccccgggtgggcggccaggaccagaaggacagccctgtggccatccccatgagcagcggggacacagaagatcctggggtggccagcggctacgtgagcagcgctgacctggtgttcacccccaacagcggggccagctctgtgtccctggtgcccagcctgggcctgcccagcgaccagacccccagcctgtgccccggcctggccagcggccccccaggggcccctggccctgtgaagagcggctttgagggctacgtggagctgccccccatcgagggccgcagccccaggagccccaggaacaaccctgtgcccccagaggccaagagccctgtgctgaaccctggagagaggcctgcagatgtgagccccaccagcccccagcctgagggcctgctggtgctgcagcaggtgggggactactgcttcctgcccggcctgggccctggccccctgagcctgcggagcaagcccagcagccctggccctggccctgagatcaagaacctggaccaggccttccaggtgaagaagcccccaggccaggccgtgccccaggtgcctgtgatccagctgttcaaggccctgaagcagcaggactacctgagcctgcccccctgggaggtgaacaagccaggagaggtgtgctag

SEQ ID NO: 148123 - DNA, 2694 bp, Artificial Sequence
  Description of Artificial Sequence: Synthetic coding sequence
atggtgctggcccagggcctgctgtccatggccctgctggccctgtgctgggagaggagcctggccggggctgaggagaccatccccctgcagaccctgcgctgctacaatgactacaccagccacatcacctgccgctgggccgacacccaggatgcccagaggctggtgaatgtgaccctcatcagaagagtgaatgaagacctgctggagcctgtgtcctgtgacctgagtgatgacatgccctggagcgcctgcccccacccccgctgtgtgccccggcgctgcgtcatcccctgccagagctttgtggtgacagatgtggactacttctccttccagcctgaccggcccctgggcacccggctgactgtgaccctgacccagcacgtgcagcccccagagccccgggacctgcagatcagcacagaccaggaccacttcctgctgacctggagcgtggccctgggcagcccccagagccactggctgagccctggggacctggagtttgaggtggtgtacaagaggctgcaggacagctgggaggatgctgccatcctgctgagcaacaccagccaggccaccctgggccctgagcacctgatgcccagcagcacctacgtggcccgggtgaggacccggctggcccctggcagccggctgagcggccggcccagcaagtggagccctgaggtgtgctgggacagccagcctggagatgaggcccagccccagaacctggagtgcttctttgatggagctgctgtgctgagctgctcctgggaggtgaggaaggaggtggccagctctgtgtcctttggcctcttctacaagcccagcccagatgctggggaggaggagtgcagccctgtgctgcgggagggcctgggcagcctgcacaccaggcaccactgccagatccctgtgcctgaccctgccacccacggccagtacatcgtgtctgtgcagccccggcgggcagagaagcacatcaagagctctgtgaacatccagatggccccacccagcctgaatgtgaccaaggatggagacagctacagcctgcgctgggagaccatgaagatgagatatgagcacatcgaccacacctttgagatccagtacaggaaggacacagccacctggaaggacagcaagacagagaccctgcagaatgcccacagcatggccctgcctgccctggagcccagcacccgctactgggcccgggtgcgggtgaggaccagcaggacaggctacaacggcatctggagcgagtggagcgaggcccgctcctgggacacagagagcgtgctgcccatgtgggtgctggccctgattgtcatcttcctgaccatcgctgtgctgctggccctgcgcttctgtggcatctacggctaccgcctgcggaggaagtgggaggagaagatccccaaccccagcaagagccacctgttccagaatggatctgctgagctgtggcccccaggctccatgtctgccttcaccagcggcagccccccccaccagggcccctggggcagccgcttccctgagctggagggcgtcttccctgtgggctttggagacagcgaggtgagccccctgaccatcgaggaccccaagcacgtgtgtgacccccccagcggccctgacaccaccccagctgccagtgacctgcccacagagcagccccccagcccccagcccggccccccagctgccagccacaccccagagaagcaggccagcagctttgacttcaacggcccctacctgggccccccccacagccgcagcctgcctgacatcctgggccagcctgagcccccccaggagggcggcagccagaagagccccccacctggcagcctggagtacctgtgcctgcctgctgggggccaggtgcagctggtgcccctggcccaggccatgggccctggccaggccgtggaggtggagcggcggcccagccagggcgctgctggcagccccagcctggagagcggcggcggccctgcccccccagccctgggcccccgggtgggcggccaggaccagaaggacagccctgtggccatccccatgagcagcggggacacagaagatcctggggtggccagcggctacgtgagcagcgctgacctggtgttcacccccaacagcggggccagctctgtgtccctggtgcccagcctgggcctgcccagcgaccagacccccagcctgtgccccggcctggccagcggccccccaggggcccctggccctgtgaagagcggctttgagggctacgtggagctgccccccatcgagggccgcagccccaggagccccaggaacaaccctgtgcccccagaggccaagagccctgtgctgaaccctggagagaggcctgcagatgtgagccccaccagcccccagcctgagggcctgctggtgctgcagcaggtgggggactactgcttcctgcccggcctgggccctggccccctgagcctgcggagcaagcccagcagccctggccctggccctgagatcaagaacctggaccaggccttccaggtgaagaagcccccaggccaggccgtgccccaggtgcctgtgatccagctgttcaaggccctgaagcagcaggactacctgagcctgcccccctgggaggtgaacaagccaggagaggtgtgctag

SEQ ID NO: 148124 - DNA, 690 bp, Artificial Sequence
  Description of Artificial Sequence: Synthetic coding sequence
atgccctggagcgcctgcccccacccccgctgtgtgccccggcgctgcgtcatcccctgccagagctttgtggtgacagatgtggactacttctccttccagcctgaccggcccctgggcacccggctgactgtgaccctgacccagcacgtgcagcccccagagccccgggacctgcagatcagcacagaccaggaccacttcctgctgacctggagcgtggccctgggcagcccccagagccactggctgagccctggggacctggagtttgaggtggtgtacaagaggctgcaggacagctgggaggatgctgccatcctgctgagcaacaccagccaggccaccctgggccctgagcacctgatgcccagcagcacctacgtggcccgggtgaggacccggctggcccctggcagccggctgagcggccggcccagcaagtggagccctgaggtgtgctgggacagccagcctggagatgaggcccagccccagaacctggagtgcttctttgatggagctgctgtgctgagctgctcctgggaggtgaggaaggaggtggccagctctgtgtcctttggcctcttctacaagcccagcccagatgctggggaggaggagtgcagccctgtgctgcgggagggcctgggcagcctgcacaccaggcaccactgccagatcccctag

SEQ ID NO: 148125 - DNA, 2535 bp, Artificial Sequence
  Description of Artificial Sequence: Synthetic coding sequence
atgggcaagctgcggccctggagggacctgctggagcctgtgtcctgtgacctgagtgatgacatgccctggagcgcctgcccccacccccgctgtgtgccccggcgctgtgtgatcccctgccagagctttgtggtgacagatgtggactacttctccttccagcctgaccggcccctgggcacccggctgactgtgaccctgacccagcacgtgcagcccccagagccccgggacctgcagatcagcacagaccaggaccacttcctgctgacctggagcgtggccctgggcagcccccagagccactggctgagccctggggacctggagtttgaggtggtgtacaagaggctgcaggacagctgggaggatgctgccatcctgctgagcaacaccagccaggccaccctgggccctgagcacctgatgcccagcagcacctacgtggcccgggtgaggacccggctggcccctggcagccggctgagcggccggcccagcaagtggagccctgaggtgtgctgggacagccagcctggagatgaggcccagccccagaacctggagtgcttctttgatggagctgctgtgctgagctgctcctgggaggtgaggaaggaggtggccagctctgtgtcctttggcctcttctacaagcccagcccagatgctggcagcgctgtgctgctgcgggaggaggagtgcagccctgtgctgcgggagggcctgggcagcctgcacaccaggcaccactgccagatccctgtgcctgaccctgccacccacggccagtacatcgtgtctgtgcagcccaggagagctgagaagcacatcaagagctctgtgaacatccagatggccccacccagcctgaatgtgaccaaggatggagacagctacagcctgcgctgggagaccatgaagatgagatatgagcacatcgaccacacctttgagatccagtacaggaaggacacagccacctggaaggacagcaagacagagaccctgcagaatgcccacagcatggccctgcctgccctggagcccagcacccgctactgggcccgggtgcgggtgaggaccagcaggacaggctacaacggcatctggagcgagtggagcgaggcccgctcctgggacacagaatctgtgctgcccatgtgggtgctggccctgattgtcatcttcctgaccatcgctgtgctgctggccctgcgcttctgtggcatctacggctaccgcctgcggaggaagtgggaggagaagatccccaaccccagcaagagccacctgttccagaatggcagcgctgagctgtggcccccaggctccatgtctgccttcaccagcggcagccccccccaccagggcccctggggcagccgcttccctgagctggagggcgtcttccctgtgggctttggagacagcgaggtgagccccctgaccatcgaggaccccaagcacgtgtgtgaccccccatctggccctgacaccaccccagctgccagtgacctgcccacagagcagccccccagcccccagcccggccccccagctgccagccacaccccagagaagcaggccagcagctttgacttcaacggcccctacctgggccccccccacagccgcagcctgcctgacatcctgggccagcctgagcccccccaggagggcggcagccagaagagccccccacctggcagcctggagtacctgtgcctgcctgctgggggccaggtgcagctggtgcccctggcccaggccatgggccctggccaggccgtggaggtggagcggcggcccagccagggcgccgccggcagccccagcctggagagcggcggcggccctgcccccccagccctgggcccccgggtgggcggccaggaccagaaggacagccctgtggccatccccatgagcagcggggacacagaggaccccggggtggccagcggctacgtgtcctctgctgacctggtgttcacccccaacagcggggccagctctgtgtccctggtgcccagcctgggcctgcccagcgaccagacccccagcctgtgccccggcctggccagcggccccccaggggcccctggccctgtgaagagcggctttgagggctacgtggagctgccccccatcgagggccgcagccccaggagccccaggaacaaccctgtgcccccagaggccaagagccctgtgctgaaccctggagagaggcctgcagatgtgagccccaccagcccccagcctgagggcctgctggtgctgcagcaggtgggggactactgcttcctgcccggcctgggccctggccccctgagcctgcggagcaagcccagcagccctggccctggccctgagatcaagaacctggaccaggccttccaggtgaagaagcccccaggccaggccgtgccccaggtgcctgtgatccagctgttcaaggccctgaagcagcaggactacctgagcctgcccccctgggaggtgaacaagccaggagaggtgtgctag

SEQ ID NO: 148126 - DNA, 2670 bp, Artificial Sequence
  Description of Artificial Sequence: Synthetic coding sequence
atggtgctggcccagggcctgctgtccatggccctgctggccctgtgctgggagaggagcctggccggggctgaggagaccatccccctgcagaccctgcgctgctacaatgactacaccagccacatcacctgccgctgggccgacacccaggatgcccagaggctggtgaatgtgaccctcatcagaagagtgaatgaagacctgctggagcctgtgtcctgtgacctgagtgatgacatgccctggagcgcctgcccccacccccgctgtgtgccccggcgctgcgtcatcccctgccagagctttgtggtgacagatgtggactacttctccttccagcctgaccggcccctgggcacccggctgactgtgaccctgacccagcacgtgcagcccccagagccccgggacctgcagatcagcacagaccaggaccacttcctgctgacctggagcgtggccctgggcagcccccagagccactggctgagccctggggacctggagtttgaggtggtgtacaagaggctgcaggacagctgggaggatgctgccatcctgctgagcaacaccagccaggccaccctgggccctgagcacctgatgcccagcagcacctacgtggcccgggtgaggacccggctggcccctggcagccggctgagcggccggcccagcaagtggagccctgaggtgtgctgggacagccagcctggagatgaggcccagccccagaacctggagtgcttctttgatggagctgctgtgctgagctgctcctgggaggtgaggaaggaggtggccagctctgtgtcctttggcctcttctacaagcccagcccagatgctggggaggaggagtgcagccctgtgctgcgggagggcctgggcagcctgcacaccaggcaccactgccagatccctgtgcctgaccctgccacccacggccagtacatcgtgtctgtgcagccccggcgggcagagaagcacatcaagagctctgtgaacatccagatggccccacccagcctgaatgtgaccaaggatggagacagctacagcctgcgctgggagaccatgaagatgagatatgagcacatcgaccacacctttgagatccagtacaggaaggacacagccacctggaaggacagcaagacagagaccctgcagaatgcccacagcatggccctgcctgccctggagcccagcacccgctactgggcccgggtgcgggtgaggaccagcaggacaggctacaacggcatctggagcgagtggagcgaggcccgctcctgggacacagagagcgtgctgcccatgtgggtgctggccctgattgtcatcttcctgaccatcgctgtgctgctggccctgcgcttctgtggcatctacggctaccgcctgcggaggaagtgggaggagaagatccccaaccccagcaagagccacctgttccagaatggatctgctgagctgtggcccccaggctccatgtctgccttcaccagcggcagccccccccaccagggcccctggggcagccgcttccctgagctggagggcgtcttccctgtgggctttggagacagcgaggtgagccccctgaccatcgaggaccccaagcacgtgtgtgacccccccagcggccctgacaccaccccagctgccagtgacctgcccacagagcagccccccagcccccagcccggccccccagctgccagccacaccccagagaagcaggccagcagctttgacttcaacggcccctacctgggccccccccacagccgcagcctgcctgacatcctgggccagcctgagcccccccaggagggcggcagccagaagagccccccacctggcagcctggagtacctgtgcctgcctgctgggggccaggtgcagctggtgcccctggcccaggccatgggccctggccaggccgtggaggtggagcggcggcccagccagggcgctgctggcagccccagcctggagagcggcggcggccctgcccccccagccctgggcccccgggtgggcggccaggaccagaaggacagccctgtggccatccccatgagcagcggggacacagaagatcctggggtggccagcggctacgtgagcagcgctgacctggtgttcacccccaacagcggggccagctctgtgtccctggtgcccagcctgggcctgcccagcgaccagacccccagcctgtgccccggcctggccagcggccccccaggggcccctggccctgtgaagagcggctttgagggctacgtggagctgccccccatcgagggccgcagccccaggagccccaggaacaaccctgtgcccccagaggccaagagccctgtgctgaaccctggagagaggcctgcagatgtgagccccaccagcccccagcctgagggcctgctggtgctgcagcaggtgggggactactgcttcctgcccggcctgggccctggccccctgagcctgcggagcaagcccagcagccctggccctggccctgagatcaagaacctggaccaggccttccaggtgaagaagcccccaggccaggccgtgccccaggtgcctgtgatccagctgttcaaggccctggtggtgtctgtgatgtctgtgggcccccctgtgccctag

SEQ ID NO: 148127 - DNA, 2352 bp, Artificial Sequence
  Description of Artificial Sequence: Synthetic coding sequence
atggcccggctgggcaactgcagcctgacctgggccgccctgatcatcctgctgctgcccggcagcctggaggagtgtggccacatctctgtgtctgcccccatcgtgcacctgggggaccccatcacagccagctgcatcatcaagcagaactgcagccacctggaccctgagccccagatcctgtggaggctgggcgctgagctgcagcccggcggccggcagcagaggctgagtgatggcacccaggagagcatcatcaccctgccccacctgaaccacacccaggccttcctgagctgctgcctgaactggggcaacagcctgcagatcctggaccaggtggagctgcgggccggctaccccccagccatcccccacaacctgagctgcctgatgaacctgaccaccagcagcctcatctgccagtgggagcccggccctgagacccacctgcccaccagcttcaccctgaagagcttcaagagccggggcaactgccagacccagggcgacagcatcctggactgtgtgcccaaggatggccagagccactgctgcatccccaggaagcacctgctgctgtaccagaacatgggcatctgggtgcaggccgagaatgccctgggcacctccatgagcccccagctgtgcctggaccccatggatgtggtgaagctggagccccccatgctgcggaccatggaccccagccctgaggccgccccaccccaggccggctgcctgcagctgtgctgggagccctggcagcccggcctgcacatcaaccagaagtgtgagctgcggcacaagccccagagaggagaggcctcctgggccctggtgggccccctgcccctggaggccctgcagtatgagctgtgtggcctgctgcctgccacagcctacaccctgcagatccgctgcatccgctggcccctgcccggccactggagcgactggagccccagcctggagctgcggaccacagagcgggcccccaccgtgcggctggacacctggtggaggcagaggcagctggaccccaggacagtgcagctgttctggaagcctgtgcccctggaggaggacagcggccgcatccagggctacgtggtgtcctggaggcccagcggccaggccggggccatcctgcccctgtgcaacaccacagagctgagctgcaccttccacctgcccagcgaggcccaggaggtggccctggtggcctacaacagcgctggcaccagccggcccacccctgtggtgttttctgagagccggggccctgccctgacccggctgcacgccatggcccgggacccccacagcctgtgggtgggctgggagccccccaacccctggccccagggctacgtgattgagtggggcctgggccccccatctgccagcaacagcaacaagacctggaggatggagcagaatggccgggccaccggcttcctgctgaaggagaacatccggcccttccagctgtatgagatcatcgtgacccccctgtaccaggacaccatgggccccagccagcacgtgtatgcctacagccaggagatggcccccagccacgcccctgagctgcacctgaagcacatcggcaagacctgggcccagctggagtgggtgcctgagcccccagagctgggcaagagccccctgacccactacaccatcttctggaccaatgcccagaaccagagcttcagcgccatcctgaatgccagcagccggggctttgtgctgcacggcctggagcccgccagcctgtaccacatccacctgatggccgccagccaggccggggccaccaacagcacagtgctgaccctgatgaccctgaccccagagggcagcgagctgcacatcatcctgggcctgtttggcctgctgctgctgctgacctgcctgtgtggcacagcctggctgtgctgcagccccaacaggaagaaccccctgtggcccagcgtgcctgaccctgcccacagcagcctgggctcctgggtgcccaccatcatggaggaggatgccttccagctgcccggcctgggcaccccacccatcaccaagctgactgtgctggaggaggatgagaagaagcctgtgccctgggagagccacaacagcagcgagacctgtggcctgcccaccctggtgcagacctacgtgctgcagggcgaccccagggctgtgtccacccagccccagagccagagcggcaccagtgaccaggccggccccccccggcgcagcgcctacttcaaggaccagatcatgctgcacccagcccccccaaatggcctgctgtgcctcttccccatcacctctgtgctgtag

SEQ ID NO: 148128 - DNA, 2310 bp, Artificial Sequence
  Description of Artificial Sequence: Synthetic coding sequence
atggcccggctgggcaactgcagcctgacctgggccgccctgatcatcctgctgctgcccggcagcctggaggagtgtggccacatctctgtgtctgcccccatcgtgcacctgggggaccccatcacagccagctgcatcatcaagcagaactgcagccacctggaccctgagccccagatcctgtggaggctgggcgctgagctgcagcccggcggccggcagcagaggctgagtgatggcacccaggagagcatcatcaccctgccccacctgaaccacacccaggccttcctgagctgctgcctgaactggggcaacagcctgcagatcctggaccaggtggagctgcgggccggctaccccccagccatcccccacaacctgagctgcctgatgaacctgaccaccagcagcctcatctgccagtgggagcccggccctgagacccacctgcccaccagcttcaccctgaagagcttcaagagccggggcaactgccagacccagggcgacagcatcctggactgtgtgcccaaggatggccagagccactgctgcatccccaggaagcacctgctgctgtaccagaacatgggcatctgggtgcaggccgagaatgccctgggcacctccatgagcccccagctgtgcctggaccccatggatgtggtgaagctggagccccccatgctgcggaccatggaccccagccctgaggccgccccaccccaggccggctgcctgcagctgtgctgggagccctggcagcccggcctgcacatcaaccagaagtgtgagctgcggcacaagccccagagaggagaggcctcctgggccctggtgggccccctgcccctggaggccctgcagtatgagctgtgtggcctgctgcctgccacagcctacaccctgcagatccgctgcatccgctggcccctgcccggccactggagcgactggagccccagcctggagctgcggaccacagagcgggcccccaccgtgcggctggacacctggtggaggcagaggcagctggaccccaggacagtgcagctgttctggaagcctgtgcccctggaggaggacagcggccgcatccagggctacgtggtgtcctggaggcccagcggccaggccggggccatcctgcccctgtgcaacaccacagagctgagctgcaccttccacctgcccagcgaggcccaggaggtggccctggtggcctacaacagcgctggcaccagccggcccacccctgtggtgttttctgagagccggggccctgccctgacccggctgcacgccatggcccgggacccccacagcctgtgggtgggctgggagccccccaacccctggccccagggctacgtgattgagtggggcctgggccccccatctgccagcaacagcaacaagacctggaggatggagcagaatggccgggccaccggcttcctgctgaaggagaacatccggcccttccagctgtatgagatcatcgtgacccccctgtaccaggacaccatgggccccagccagcacgtgtatgcctacagccaggagatggcccccagccacgcccctgagctgcacctgaagcacatcggcaagacctgggcccagctggagtgggtgcctgagcccccagagctgggcaagagccccctgacccactacaccatcttctggaccaatgcccagaaccagagcttcagcgccatcctgaatgccagcagccggggctttgtgctgcacggcctggagcccgccagcctgtaccacatccacctgatggccgccagccaggccggggccaccaacagcacagtgctgaccctgatgaccctgaccccagctggccgcatccccagcggccaggtgtcccagacccagctgacagctgcctgggcccctggctgcccccagagctggaggaggatgcccagcagctgcccagccctggcccggcaccccagccccagcagccagtgctggaggaggatgaagaggagccgctgccccggcagccccatcacagcccagaggcctgtggccagccccctgtggagccggcccatgtgcagccggggcacccaggagcagttcccccccagccccaaccccagcctggccccagccatccgctccttcatgggcagctgctgggccgccccccaggcccagggccagggcaccatctctgctgtgacccccctgagccccagctggagggccagccccccagcccccagccccatgaggaccagcggcagcaggcctgccccctggggcccctggtag

SEQ ID NO: 148129 - DNA, 2511 bp, Artificial Sequence
  Description of Artificial Sequence: Synthetic coding sequence
atggcccggctgggcaactgcagcctgacctgggccgccctgatcatcctgctgctgcccggcagcctggaggagtgtggccacatctctgtgtctgcccccatcgtgcacctgggggaccccatcacagccagctgcatcatcaagcagaactgcagccacctggaccctgagccccagatcctgtggaggctgggcgctgagctgcagcccggcggccggcagcagaggctgagtgatggcacccaggagagcatcatcaccctgccccacctgaaccacacccaggccttcctgagctgctgcctgaactggggcaacagcctgcagatcctggaccaggtggagctgcgggccggctaccccccagccatcccccacaacctgagctgcctgatgaacctgaccaccagcagcctcatctgccagtgggagcccggccctgagacccacctgcccaccagcttcaccctgaagagcttcaagagccggggcaactgccagacccagggcgacagcatcctggactgtgtgcccaaggatggccagagccactgctgcatccccaggaagcacctgctgctgtaccagaacatgggcatctgggtgcaggccgagaatgccctgggcacctccatgagcccccagctgtgcctggaccccatggatgtggtgaagctggagccccccatgctgcggaccatggaccccagccctgaggccgccccaccccaggccggctgcctgcagctgtgctgggagccctggcagcccggcctgcacatcaaccagaagtgtgagctgcggcacaagccccagagaggagaggcctcctgggccctggtgggccccctgcccctggaggccctgcagtatgagctgtgtggcctgctgcctgccacagcctacaccctgcagatccgctgcatccgctggcccctgcccggccactggagcgactggagccccagcctggagctgcggaccacagagcgggcccccaccgtgcggctggacacctggtggaggcagaggcagctggaccccaggacagtgcagctgttctggaagcctgtgcccctggaggaggacagcggccgcatccagggctacgtggtgtcctggaggcccagcggccaggccggggccatcctgcccctgtgcaacaccacagagctgagctgcaccttccacctgcccagcgaggcccaggaggtggccctggtggcctacaacagcgctggcaccagccggcccacccctgtggtgttttctgagagccggggccctgccctgacccggctgcacgccatggcccgggacccccacagcctgtgggtgggctgggagccccccaacccctggccccagggctacgtgattgagtggggcctgggccccccatctgccagcaacagcaacaagacctggaggatggagcagaatggccgggccaccggcttcctgctgaaggagaacatccggcccttccagctgtatgagatcatcgtgacccccctgtaccaggacaccatgggccccagccagcacgtgtatgcctacagccaggagatggcccccagccacgcccctgagctgcacctgaagcacatcggcaagacctgggcccagctggagtgggtgcctgagcccccagagctgggcaagagccccctgacccactacaccatcttctggaccaatgcccagaaccagagcttcagcgccatcctgaatgccagcagccggggctttgtgctgcacggcctggagcccgccagcctgtaccacatccacctgatggccgccagccaggccggggccaccaacagcacagtgctgaccctgatgaccctgaccccagagggcagcgagctgcacatcatcctgggcctgtttggcctgctgctgctgctgacctgcctgtgtggcacagcctggctgtgctgcagccccaacaggaagaaccccctgtggcccagcgtgcctgaccctgcccacagcagcctgggctcctgggtgcccaccatcatggaggaggatgccttccagctgcccggcctgggcaccccacccatcaccaagctgactgtgctggaggaggatgagaagaagcctgtgccctgggagagccacaacagcagcgagacctgtggcctgcccaccctggtgcagacctacgtgctgcagggcgaccccagggctgtgtccacccagccccagagccagagcggcaccagtgaccaggtgctgtatggccagctgctgggcagccccaccagccctggccctggccactacctgcgctgtgacagcacccagcccctgctggccggcctgacccccagccccaagagctatgagaacctgtggttccaggccagccccctgggcaccctggtgaccccagcccccagccaggaggatgactgtgtgtttggccccctgctgaacttccccctgctgcagggcatccgggtgcacggcatggaggccctgggcagcttctag

SEQ ID NO: 148130 - DNA, 2592 bp, Artificial Sequence
  Description of Artificial Sequence: Synthetic coding sequence
atggcccggctgggcaactgcagcctgacctgggccgccctgatcatcctgctgctgcccggcagcctggaggagtgtggccacatctctgtgtctgcccccatcgtgcacctgggggaccccatcacagccagctgcatcatcaagcagaactgcagccacctggaccctgagccccagatcctgtggaggctgggcgctgagctgcagcccggcggccggcagcagaggctgagtgatggcacccaggagagcatcatcaccctgccccacctgaaccacacccaggccttcctgagctgctgcctgaactggggcaacagcctgcagatcctggaccaggtggagctgcgggccggctaccccccagccatcccccacaacctgagctgcctgatgaacctgaccaccagcagcctcatctgccagtgggagcccggccctgagacccacctgcccaccagcttcaccctgaagagcttcaagagccggggcaactgccagacccagggcgacagcatcctggactgtgtgcccaaggatggccagagccactgctgcatccccaggaagcacctgctgctgtaccagaacatgggcatctgggtgcaggccgagaatgccctgggcacctccatgagcccccagctgtgcctggaccccatggatgtggtgaagctggagccccccatgctgcggaccatggaccccagccctgaggccgccccaccccaggccggctgcctgcagctgtgctgggagccctggcagcccggcctgcacatcaaccagaagtgtgagctgcggcacaagccccagagaggagaggcctcctgggccctggtgggccccctgcccctggaggccctgcagtatgagctgtgtggcctgctgcctgccacagcctacaccctgcagatccgctgcatccgctggcccctgcccggccactggagcgactggagccccagcctggagctgcggaccacagagcgggcccccaccgtgcggctggacacctggtggaggcagaggcagctggaccccaggacagtgcagctgttctggaagcctgtgcccctggaggaggacagcggccgcatccagggctacgtggtgtcctggaggcccagcggccaggccggggccatcctgcccctgtgcaacaccacagagctgagctgcaccttccacctgcccagcgaggcccaggaggtggccctggtggcctacaacagcgctggcaccagccggcccacccctgtggtgttttctgagagccggggccctgccctgacccggctgcacgccatggcccgggacccccacagcctgtgggtgggctgggagccccccaacccctggccccagggctacgtgattgagtggggcctgggccccccatctgccagcaacagcaacaagacctggaggatggagcagaatggccgggccaccggcttcctgctgaaggagaacatccggcccttccagctgtatgagatcatcgtgacccccctgtaccaggacaccatgggccccagccagcacgtgtatgcctacagccaggagatggcccccagccacgcccctgagctgcacctgaagcacatcggcaagacctgggcccagctggagtgggtgcctgagcccccagagctgggcaagagccccctgacccactacaccatcttctggaccaatgcccagaaccagagcttcagcgccatcctgaatgccagcagccggggctttgtgctgcacggcctggagcccgccagcctgtaccacatccacctgatggccgccagccaggccggggccaccaacagcacagtgctgaccctgatgaccctgaccccagagggcagcgagctgcacatcatcctgggcctgtttggcctgctgctgctgctgacctgcctgtgtggcacagcctggctgtgctgcagccccaacaggaagaaccccctgtggcccagcgtgcctgaccctgcccacagcagcctgggctcctgggtgcccaccatcatggaggagctgcccggcccccggcagggccagtggctgggccagaccagcgagatgagccgggccctgaccccccacccctgtgtgcaggatgccttccagctgcccggcctgggcaccccacccatcaccaagctgactgtgctggaggaggatgagaagaagcctgtgccctgggagagccacaacagcagcgagacctgtggcctgcccaccctggtgcagacctacgtgctgcagggcgaccccagggctgtgtccacccagccccagagccagagcggcaccagtgaccaggtgctgtatggccagctgctgggcagccccaccagccctggccctggccactacctgcgctgtgacagcacccagcccctgctggccggcctgacccccagccccaagagctatgagaacctgtggttccaggccagccccctgggcaccctggtgaccccagcccccagccaggaggatgactgtgtgtttggccccctgctgaacttccccctgctgcagggcatccgggtgcacggcatggaggccctgggcagcttctag

SEQ ID NO: 148131 - DNA, 2352 bp, Artificial Sequence; identical to SEQ ID NO: 148127
  Description of Artificial Sequence: Synthetic coding sequence

SEQ ID NO: 148132 - DNA, 2511 bp, Artificial Sequence; identical to SEQ ID NO: 148129
  Description of Artificial Sequence: Synthetic coding sequence

SEQ ID NO: 148133 - DNA, 2511 bp, Artificial Sequence; identical to SEQ ID NO: 148129
  Description of Artificial Sequence: Synthetic coding sequence

SEQ ID NO: 148134 - DNA, 2592 bp, Artificial Sequence; identical to SEQ ID NO: 148130
  Description of Artificial Sequence: Synthetic coding sequence

SEQ ID NO: 148135 - DNA, 1167 bp, Artificial Sequence
  Description of Artificial Sequence: Synthetic coding sequence
tgaaccagccggcccacccctgtggtgttttctgagagccggggccctgccctgacccggctgcacgccatggcccgggacccccacagcctgtgggtgggctgggagccccccaacccctggccccagggctacgtgattgagtggggcctgggccccccatctgccagcaacagcaacaagacctggaggatggagcagaatggccgggccaccggcttcctgctgaaggcccccagccacgcccctgagctgcacctgaagcacatcggcaagacctgggcccagctggagtgggtgcctgagcccccagagctgggcaagagccccctgacccactacaccatcttctggaccaatgcccagaaccagagcttcagcgccatcctgaatgccagcagccggggctttgtgctgcacggcctggagcccgccagcctgtaccacatccacctgatggccgccagccaggccggggccaccaacagcacagtgctgaccctgatgaccctgaccccagagggcagcgagctgcacatcatcctgggcctgtttggcctgctgctgctgctgacctgcctgtgtggcacagcctggctgtgctgcagccccaacaggaagaaccccctgtggcccagcgtgcctgaccctgcccacagcagcctgggctcctgggtgcccaccatcatggaggaggatgccttccagctgcccggcctgggcaccccacccatcaccaagctgactgtgctggaggaggatgagaagaagcctgtgccctgggagagccacaacagcagcgagacctgtggcctgcccaccctggtgcagacctacgtgctgcagggcgaccccagggctgtgtccacccagccccagagccagagcggcaccagtgaccaggtgctgtatggccagctgctgggcagccccaccagccctggccctggccactacctgcgctgtgacagcacccagcccctgctggccggcctgacccccagccccaagagctatgagaacctgtggttccaggccagccccctgggcaccctggtgaccccagcccccagccaggaggatgactgtgtgtttggccccctgctgaacttccccctgctgcagggcatccgggtgcacggcatggaggccctgggcagcttctag

SEQ ID NO: 148136 - DNA, 66 bp, Artificial Sequence
  Description of Artificial Sequence: Synthetic coding sequence
atggcccggctgggcaactgcagcctgacctgggccgccctgatcatcctgctgctgcccggctag

SEQ ID NO: 148137 - DNA, 675 bp, Artificial Sequence
  Description of Artificial Sequence: Synthetic coding sequence
atgtctgctgtgggcgccgccaccccctacctgcaccaccctggggacagccacagcggccgggtgtccttcctgggcgcccagctgcccccagaggtggccgccatggcccggctgctgggggacctggacaggagcaccttcaggaagctgctgaagtttgtggtgagcagcctgcagggcgaggactgccgggaggccgtgcagaggctgggcgtgtctgccaacctgcctgaggagcagctgggcgccctgctggccggcatgcacaccctgctgcagcaggccctgcggctgccccccaccagcctgaagccagacaccttccgggaccagctgcaggagctgtgcatcccccaggacctggtgggggacctggcctctgtggtgtttggcagccagaggcccctgctggacagcgtggcccagcagcagggcgcctggctgccccacgtggccgacttccgctggagggtggatgtggccatcagcaccagcgccctggcccggagcctgcagcccagcgtgctgatgcagctgaagctgagtgatggcagcgcctacagatttgaggtgcccacagccaagttccaggagctgcgctacagcgtggccctggtgctgaaggagatggctgacctggagaagagatgtgagcggcggctgcaggactag

SEQ ID NO: 148138 - DNA, 675 bp, Artificial Sequence; identical to SEQ ID NO: 148137
  Description of Artificial Sequence: Synthetic coding sequence

SEQ ID NO: 148139 - DNA, 675 bp, Artificial Sequence; identical to SEQ ID NO: 148137
  Description of Artificial Sequence: Synthetic coding sequence

SEQ ID NO: 148140 - DNA, 297 bp, Artificial Sequence
  Description of Artificial Sequence: Synthetic coding sequence
atggaggccagcagcgagccccccctggatgccaagagtgatgtgaccaaccagctggtggacttccagtggaagctgggcatggctgtgtccagtgacacctgccgcagcctgaagtacccctacgtggccgtgatgctgaaggtggccgaccacagcggccaggtgaagaccaagtgctttgagatgaccatcccccagttccagccccagctgctggccaccagcagcctgctgagcgccagcaacttctaccggcagttcaaggagattgctgctgtgattgaaacagtgtag

SEQ ID NO: 148141 - DNA, 258 bp, Artificial Sequence
  Description of Artificial Sequence: Synthetic coding sequence
atggaggccagcagcgagccccccctggatgccaagagtgatgtgaccaaccagctggtggacttccagtggaagctgggcatggctgtgtccagtgacacctgccgcagcctgaagtacccctacgtggccgtgatgctgaaggtggccgaccacagcggccaggtgaagaccaagtgctttgagatgaccatcccccagttccagaacttctaccggcagttcaaggagattgctgctgtgattgagaccgtgtag

SEQ ID NO: 148142 - DNA, 258 bp, Artificial Sequence; identical to SEQ ID NO: 148141
  Description of Artificial Sequence: Synthetic coding sequence

SEQ ID NO: 148143 - DNA, 7470 bp, Artificial Sequence
  Description of Artificial Sequence: Synthetic coding sequence
atgggcgccagcagccccaggagccctgagcctgtgggccccccagcccctggcctgcccttctgctgcggcggcagcctgctggccgtggtggtgctgctggccctgcctgtggcctggggccagtgcaatgcccctgagtggctgccctttgcccggcccaccaacctgacagatgaatttgagttccccatcggcacctacctgaactatgagtgcaggcctggctacagcggccggcccttcagcatcatctgcctgaagaacagcgtgtggacaggagccaaggaccgctgcaggaggaagagctgcagaaatcctccagaccctgtgaatggcatggtgcacgtgatcaagggcatccagtttggcagccagatcaagtacagctgcaccaagggctaccgcctcatcggcagcagcagcgccacctgcatcatcagcggggacaccgtcatctgggacaatgagacccccatctgtgaccgcatcccctgtggcctgccccccaccatcaccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaaggctgtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgagcggcaacacagcccactggagcaccaagccacccatctgccagaggatcccctgtggcctgccccccaccatcgccaacggggacttcatcagcaccaaccgggagaacttccactacggctctgtggtgacctaccgctgcaacctgggcagccggggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccacctgagatcctgcatggagagcacacccccagccaccaggacaacttcagccctggccaggaggtgttctacagctgtgagcccggctatgacctgcggggagctgccagcctgcactgcaccccccagggcgactggagccctgaggccccccgctgtgctgtgaagagctgtgatgacttcctgggccagctgccccacggccgggtgctcttccccctgaacctgcagctgggcgccaaggtgtcctttgtgtgtgatgagggcttccggctgaagggcagctctgtgagccactgtgtgctggtgggcatgaggagcctgtggaacaacagcgtgcctgtgtgtgagcacatcttctgccccaaccccccagccatcctgaatggccgccacacaggcaccccatctggggacatcccctacggcaaggagatctcctacacctgtgacccccacccagaccggggcatgaccttcaacctgattggagagagcaccatccgctgcaccagtgacccccatggaaatggagtgtggagcagccctgccccccgctgtgagctgtctgtgcgggccggccactgcaagaccccagagcagttcccctttgccagccccaccatccccatcaatgactttgagttccctgtgggcaccagcctgaactatgaatgtcggcccggctactttgggaagatgttcagcatcagctgcctggagaacctggtgtggagctctgtggaggacaactgcaggaggaagagctgtggccccccacctgagcccttcaacggcatggtgcacatcaacacagacacccagtttggcagcacagtgaactacagctgcaatgaaggcttccggctgattggcagccccagcaccacctgcctggtgtctggcaacaacgtgacctgggacaagaaggcccccatctgtgagatcatcagctgtgagcccccacccaccatcagcaatggagacttctacagcaacaacagaaccagcttccacaacggcaccgtggtgacctaccagtgccacacaggcccagatggagagcagctgtttgagctggtgggggagaggagcatctactgcaccagcaaggatgaccaggtgggcgtgtggagcagccccccaccccgctgcatcagcaccaacaagtgcacagcccctgaggtggagaatgccatccgggtgcccggcaacagaagcttcttcaccctgacagagatcatccgcttccgctgccagcccggctttgtgatggtgggcagccacacagtgcagtgccagaccaacggccgctggggccccaagctgccccactgcagccgggtgtgccagcccccacctgagatcctgcacggggagcacaccctgagccaccaggacaacttcagccctggccaggaggtgttctacagctgtgagcccagctatgacctgcggggggccgccagcctgcactgcaccccccagggcgactggagccctgaggccccccgctgcaccgtgaagagctgtgatgacttcctgggccagctgccccacggccgggtgctgctgcccctgaacctgcagctgggcgccaaggtgtcctttgtgtgtgatgagggcttccggctgaagggccgcagcgccagccactgtgtgctggccggcatgaaggccctgtggaacagctctgtgcctgtgtgtgagcagatcttctgccccaaccccccagccatcctgaatggccgccacacaggcaccccatttggagacatcccctacggcaaggagatctcctatgcctgtgacacccacccagaccggggcatgaccttcaacctgattggagagagcagcatccgctgcaccagtgacccccagggcaatggagtgtggagcagccctgccccccgctgtgagctgtctgtgcctgctgcctgcccccacccccccaagatccagaatggccactacatcggcggccacgtgtccctgtacctgcccggcatgaccatctcctacatctgtgaccccggctacctgctggtgggcaagggcttcatcttctgcacagaccagggcatctggagccagctggaccactactgcaaggaggtgaactgcagcttccccctcttcatgaatggcatcagcaaggagctggagatgaagaaggtgtaccactacggggactatgtgaccctgaagtgtgaagatggctacaccctggagggcagcccctggagccagtgccaggctgatgaccgctgggacccccccctggccaagtgcaccagcaggacccatgatgccctgattgtgggcaccctgagcggcaccatcttcttcatcctgctgatcatcttcctgtcctggatcatcctgaagcacaggaagggcaacaatgcccacgagaaccccaaggaggtggccatccacctgcacagccagggcggcagctctgtgcaccccaggaccctgcagaccaatgaggagaacagccgggtgctgccctag

SEQ ID NO: 148144 - DNA, 6120 bp, Artificial Sequence
  Description of Artificial Sequence: Synthetic coding sequence
atgggcgccagcagccccaggagccctgagcctgtgggccccccagcccctggcctgcccttctgctgcggcggcagcctgctggccgtggtggtgctgctggccctgcctgtggcctggggccagtgcaatgcccctgagtggctgccctttgcccggcccaccaacctgacagatgaatttgagttccccatcggcacctacctgaactatgagtgcaggcctggctacagcggccggcccttcagcatcatctgcctgaagaacagcgtgtggacaggagccaaggaccgctgcaggaggaagagctgcagaaatcctccagaccctgtgaatggcatggtgcacgtgatcaagggcatccagtttggcagccagatcaagtacagctgcaccaagggctaccgcctcatcggcagcagcagcgccacctgcatcatcagcggggacaccgtcatctgggacaatgagacccccatctgtgaccgcatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaaggctgtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgagcggcaacacagcccactggagcaccaagccacccatctgccagaggatcccctgtggcctgccccccaccatcgccaacggggacttcatcagcaccaaccgggagaacttccactacggctctgtggtgacctaccgctgcaacctgggcagccggggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccacctgagatcctgcatggagagcacacccccagccaccaggacaacttcagccctggccaggaggtgttctacagctgtgagcccggctatgacctgcggggagctgccagcctgcactgcaccccccagggcgactggagccctgaggccccccgctgtgctgtgaagagctgtgatgacttcctgggccagctgccccacggccgggtgctcttccccctgaacctgcagctgggcgccaaggtgtcctttgtgtgtgatgagggcttccggctgaagggcagctctgtgagccactgtgtgctggtgggcatgaggagcctgtggaacaacagcgtgcctgtgtgtgagcacatcttctgccccaaccccccagccatcctgaatggccgccacacaggcaccccatctggggacatcccctacggcaaggagatctcctacacctgtgacccccacccagaccggggcatgaccttcaacctgattggagagagcaccatccgctgcaccagtgacccccatggaaatggagtgtggagcagccctgccccccgctgtgagctgtctgtgcgggccggccactgcaagaccccagagcagttcccctttgccagccccaccatccccatcaatgactttgagttccctgtgggcaccagcctgaactatgaatgtcggcccggctactttgggaagatgttcagcatcagctgcctggagaacctggtgtggagctctgtggaggacaactgcaggaggaagagctgtggccccccacctgagcccttcaacggcatggtgcacatcaacacagacacccagtttggcagcacagtgaactacagctgcaatgaaggcttccggctgattggcagccccagcaccacctgcctggtgtctggcaacaacgtgacctgggacaagaaggcccccatctgtgagatcatcagctgtgagcccccacccaccatcagcaatggagacttctacagcaacaacagaaccagcttccacaacggcaccgtggtgacctaccagtgccacacaggcccagatggagagcagctgtttgagctggtgggggagaggagcatctactgcaccagcaaggatgaccaggtgggcgtgtggagcagccccccaccccgctgcatcagcaccaacaagtgcacagcccctgaggtggagaatgccatccgggtgcccggcaacagaagcttcttcaccctgacagagatcatccgcttccgctgccagcccggctttgtgatggtgggcagccacacagtgcagtgccagaccaacggccgctggggccccaagctgccccactgcagccgggtgtgccagcccccacctgagatcctgcacggggagcacaccctgagccaccaggacaacttcagccctggccaggaggtgttctacagctgtgagcccagctatgacctgcggggggccgccagcctgcactgcaccccccagggcgactggagccctgaggccccccgctgcaccgtgaagagctgtgatgacttcctgggccagctgccccacggccgggtgctgctgcccctgaacctgcagctgggcgccaaggtgtcctttgtgtgtgatgagggcttccggctgaagggccgcagcgccagccactgtgtgctggccggcatgaaggccctgtggaacagctctgtgcctgtgtgtgagcagatcttctgccccaaccccccagccatcctgaatggccgccacacaggcaccccatttggagacatcccctacggcaaggagatctcctatgcctgtgacacccacccagaccggggcatgaccttcaacctgattggagagagcagcatccgctgcaccagtgacccccagggcaatggagtgtggagcagccctgccccccgctgtgagctgtctgtgcctgctgcctgcccccacccccccaagatccagaatggccactacatcggcggccacgtgtccctgtacctgcccggcatgaccatctcctacatctgtgaccccggctacctgctggtgggcaagggcttcatcttctgcacagaccagggcatctggagccagctggaccactactgcaaggaggtgaactgcagcttccccctcttcatgaatggcatcagcaaggagctggagatgaagaaggtgtaccactacggggactatgtgaccctgaagtgtgaagatggctacaccctggagggcagcccctggagccagtgccaggctgatgaccgctgggacccccccctggccaagtgcaccagcaggacccatgatgccctgattgtgggcaccctgagcggcaccatcttcttcatcctgctgatcatcttcctgtcctggatcatcctgaagcacaggaagggcaacaatgcccacgagaaccccaaggaggtggccatccacctgcacagccagggcggcagctctgtgcaccccaggaccctgcagaccaatgaggagaacagccgggtgctgccctag

SEQ ID NO: 148145 - DNA, 6120 bp, Artificial Sequence
  Description of Artificial Sequence: Synthetic coding sequence
atgggcgccagcagccccaggagccctgagcctgtgggccccccagcccctggcctgcccttctgctgcggcggcagcctgctggccgtggtggtgctgctggccctgcctgtggcctggggccagtgcaatgcccctgagtggctgccctttgcccggcccaccaacctgacagatgaatttgagttccccatcggcacctacctgaactatgagtgcaggcctggctacagcggccggcccttcagcatcatctgcctgaagaacagcgtgtggacaggagccaaggaccgctgcaggaggaagagctgcagaaatcctccagaccctgtgaatggcatggtgcacgtgatcaagggcatccagtttggcagccagatcaagtacagctgcaccaagggctaccgcctcatcggcagcagcagcgccacctgcatcatcagcggggacaccgtcatctgggacaatgagacccccatctgtgaccgcatcccctgtggcctgccccccaccatcaccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgagcggcaacacagcccactggagcaccaagccacccatctgccagaggatcccctgtggcctgccccccaccatcgccaacggggacttcatcagcaccaaccgggagaacttccactacggctctgtggtgacctaccgctgcaacctgggcagccggggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccacctgagatcctgcatggagagcacacccccagccaccaggacaacttcagccctggccaggaggtgttctacagctgtgagcccggctatgacctgcggggagctgccagcctgcactgcaccccccagggcgactggagccctgaggccccccgctgtgctgtgaagagctgtgatgacttcctgggccagctgccccacggccgggtgctcttccccctgaacctgcagctgggcgccaaggtgtcctttgtgtgtgatgagggcttccggctgaagggcagctctgtgagccactgtgtgctggtgggcatgaggagcctgtggaacaacagcgtgcctgtgtgtgagcacatcttctgccccaaccccccagccatcctgaatggccgccacacaggcaccccatctggggacatcccctacggcaaggagatctcctacacctgtgacccccacccagaccggggcatgaccttcaacctgattggagagagcaccatccgctgcaccagtgacccccatggaaatggagtgtggagcagccctgccccccgctgtgagctgtctgtgcgggccggccactgcaagaccccagagcagttcccctttgccagccccaccatccccatcaatgactttgagttccctgtgggcaccagcctgaactatgaatgtcggcccggctactttgggaagatgttcagcatcagctgcctggagaacctggtgtggagctctgtggaggacaactgcaggaggaagagctgtggccccccacctgagcccttcaacggcatggtgcacatcaacacagacacccagtttggcagcacagtgaactacagctgcaatgaaggcttccggctgattggcagccccagcaccacctgcctggtgtctggcaacaacgtgacctgggacaagaaggcccccatctgtgagatcatcagctgtgagcccccacccaccatcagcaatggagacttctacagcaacaacagaaccagcttccacaacggcaccgtggtgacctaccagtgccacacaggcccagatggagagcagctgtttgagctggtgggggagaggagcatctactgcaccagcaaggatgaccaggtgggcgtgtggagcagccccccaccccgctgcatcagcaccaacaagtgcacagcccctgaggtggagaatgccatccgggtgcccggcaacagaagcttcttcaccctgacagagatcatccgcttccgctgccagcccggctttgtgatggtgggcagccacacagtgcagtgccagaccaacggccgctggggccccaagctgccccactgcagccgggtgtgccagcccccacctgagatcctgcacggggagcacaccctgagccaccaggacaacttcagccctggccaggaggtgttctacagctgtgagcccagctatgacctgcggggggccgccagcctgcactgcaccccccagggcgactggagccctgaggccccccgctgcaccgtgaagagctgtgatgacttcctgggccagctgccccacggccgggtgctgctgcccctgaacctgcagctgggcgccaaggtgtcctttgtgtgtgatgagggcttccggctgaagggccgcagcgccagccactgtgtgctggccggcatgaaggccctgtggaacagctctgtgcctgtgtgtgagcagatcttctgccccaaccccccagccatcctgaatggccgccacacaggcaccccatttggagacatcccctacggcaaggagatctcctatgcctgtgacacccacccagaccggggcatgaccttcaacctgattggagagagcagcatccgctgcaccagtgacccccagggcaatggagtgtggagcagccctgccccccgctgtgagctgtctgtgcctgctgcctgcccccacccccccaagatccagaatggccactacatcggcggccacgtgtccctgtacctgcccggcatgaccatctcctacatctgtgaccccggctacctgctggtgggcaagggcttcatcttctgcacagaccagggcatctggagccagctggaccactactgcaaggaggtgaactgcagcttccccctcttcatgaatggcatcagcaaggagctggagatgaagaaggtgtaccactacggggactatgtgaccctgaagtgtgaagatggctacaccctggagggcagcccctggagccagtgccaggctgatgaccgctgggacccccccctggccaagtgcaccagcaggacccatgatgccctgattgtgggcaccctgagcggcaccatcttcttcatcctgctgatcatcttcctgtcctggatcatcctgaagcacaggaagggcaacaatgcccacgagaaccccaaggaggtggccatccacctgcacagccagggcggcagctctgtgcaccccaggaccctgcagaccaatgaggagaacagccgggtgctgccctag

SEQ ID NO: 148146 - DNA, 6120 bp, Artificial Sequence
  Description of Artificial Sequence: Synthetic coding sequence
atgggcgccagcagccccaggagccctgagcctgtgggccccccagcccctggcctgcccttctgctgcggcggcagcctgctggccgtggtggtgctgctggccctgcctgtggcctggggccagtgcaatgcccctgagtggctgccctttgcccggcccaccaacctgacagatgaatttgagttccccatcggcacctacctgaactatgagtgcaggcctggctacagcggccggcccttcagcatcatctgcctgaagaacagcgtgtggacaggagccaaggaccgctgcaggaggaagagctgcagaaatcctccagaccctgtgaatggcatggtgcacgtgatcaagggcatccagtttggcagccagatcaagtacagctgcaccaagggctaccgcctcatcggcagcagcagcgccacctgcatcatcagcggggacaccgtcatctgggacaatgagacccccatctgtgaccgcatcccctgtggcctgccccccaccatcaccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaaggctgtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgagcggcaacacagcccactggagcaccaagccacccatctgccagaggatcccctgtggcctgccccccaccatcgccaacggggacttcatcagcaccaaccgggagaacttccactacggctctgtggtgacctaccgctgcaacctgggcagccggggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccacctgagatcctgcatggagagcacacccccagccaccaggacaacttcagccctggccaggaggtgttctacagctgtgagcccggctatgacctgcggggagctgccagcctgcactgcaccccccagggcgactggagccctgaggccccccgctgtgctgtgaagagctgtgatgacttcctgggccagctgccccacggccgggtgctcttccccctgaacctgcagctgggcgccaaggtgtcctttgtgtgtgatgagggcttccggctgaagggcagctctgtgagccactgtgtgctggtgggcatgaggagcctgtggaacaacagcgtgcctgtgtgtgagcacatcttctgccccaaccccccagccatcctgaatggccgccacacaggcaccccatctggggacatcccctacggcaaggagatctcctacacctgtgacccccacccagaccggggcatgaccttcaacctgattggagagagcaccatccgctgcaccagtgacccccatggaaatggagtgtggagcagccctgccccccgctgtgagctgtctgtgcgggccggccactgcaagaccccagagcagttcccctttgccagccccaccatccccatcaatgactttgagttccctgtgggcaccagcctgaactatgaatgtcggcccggctactttgggaagatgttcagcatcagctgcctggagaacctggtgtggagctctgtggaggacaactgcaggaggaagagctgtggccccccacctgagcccttcaacggcatggtgcacatcaacacagacacccagtttggcagcacagtgaactacagctgcaatgaaggcttccggctgattggcagccccagcaccacctgcctggtgtctggcaacaacgtgacctgggacaagaaggcccccatctgtgagatcatcagctgtgagcccccacccaccatcagcaatggagacttctacagcaacaacagaaccagcttccacaacggcaccgtggtgacctaccagtgccacacaggcccagatggagagcagctgtttgagctggtgggggagaggagcatctactgcaccagcaaggatgaccaggtgggcgtgtggagcagccccccaccccgctgcatcagcaccaacaagtgcacagcccctgaggtggagaatgccatccgggtgcccggcaacagaagcttcttcaccctgacagagatcatccgcttccgctgccagcccggctttgtgatggtgggcagccacacagtgcagtgccagaccaacggccgctggggccccaagctgccccactgcagccgggtgtgccagcccccacctgagatcctgcacggggagcacaccctgagccaccaggacaacttcagccctggccaggaggtgttctacagctgtgagcccagctatgacctgcggggggccgccagcctgcactgcaccccccagggcgactggagccctgaggccccccgctgcaccgtgaagagctgtgatgacttcctgggccagctgccccacggccgggtgctgctgcccctgaacctgcagctgggcgccaaggtgtcctttgtgtgtgatgagggcttccggctgaagggccgcagcgccagccactgtgtgctggccggcatgaaggccctgtggaacagctctgtgcctgtgtgtgagcagatcttctgccccaaccccccagccatcctgaatggccgccacacaggcaccccatttggagacatcccctacggcaaggagatctcctatgcctgtgacacccacccagaccggggcatgaccttcaacctgattggagagagcagcatccgctgcaccagtgacccccagggcaatggagtgtggagcagccctgccccccgctgtgagctgtctgtgcctgctgcctgcccccacccccccaagatccagaatggccactacatcggcggccacgtgtccctgtacctgcccggcatgaccatctcctacatctgtgaccccggctacctgctggtgggcaagggcttcatcttctgcacagaccagggcatctggagccagctggaccactactgcaaggaggtgaactgcagcttccccctcttcatgaatggcatcagcaaggagctggagatgaagaaggtgtaccactacggggactatgtgaccctgaagtgtgaagatggctacaccctggagggcagcccctggagccagtgccaggctgatgaccgctgggacccccccctggccaagtgcaccagcaggacccatgatgccctgattgtgggcaccctgagcggcaccatcttcttcatcctgctgatcatcttcctgtcctggatcatcctgaagcacaggaagggcaacaatgcccacgagaaccccaaggaggtggccatccacctgcacagccagggcggcagctctgtgcaccccaggaccctgcagaccaatgaggagaacagccgggtgctgccctag

SEQ ID NO: 148147 - DNA, 6120 bp, Artificial Sequence; identical to SEQ ID NO: 148146
  Description of Artificial Sequence: Synthetic coding sequence

SEQ ID NO: 148148 - DNA, 1755 bp, Artificial Sequence
  Description of Artificial Sequence: Synthetic coding sequence
ggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggatcccctgtggcctgccccccaccatcgccaacggggacttcatcagcaccaaccgggagaacttccactacggctctgtggtgacctaccgctgcaaccctggcagcggcggcaggaaggtgtttgagctggtgggggagcccagcatctactgcaccagcaatgatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggctttgtgatgaagggcccccggcgggtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggagctgcctccatgcgctgcaccccccagggcgactggagccctgctgcccccacctgtgaggtgaagagctgtgatgacttcatgggccagctgctgaatggccgggtgctcttccctgtgaacctgcagctgggcgccaaggtggactttgtgtgtgatgagggcttccagctgaagggcagcagcgccagctactgtgtgctggccggcatggagagcctgtggaacagctctgtgcctgtgtgtgagcagatcttctgccccagcccccctgtgatccccaacggccgccacacaggcaagcccctggaggtgttcccctttgggaagacagtgaactacacctgtgacccccacccagaccggggcaccagctttgacctgattggagagagcaccatccgctgcaccagtgacccccagggcaatggagtgtggagcagccctgccccccgctgtggcatcctgggccactgccaggccccagaccacttcctgtttgccaagctgaagacccagaccaatgccagtgacttccccatcggcaccagcctgaagtatgagtgcaggcctgagtactacggccggcccttcagcatcacctgcctggacaacctggtgtggagcagccccaaggatgtgtgcaagaggaagagctgcaagaccccaccagaccctgtgaatggcatggtgcacgtgatcacagacatccaggtgggcagccgcatcaactacagctgcaccaccggccacaggctcatcggccacagcagcgctgagtgcatcctgtctggaaatgctgcccactggagcaccaagccacccatctgccagaggagctgccacctgccctgtgagctgtttggccgctag

SEQ ID NO: 148149 - DNA, 1335 bp, Artificial Sequence
  Description of Artificial Sequence: Synthetic coding sequence
atggcccctcctgtgcggctggagcggcccttccccagccgccgcttccctggcctgctgctggccgccctggtgctgctgctgagcagcttcagtgaccagtgcaatgtgcctgagtggctgccctttgcccggcccaccaacctgacagatgactttgagttccccatcggcacctacctgaactatgagtgcaggcctggctacagcggccggcccttcagcatcatctgcctgaagaacagcgtgtggaccagcgccaaggacaagtgcaagaggaagagctgcagaaatcctccagaccctgtgaatggcatggcccacgtgatcaaggacatccagttccgcagccagatcaagtacagctgccccaagggctaccgcctcatcggcagcagcagcgccacctgcatcatcagcggcaacacagtcatctgggacaacaagacccctgtgtgtgaccgcatcatctgtggcctgccccccaccatcgccaacggggacttcaccagcatcagccgggagtacttccactacggctctgtggtgacctaccactgcaacctgggcagccggggcaagaaggtgtttgagctggtgggggagcccagcatctactgcaccagcaaggatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggcttcggcatgaagggccccagccacgtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggcagcacctacctgcactgcaccccccagggcgactggagccctgctgccccccgctgtgaggtgaagagctgtgatgacttcctgggccagctgcccaatggacatgtgctcttccccctgaacctgcagctgggcgccaaggtggactttgtgtgtgatgagggcttccagctgaagggcagcagcgccagctactgtgtgctggccggcatggagagcctgtggaacagctctgtgcctgtgtgtgagaggaagagctgtgagaccccacctgtgcctgtgaatggcatggtgcacgtgatcacagacatccacgtgggcagccgcatcaactacagctgcaccaccggcttctag

SEQ ID NO: 148150 - DNA, 1710 bp, Artificial Sequence
  Description of Artificial Sequence: Synthetic coding sequence
atggcccctcctgtgcggctggagcggcccttccccagccgccgcttccctggcctgctgctggccgccctggtgctgctgctgagcagcttcagtgaccagtgcaatgtgcctgagtggctgccctttgcccggcccaccaacctgacagatgactttgagttccccatcggcacctacctgaactatgagtgcaggcctggctacagcggccggcccttcagcatcatctgcctgaagaacagcgtgtggaccagcgccaaggacaagtgcaagaggaagagctgcagaaatcctccagaccctgtgaatggcatggcccacgtgatcaaggacatccagttccgcagccagatcaagtacagctgccccaagggctaccgcctcatcggcagcagcagcgccacctgcatcatcagcggcaacacagtcatctgggacaacaagacccctgtgtgtgaccgcatcatctgtggcctgccccccaccatcgccaacggggacttcaccagcatcagccgggagtacttccactacggctctgtggtgacctaccactgcaacctgggcagccggggcaagaaggtgtttgagctggtgggggagcccagcatctactgcaccagcaaggatgaccaggtgggcatctggagcggccctgccccccagtgcatcatccccaacaagtgcaccccacccaacgtggagaatggcatcctggtgtctgacaacagaagcctcttcagcctgaatgaggtggtggagttccgctgccagcccggcttcggcatgaagggccccagccacgtgaagtgccaggccctgaacaagtgggagcctgagctgcccagctgcagccgggtgtgccagcccccaccagatgtgctgcacgccgagaggacccagagggacaaggacaacttcagccctggccaggaggtgttctacagctgtgagcccggctatgacctgcggggcagcacctacctgcactgcaccccccagggcgactggagccctgctgccccccgctgtgaggtgaagagctgtgatgacttcctgggccagctgcccaatggacatgtgctcttccccctgaacctgcagctgggcgccaaggtggactttgtgtgtgatgagggcttccagctgaagggcagcagcgccagctactgtgtgctggccggcatggagagcctgtggaacagctctgtgcctgtgtgtgagaggaagagctgtgagaccccacctgtgcctgtgaatggcatggtgcacgtgatcacagacatccacgtgggcagccgcatcaactacagctgcaccaccggccaccggctgattggccacagcagcgctgagtgcatcctgagcggcaacacagcccactggagcatgaagccacccatctgccagcagatcttctgccccaaccccccagccatcctgaatggccgccacacaggcacccccctgggggacatcccctacggcaaggaggtgtcctacacctgtgacccccacccagaccggggcatgaccttcaacctgattggagagagcaccatccggaggaccagcgagccccatggaaatggagtgtggagcagccctgccccccgctgtgagctgcctgtgggcgccggcagccatgatgccctgattgtgggcaagttctatgaggtgtttgctgaggagttctgccacctgtag

SEQ ID NO: 148151 - DNA, 3279 bp, Artificial Sequence
  Description of Artificial Sequence: Synthetic coding sequence
atgggcgccgccggcctgctgggcgtcttcctggccctggtggcccctggggtgctgggcatcagctgtggcagccccccacccatcctgaatggccgcatctcctactacagcacccccatcgctgtgggcaccgtcatccgctacagctgcagcggcaccttccgcctcatcggggagaagagcctgctgtgcatcaccaaggacaaggtggatggcacctgggacaagccagcccccaagtgtgagtacttcaacaagtacagcagctgcccagagcccatcgtgcctgggggctacaagatccggggcagcaccccctaccgccacggggacagcgtgacctttgcctgcaagaccaacttctccatgaatggaaacaagtctgtgtggtgccaggccaacaacatgtggggccccacccggctgcccacctgtgtgtctgtgttccccctggagtgcccagccctgcccatgatccacaacggccaccacaccagtgaaaatgtgggcagcatcgcccctggcctgtctgtgacctacagctgtgagagcggctacctgctggtgggggagaagatcatcaactgcctgagcagcggcaagtggagcgctgtgccccccacctgtgaggaggcccgctgcaagagcctgggccgcttccccaacgggaaggtgaaggagccccccatcctgcgggtgggcgtgacagccaacttcttctgtgatgagggctaccgcctgcagggcccccccagcagccgctgtgtgattgctggccagggcgtggcctggaccaagatgcctgtgtgtgaggagatcttctgccccagccccccacccatcctgaatggccgccacatcggcaacagcctggccaacgtgtcctatggcagcatcgtgacctacacctgtgaccctgaccctgaggagggcgtgaacttcatcctgattggagagagcaccctgcgctgcaccgtggacagccagaagacaggcacctggagcggccctgccccccgctgtgagctgagcaccagcgctgtgcagtgcccccacccccagatcctgcggggccgcatggtgtctggccagaaggaccgctacacctacaatgacaccgtcatctttgcctgcatgtttggcttcaccctgaagggcagcaagcagatccgctgcaatgcccagggcacctgggagcccagcgcccctgtgtgtgagaaggagtgccaggccccacccaacatcctgaatggccagaaggaggacagacacatggtgcgctttgatcctggcaccagcatcaagtacagctgcaaccctggctacgtgctggtgggggaggagagcatccagtgcaccagcgagggcgtgtggaccccacctgtgccccagtgcaaggtggccgcctgtgaggccaccggccggcagctgctgaccaagccccagcaccagtttgtgcggccagatgtgaacagcagctgtggggagggctacaagctgagcggctctgtgtaccaggagtgccagggcaccatcccctggttcatggagatccggctgtgcaaggagatcacctgccccccacctcctgtgatctacaatggagcccacacaggcagcagcctggaggacttcccctacggcaccaccgtgacctacacctgcaaccctggccctgagcggggcgtggagttcagcctgattggagagagcaccatccgctgcaccagcaatgaccaggagcggggcacctggagcggccctgcccccctgtgcaagctgagcctgctggccgtgcagtgcagccacgtgcacatcgccaacggctacaagatcagcggcaaggaggccccctacttctacaatgacacagtgaccttcaagtgctacagcggcttcaccctgaagggcagcagccagatccgctgcaaggctgacaacacctgggaccctgagatccctgtgtgtgagaagggctgccagagccccccaggcctgcaccacggccgccacactggaggcaacacagtgttctttgtgtctggcatgacagtggactacacctgtgaccccggctacctgctggtgggcaacaagagcatccactgcatgcccagcggcaactggagccccagcgccccccgctgtgaggagacctgccagcacgtgcggcagagcctgcaggagctgcctgctggcagccgggtggagctggtgaacaccagctgccaggacggctaccagctgactggacatgcctaccagatgtgccaggatgctgaaaatggcatctggttcaagaagatccccctgtgcaaggtgatccactgccaccccccacctgtgattgtgaatggcaagcacacaggcatgatggccgagaacttcctgtatggaaatgaggtgtcctatgaatgtgaccagggcttctacctgctgggggagaagaagctgcagtgccgcagtgacagcaagggccacggctcctggagcggccccagcccccagtgcctgcggagcccccctgtgacccgctgccccaaccctgaggtgaagcacggctacaagctgaacaagacccacagcgcctacagccacaatgacatcgtgtatgtggactgcaaccctggcttcatcatgaatggcagcagggtcatccgctgccacacagacaacacctgggtgcctggggtgcccacctgcatcaagaaggccttcatcggctgccccccaccacccaagacccccaacggcaaccacactggaggcaacatcgcccgcttcagccctggcatgagcatcctgtacagctgtgaccagggctacctgctggtgggggaggccctgctgctgtgcacccatgagggcacctggagccagcctgccccccactgcaaggaggtgaactgcagcagccctgctgacatggatggcatccagaagggcctggagcccaggaagatgtaccagtacggggctgtggtgaccctggagtgtgaagatggctacatgctggagggcagcccccagagccagtgccagagcgaccaccagtggaacccccccctggccgtgtgccgcagccgcagcctggcccctgtgctgtgtggcattgctgctggcctcatcctgctgaccttcctgattgtcatcaccctgtatgtgatcagcaagcaccgggccaggaactactacacagacaccagccagaaggaggccttccacctggaggcccgggaggtgtacagcgtggacccctacaacccagccagctag

SEQ ID NO: 148152 - DNA, 3102 bp, Artificial Sequence
  Description of Artificial Sequence: Synthetic coding sequence
atgggcgccgccggcctgctgggcgtcttcctggccctggtggcccctggggtgctgggcatcagctgtggcagccccccacccatcctgaatggccgcatctcctactacagcacccccatcgctgtgggcaccgtcatccgctacagctgcagcggcaccttccgcctcatcggggagaagagcctgctgtgcatcaccaaggacaaggtggatggcacctgggacaagccagcccccaagtgtgagtacttcaacaagtacagcagctgcccagagcccatcgtgcctgggggctacaagatccggggcagcaccccctaccgccacggggacagcgtgacctttgcctgcaagaccaacttctccatgaatggaaacaagtctgtgtggtgccaggccaacaacatgtggggccccacccggctgcccacctgtgtgtctgtgttccccctggagtgcccagccctgcccatgatccacaacggccaccacaccagtgaaaatgtgggcagcatcgcccctggcctgtctgtgacctacagctgtgagagcggctacctgctggtgggggagaagatcatcaactgcctgagcagcggcaagtggagcgctgtgccccccacctgtgaggaggcccgctgcaagagcctgggccgcttccccaacgggaaggtgaaggagccccccatcctgcgggtgggcgtgacagccaacttcttctgtgatgagggctaccgcctgcagggcccccccagcagccgctgtgtgattgctggccagggcgtggcctggaccaagatgcctgtgtgtgaggagatcttctgccccagccccccacccatcctgaatggccgccacatcggcaacagcctggccaacgtgtcctatggcagcatcgtgacctacacctgtgaccctgaccctgaggagggcgtgaacttcatcctgattggagagagcaccctgcgctgcaccgtggacagccagaagacaggcacctggagcggccctgccccccgctgtgagctgagcaccagcgctgtgcagtgcccccacccccagatcctgcggggccgcatggtgtctggccagaaggaccgctacacctacaatgacaccgtcatctttgcctgcatgtttggcttcaccctgaagggcagcaagcagatccgctgcaatgcccagggcacctgggagcccagcgcccctgtgtgtgagaaggagtgccaggccccacccaacatcctgaatggccagaaggaggacagacacatggtgcgctttgatcctggcaccagcatcaagtacagctgcaaccctggctacgtgctggtgggggaggagagcatccagtgcaccagcgagggcgtgtggaccccacctgtgccccagtgcaaggtggccgcctgtgaggccaccggccggcagctgctgaccaagccccagcaccagtttgtgcggccagatgtgaacagcagctgtggggagggctacaagctgagcggctctgtgtaccaggagtgccagggcaccatcccctggttcatggagatccggctgtgcaaggagatcacctgccccccacctcctgtgatctacaatggagcccacacaggcagcagcctggaggacttcccctacggcaccaccgtgacctacacctgcaaccctggccctgagcggggcgtggagttcagcctgattggagagagcaccatccgctgcaccagcaatgaccaggagcggggcacctggagcggccctgcccccctgtgcaagctgagcctgctggccgtgcagtgcagccacgtgcacatcgccaacggctacaagatcagcggcaaggaggccccctacttctacaatgacacagtgaccttcaagtgctacagcggcttcaccctgaagggcagcagccagatccgctgcaaggctgacaacacctgggaccctgagatccctgtgtgtgagaaggagacctgccagcacgtgcggcagagcctgcaggagctgcctgctggcagccgggtggagctggtgaacaccagctgccaggacggctaccagctgaccggccacgcctaccagatgtgccaggatgctgaaaatggcatctggttcaagaagatccccctgtgcaaggtgatccactgccaccccccacctgtgattgtgaatggcaagcacacaggcatgatggccgagaacttcctgtatggaaatgaggtgtcctatgaatgtgaccagggcttctacctgctgggggagaagaagctgcagtgccgcagtgacagcaaaggacatggctcctggagcggccccagcccccagtgcctgcggagcccccctgtgacccgctgccccaaccctgaggtgaagcacggctacaagctgaacaagacccacagcgcctacagccacaatgacatcgtgtatgtggactgcaaccctggcttcatcatgaatggcagcagggtcatccgctgccacacagacaacacctgggtgcctggggtgcccacctgcatcaagaaggccttcatcggctgccccccaccacccaagaccccaaatggaaaccacactggaggcaacatcgcccgcttcagccctggcatgagcatcctgtacagctgtgaccagggctacctgctggtgggggaggccctgctgctgtgcacccatgagggcacctggagccagcctgccccccactgcaaggaggtgaactgcagcagccctgctgacatggatggcatccagaagggcctggagcccaggaagatgtaccagtatggagctgtggtgaccctggagtgtgaagatggctacatgctggagggcagcccccagagccagtgccagagcgaccaccagtggaacccccccctggccgtgtgccgcagccgcagcctggcccctgtgctgtgtggcattgctgctggcctcatcctgctgaccttcctgattgtcatcaccctgtatgtgatcagcaagcaccgggccaggaactactacacagacaccagccagaaggaggccttccacctggaggcccgggaggtgtacagcgtggacccctacaacccagccagctag

SEQ ID NO: 148153 - DNA, 2916 bp, Artificial Sequence
  Description of Artificial Sequence: Synthetic coding sequence
atgggcgccgccggcctgctgggcgtcttcctggccctggtggcccctggggtgctgggcatcagctgtggcagccccccacccatcctgaatggccgcatctcctactacagcacccccatcgctgtgggcaccgtcatccgctacagctgcagcggcaccttccgcctcatcggggagaagagcctgctgtgcatcaccaaggacaaggtggatggcacctgggacaagccagcccccaagtgtgagtacttcaacaagtacagcagctgcccagagcccatcgtgcctgggggctacaagatccggggcagcaccccctaccgccacggggacagcgtgacctttgcctgcaagaccaacttctccatgaatggaaacaagtctgtgtggtgccaggccaacaacatgtggggccccacccggctgcccacctgtgtgtctgtgttccccctggagtgcccagccctgcccatgatccacaacggccaccacaccagtgaaaatgtgggcagcatcgcccctggcctgtctgtgacctacagctgtgagagcggctacctgctggtgggggagaagatcatcaactgcctgagcagcggcaagtggagcgctgtgccccccacctgtgaggaggcccgctgcaagagcctgggccgcttccccaacgggaaggtgaaggagccccccatcctgcgggtgggcgtgacagccaacttcttctgtgatgagggctaccgcctgcagggcccccccagcagccgctgtgtgattgctggccagggcgtggcctggaccaagatgcctgtgtgtgaggagatcttctgccccagccccccacccatcctgaatggccgccacatcggcaacagcctggccaacgtgtcctatggcagcatcgtgacctacacctgtgaccctgaccctgaggagggcgtgaacttcatcctgattggagagagcaccctgcgctgcaccgtggacagccagaagacaggcacctggagcggccctgccccccgctgtgagctgagcaccagcgctgtgcagtgcccccacccccagatcctgcggggccgcatggtgtctggccagaaggaccgctacacctacaatgacaccgtcatctttgcctgcatgtttggcttcaccctgaagggcagcaagcagatccgctgcaatgcccagggcacctgggagcccagcgcccctgtgtgtgagaaggagtgccaggccccacccaacatcctgaatggccagaaggaggacagacacatggtgcgctttgatcctggcaccagcatcaagtacagctgcaaccctggctacgtgctggtgggggaggagagcatccagtgcaccagcgagggcgtgtggaccccacctgtgccccagtgcaaggtggccgcctgtgaggccaccggccggcagctgctgaccaagccccagcaccagtttgtgcggccagatgtgaacagcagctgtggggagggctacaagctgagcggctctgtgtaccaggagtgccagggcaccatcccctggttcatggagatccggctgtgcaaggagatcacctgccccccacctcctgtgatctacaatggagcccacacaggcagcagcctggaggacttcccctacggcaccaccgtgacctacacctgcaaccctggccctgagcggggcgtggagttcagcctgattggagagagcaccatccgctgcaccagcaatgaccaggagcggggcacctggagcggccctgcccccctgtgcaagctgagcctgctggccgtgcagtgcagccacgtgcacatcgccaacggctacaagatcagcggcaaggaggccccctacttctacaatgacacagtgaccttcaagtgctacagcggcttcaccctgaagggcagcagccagatccgctgcaaggctgacaacacctgggaccctgagatccctgtgtgtgagaaggagacctgccagcacgtgcggcagagcctgcaggagctgcctgctggcagccgggtggagctggtgaacaccagctgccaggacggctaccagctgaccggccacgcctaccagatgtgccaggatgctgaaaatggcatctggttcaagaagatccccctgtgcaaggtgatccactgccaccccccacctgtgattgtgaatggcaagcacacaggcatgatggccgagaacttcctgtatggaaatgaggtgtcctatgaatgtgaccagggcttctacctgctgggggagaagaagctgcagtgccgcagtgacagcaaaggacatggctcctggagcggccccagcccccagtgcctgcggagcccccctgtgacccgctgccccaaccctgaggtgaagcacggctacaagctgaacaagacccacagcgcctacagccacaatgacatcgtgtatgtggactgcaaccctggcttcatcatgaatggcagcagggtcatccgctgccacacagacaacacctgggtgcctggggtgcccacctgcatcaagaaggaggtgaactgcagcagccctgctgacatggatggcatccagaagggcctggagcccaggaagatgtaccagtatggagctgtggtgaccctggagtgtgaagatggctacatgctggagggcagcccccagagccagtgccagagcgaccaccagtggaacccccccctggccgtgtgccgcagccgcagcctggcccctgtgctgtgtggcattgctgctggcctcatcctgctgaccttcctgattgtcatcaccctgtatgtgatcagcaagcaccgggccaggaactactacacagacaccagccagaaggaggccttccacctggaggcccgggaggtgtacagcgtggacccctacaacccagccagctag

SEQ ID NO: 148154 - DNA, 3021 bp, Artificial Sequence
  Description of Artificial Sequence: Synthetic coding sequence
atgggcgccgccggcctgctgggcgtcttcctggccctggtggcccctggggtgctgggcatcagctgtggcagccccccacccatcctgaatggccgcatctcctactacagcacccccatcgctgtgggcaccgtcatccgctacagctgcagcggcaccttccgcctcatcggggagaagagcctgctgtgcatcaccaaggacaaggtggatggcacctgggacaagccagcccccaagtgtgagtacttcaacaagtacagcagctgcccagagcccatcgtgcctgggggctacaagatccggggcagcaccccctaccgccacggggacagcgtgacctttgcctgcaagaccaacttctccatgaatggaaacaagtctgtgtggtgccaggccaacaacatgtggggccccacccggctgcccacctgtgtgtctgtgttccccctggagtgcccagccctgcccatgatccacaacggccaccacaccagtgaaaatgtgggcagcatcgcccctggcctgtctgtgacctacagctgtgagagcggctacctgctggtgggggagaagatcatcaactgcctgagcagcggcaagtggagcgctgtgccccccacctgtgaggaggcccgctgcaagagcctgggccgcttccccaacgggaaggtgaaggagccccccatcctgcgggtgggcgtgacagccaacttcttctgtgatgagggctaccgcctgcagggcccccccagcagccgctgtgtgattgctggccagggcgtggcctggaccaagatgcctgtgtgtgaggagatcttctgccccagccccccacccatcctgaatggccgccacatcggcaacagcctggccaacgtgtcctatggcagcatcgtgacctacacctgtgaccctgaccctgaggagggcgtgaacttcatcctgattggagagagcaccctgcgctgcaccgtggacagccagaagacaggcacctggagcggccctgccccccgctgtgagctgagcaccagcgctgtgcagtgcccccacccccagatcctgcggggccgcatggtgtctggccagaaggaccgctacacctacaatgacaccgtcatctttgcctgcatgtttggcttcaccctgaagggcagcaagcagatccgctgcaatgcccagggcacctgggagcccagcgcccctgtgtgtgagaaggagtgccaggccccacccaacatcctgaatggccagaaggaggacagacacatggtgcgctttgatcctggcaccagcatcaagtacagctgcaaccctggctacgtgctggtgggggaggagagcatccagtgcaccagcgagggcgtgtggaccccacctgtgccccagtgcaaggtggccgcctgtgaggccaccggccggcagctgctgaccaagccccagcaccagtttgtgcggccagatgtgaacagcagctgtggggagggcaaccacctgcccaccaccccctgctacctgcagtggggcacccaccgggagttcctgcggcgcttcagcatctggaaccacggccacctgcacatgcctggccctgagcggggcgtggagttcagcctcatcggggagagcaccatccgctgcaccagcaatgaccaggagcggggcacctggagcggccctgcccccctgtgcaagctgagcctgctggccgtgcagtgcagccacgtgcacatcgccaacggctacaagatcagcggcaaggaggccccctacttctacaatgacacagtgaccttcaagtgctacagcggcttcaccctgaagggcagcagccagatccgctgcaaggctgacaacacctgggaccctgagatccctgtgtgtgagaaggagacctgccagcacgtgcggcagagcctgcaggagctgcctgctggcagccgggtggagctggtgaacaccagctgccaggacggctaccagctgactggacatgcctaccagatgtgccaggatgctgaaaatggcatctggttcaagaagatccccctgtgcaaggtgatccactgccaccccccacctgtgattgtgaatggcaagcacacaggcatgatggccgagaacttcctgtatggaaatgaggtgtcctatgaatgtgaccagggcttctacctgctgggggagaagaagctgcagtgccgcagtgacagcaagggccacggctcctggagcggccccagcccccagtgcctgcggagcccccctgtgacccgctgccccaaccctgaggtgaagcacggctacaagctgaacaagacccacagcgcctacagccacaatgacatcgtgtatgtggactgcaaccctggcttcatcatgaatggcagcagggtcatccgctgccacacagacaacacctgggtgcctggggtgcccacctgcatcaagaaggccttcatcggctgccccccaccacccaagacccccaacggcaaccacactggaggcaacatcgcccgcttcagccctggcatgagcatcctgtacagctgtgaccagggctacctgctggtgggggaggccctgctgctgtgcacccatgagggcacctggagccagcctgccccccactgcaaggaggtgaactgcagcagccctgctgacatggatggcatccagaagggcctggagcccaggaagatgtaccagtacggggctgtggtgaccctggagtgtgaagatggctacatgctggagggcagcccccagagccagtgccagagcgaccaccagtggaacccccccctggccgtgtgccgcagccgcagcctggcccctgtgctgtgtggcattgctgctggcctcatcctgctgaccttcctgattgtcatcaccctgtatgtgatcagcaagcaccgggccaggaactactacacagacaccagccagaaggaggccttccacctggaggcccgggaggtgtacagcgtggacccctacaacccagccagctag

SEQ ID NO: 148155 - DNA, 2226 bp, Artificial Sequence
  Description of Artificial Sequence: Synthetic coding sequence
atggctgctgctgagggccctgtgggagatggagagctgtggcagacctggctgcccaaccacgtggtgttcctgcggctgcgggagggcctgaagaaccagagccccacagaagctgagaagccagccagcagcagcctgcccagcagccccccaccccagctgctgaccagaaatgtggtgtttggcctgggcggggagctgttcctgtgggatggagaggacagcagcttcctggtggtgcggctgcggggccccagcggcggcggggaggagcccgccctgagccagtaccagaggctgctgtgcatcaacccccccctgtttgagatctaccaggtgctgctgagccccacccagcaccacgtggccctgattggcatcaagggcctgatggtgctggagctgcccaagcgctggggcaagaacagcgagtttgagggcggcaagagcacagtgaactgcagcaccacccctgtggccgagcgcttcttcaccagcagcaccagcctgaccctgaagcacgccgcctggtaccccagcgagatcctggacccccacgtggtgctgctgaccagtgacaacgtcatccgcatctacagcctgcgggagccccagacccccaccaacgtcatcatcctgtctgaggccgaggaggagagcctggtgctgaacaagggccgggcctacacagccagcctgggggagacagctgtggcctttgattttggccccctggccgctgtgcccaagaccctgtttggccagaatggcaaggatgaggtggtggcctaccccctgtacatcctgtatgaaaatggagagaccttcctgacctacatcagcctgctgcacagccctggcaacatcggcaagctgctgggccccctgcccatgcaccctgctgctgaggacaactacggctatgatgcctgtgctgtgctgtgcctgccctgtgtgcccaacatcctggtgattgccacagagagcggcatgctgtaccactgtgtggtgctggagggggaggaggaggatgaccacaccagcgagaagtcctgggacagcagaattgacctgatccccagcctgtatgtgtttgaatgtgtggagctggagctggccctgaagctggccagcggagaagatgacccctttgacagcgacttcagctgccctgtgaagctgcaccgggaccccaagtgccccagccgctaccactgcacccatgaagctggggtgcacagcgtgggcctgacctggatccacaagctgcacaagttcctgggcagtgatgaggaggacaaggacagcctgcaggagctgagcacagagcagaagtgctttgtggagcacatcctgtgcaccaagcccctgccctgccggcagcctgcccccatccggggcttctggatcgtgcctgacatcctgggccccaccatgatctgcatcaccagcacctatgagtgcctgatctggcccctgctgagcacagtgcacccagccagcccccccctgctgtgcacccgggaggatgtggaggtggccgagagccccctgcgggtgctggccgagaccccagacagctttgagaagcacatccgcagcatcctgcagaggtctgtggccaacccagccttcctgaaggccagcgagaaggacatcgcccctcctcctgaggagtgcctgcagctgctgagccgggccacccaggtgttccgggagcagtacatcctgaagcaggacctggccaaggaggagatccagaggagagtgaagctgctgtgtgaccagaagaagaagcagctggaggacctgagctactgccgggaggagaggaagagcctgcgggagatggccgagcggctggccgacaagtatgaggaggccaaggagaagcaggaggacatcatgaacaggatgaagaagctgctgcacagcttccacagcgagctgcctgtgctgagtgacagcgagcgggacatgaagaaggagctgcagctgatcccagaccagctgcggcacctgggcaatgccatcaagcaggtgaccatgaagaaggactaccagcagcagaagatggagaaggtgctgagcctgcccaagcccaccatcatcctgagcgcctaccagaggaagtgcatccagagcatcctgaaggaggagggggagcacatccgggagatggtgaagcagatcaatgacatccggaaccacgtgaacttctag

SEQ ID NO: 148156 - DNA, 762 bp, Artificial Sequence
  Description of Artificial Sequence: Synthetic coding sequence
atgatgatgaagatcccctggggcagcatccctgtgctgatgctgctgctgctgctgggcctgattgacatcagccaggcccagctgagctgcaccggccccccagccatccctggcatccctggcatccctggcaccccaggcccagatggccagcccggcaccccaggcatcaagggggagaagggcctgcccggcctggccggggaccatggagaatttggagagaagggggaccccggcatccctggcaaccctgggaaggtgggccccaagggccccatgggccccaagggcggccctggggcccctggggcccctggccccaagggggagagcggggactacaaggccacccagaagatcgccttcagcgccaccaggaccatcaacgtgcccctgcggcgggaccagaccatccgctttgaccacgtgatcaccaacatgaacaacaactatgagcccaggtctgggaagttcacctgcaaggtgcccggcctgtactacttcacctaccacgccagcagccggggcaacctgtgtgtgaacctgatgaggggccgggagcgggcccagaaggtggtgaccttctgtgactatgcctacaacaccttccaggtgaccactggaggcatggtgctgaagctggagcagggagaaaatgtgttcctgcaggccacagacaagaacagcctgctgggcatggagggcgccaacagcatcttcagcggcttcctgctcttcccagacatggaggcctag

SEQ ID NO: 148157 - DNA, 690 bp, Artificial Sequence
  Description of Artificial Sequence: Synthetic coding sequence
atgaagatcccctggggcagcatccctgtgctgatgctgctgctgctgctgggcctgattgacatcagccaggcccagctgagctgcaccggccccccagccatccctggcatccctggcatccctggcaccccaggcccagatggccagcccggcaccccaggcatcaagggggagaagggcctgcccggcctggccggggaccatggagaatttggagagaagggggaccccggcatccctggcaaccctgggaaggtgggccccaagggccccatgggccccaagggcggccctggggcccctggggcccctggccccaagggggagagcggggactacaaggccacccagaagatcgccttcagcgccaccaggaccatcaacgtgcccctgcggcgggaccagaccatccgctttgaccacgtgatcaccaacatgaacaacaactatgagcccaggtctgggaagttcacctgcaaggtgcccggcctgtactacttcacctaccacgccagcagccggggcaacctgtgtgtgaacctgatgaggggccgggagcgggcccagaaggtggtgaccttctgtgactatgcctacaacaccttccaggtgaccactggaggcatggtgctgaagctggagcagggagaaaatgtgttcctgcaggccacagacaagaacagctag

SEQ ID NO: 148158 - DNA, 756 bp, Artificial Sequence
  Description of Artificial Sequence: Synthetic coding sequence
atgaagatcccctggggcagcatccctgtgctgatgctgctgctgctgctgggcctgattgacatcagccaggcccagctgagctgcaccggccccccagccatccctggcatccctggcatccctggcaccccaggcccagatggccagcccggcaccccaggcatcaagggggagaagggcctgcccggcctggccggggaccatggagaatttggagagaagggggaccccggcatccctggcaaccctgggaaggtgggccccaagggccccatgggccccaagggcggccctggggcccctggggcccctggccccaagggggagagcggggactacaaggccacccagaagatcgccttcagcgccaccaggaccatcaacgtgcccctgcggcgggaccagaccatccgctttgaccacgtgatcaccaacatgaacaacaactatgagcccaggtctgggaagttcacctgcaaggtgcccggcctgtactacttcacctaccacgccagcagccggggcaacctgtgtgtgaacctgatgaggggccgggagcgggcccagaaggtggtgaccttctgtgactatgcctacaacaccttccaggtgaccactggaggcatggtgctgaagctggagcagggagaaaatgtgttcctgcaggccacagacaagaacagcctgctgggcatggagggcgccaacagcatcttcagcggcttcctgctcttcccagacatggaggcctag

SEQ ID NO: 148159 - DNA, 462 bp, Artificial Sequence
  Description of Artificial Sequence: Synthetic coding sequence
atgaagatcccctggggcagcatccctgtgctgatgctgctgctgctgctgggcctgattgacatcagccaggcccagctgagctgcaccggccccccagccatccctggcatccctggcatccctggcaccccaggcccagatggccagcccggcaccccaggcatcaagggggagaagggcctgcccggcctggccggggaccatggagaatttggagagaagggggaccccggcatccctggcaaccctgggaaggtgggccccaagggccccatgggccccaagggcggccctggggcccctggggcccctggccccaagggggagagcggggactacaaggccacccagaagatcgccttcagcgccaccaggaccatcaacgtgcccctgcggcgggaccagaccatccgctttgaccacgtgatcaccaacatgaacaacaactatgagccctag

SEQ ID NO: 148160 - DNA, 738 bp, Artificial Sequence
  Description of Artificial Sequence: Synthetic coding sequence
atggatgtgggccccagcagcctgccccacctgggcctgaagctgctgctgctgctgctgctgctgcccctgcggggccaggccaacacaggctgctacggcatccctggcatgcctggcctgcccggggcccctgggaaggatggctatgatggcctgcccggccccaagggggagcccggcatcccagccatccctggcatccggggccccaagggccagaagggggagcccggcctgcccggccaccctgggaagaatggccccatgggccccccaggcatgcctggggtgcccggccccatgggcatccctggagagcccggggaggagggccgctacaagcagaagttccagagcgtcttcaccgtgacccggcagacccaccagcccccagcccccaacagcctcatccgcttcaatgctgtgctgaccaacccccagggcgactatgacaccagcacaggcaagttcacctgcaaggtgcccggcctgtactactttgtgtaccacgccagccacacagccaacctgtgtgtgctgctgtacagaagtggagtgaaggtggtgaccttctgtggccacaccagcaagaccaaccaggtgaacagcggcggcgtgctgctgcggctgcaggtgggggaggaggtgtggctggccgtgaatgactactatgacatggtgggcatccagggcagtgacagcgtcttcagcggcttcctgctcttcccagactag

SEQ ID NO: 148161 - DNA, 738 bp, Artificial Sequence; identical to SEQ ID NO: 148160
  Description of Artificial Sequence: Synthetic coding sequence

SEQ ID NO: 148162 - DNA, 738 bp, Artificial Sequence; identical to SEQ ID NO: 148160
  Description of Artificial Sequence: Synthetic coding sequence

SEQ ID NO: 148163 - DNA, 777 bp, Artificial Sequence
  Description of Artificial Sequence: Synthetic coding sequence
atgctgctggtgctggtggtgctgatccctgtgctggtgtcctctgggggccctgagggccactatgagatgctgggcacctgcaggatggtgtgtgacccctacccagcccggggccctggggccggggccaggacagatggaggagatgccctgtctgagcagagcggggcccccccacccagcaccctggtgcagggcccccagggcaagccaggccgcacaggcaagccaggccccccaggccccccaggggaccccggccccccaggccctgtgggccccccaggagagaagggggagcccgggaagccaggccccccaggcctgcctggagctgggggcagcggggccatcagcacagccacctacaccaccgtgccccgggtggccttctacgccggcctgaagaacccccatgagggctatgaggtgctgaagtttgatgatgtggtgaccaacctgggcaacaactatgatgctgccagcggcaagttcacctgcaacatccctggcacctacttcttcacctaccacgtgctgatgagaggaggagatggcacctccatgtgggccgacctgtgcaagaatggccaggtgcgggccagcgccatcgcccaggatgctgaccagaactatgactatgccagcaacagcgtcatcctgcacctggatgctggagatgaggtgttcatcaagctggatggcggcaaggcccacggcggcaacagcaacaagtacagcaccttcagcggcttcatcatctacagcgactag

SEQ ID NO: 148164 - DNA, 864 bp, Artificial Sequence
  Description of Artificial Sequence: Synthetic coding sequence
atggccctgggcctgctgattgctgtgcccctgctgctgcaggccgcccccaggggggccgcccactatgagatgatgggcacctgcaggatgatctgtgacccctacacagctgcccctggaggagagcccccaggggccaaggcccagcccccaggccccagcacagctgccctggaggtgatgcaggacctgagcgccaaccccccaccacccttcatccagggccccaagggggaccccggccggcctgggaagccaggcccccggggccccccaggagagcccggccccccaggcccccggggccccccaggagagaagggggacagcggccggcccggcctgcccggcctgcagctgacagctggaacagccagcggcgtgggcgtggtgggcggcggggccggcgtgggcggggacagcgagggggaggtgaccagcgccctgagcgccaccttcagcggccccaagatcgccttctacgtgggcctgaagagcccccatgagggctatgaggtgctgaagtttgatgatgtggtgaccaacctgggcaaccactatgaccccaccaccgggaagttcagctgccaggtgcggggcatctacttcttcacctaccacatcctgatgagaggaggagatggcacctccatgtgggccgacctgtgcaagaatggccaggtgcgggccagcgccatcgcccaggatgctgaccagaactatgactatgccagcaacagcgtggtgctgcacctggacagcggagatgaggtgtatgtgaagctggatggcggcaaggcccatggaggcaacaacaacaagtacagcaccttcagcggcttcctgctgtacccagactag

SEQ ID NO: 148165 - DNA, 2007 bp, Artificial Sequence
  Description of Artificial Sequence: Synthetic coding sequence
atgtctgtgcgcttccgggtgggccgggaggagaatgcccagtggtggctgctgtacctgctggtgcctgccctcttctgcagagctgggggcagcatccccatcccccagaagctgtttggagaggtgaccagccccctcttccccaagccctaccccaacaactttgagaccaccaccgtcatcaccgtgcccaccggctacagagtgaagctggtgttccagcagtttgacctggagcccagcgagggctgcttctatgactatgtgaagatctctgctgacaagaagagcctgggccgcttctgtggccagctgggcagccccctgggcaaccccccaggcaagaaggagttcatgagccagggcaacaagatgctgctgaccttccacacagacttcagcaatgaggagaatggcaccatcatgttctacaagggcttcctggcctactaccaggccgtggacctggatgaatgtgccagccgcagcaagagcggggaggaggacccccagccccagtgccagcacctgtgccacaactacgtgggcggctacttctgcagctgccggcccggctatgagctgcaggaggacagacacagctgccaggccgagtgcagcagcgagctgtacacagaggccagcggctacatcagcagcctggagtaccccaggagctaccccccagacctgcgctgcaactacagcatccgggtggagcggggcctgaccctgcacctgaagttcctggagccctttgatattgatgaccaccagcaggtgcactgcccctatgaccagctgcagatctatgccaacgggaagaacatcggggagttctgtgggaagcagaggcccccagacctggacaccagcagcaatgctgtggacctgctcttcttcacagatgagagcggggacagccggggctggaagctgcgctacaccacagagatcatcaagtgcccccagcccaagaccctggatgagttcaccatcatccagaacctgcagccccagtaccagttccgggactacttcatcgccacctgcaagcagggctaccagctgattgagggcatccaggtggtggccggcgtggtggatgtgtctgctggccgggtgtcctggagcaccagcagccagacctgctgcaccagggtgtacacctgcacagcccagggcatctggaagaatgagcagaagggggagaagatcccccgctgcctgcctgtgtgtgggaagcctgtgaaccctgtggagcagaggcagaggatcatcggcggccagaaggccaagatgggcaacttcccctggcaggtgttcaccaacatccacggccggggcggcggggccctgctgggggaccgctggatcctgacagctgcccacaccctgtaccccaaggagcacgaggcccagagcaatgccagcctggatgtgttcctgggccacaccaacgtggaggagctgatgaagctgggcaaccaccccatcagaagagtgtctgtgcacccagactaccggcaggatgagagctacaactttgaaggagacatcgccctgctggagctggagaacagcgtgaccctgggccccaacctgctgcccatctgcctgcctgacaatgacaccttctatgacctgggcctgatgggctacgtgtctggctttggagtgatggaggagaagatcgcccatgacctgcgctttgtgcggctgcctgtggccaacccccaggcctgtgagaactggctgcggggcaagaacaggatggatgtgttcagccagaacatgttctgtgccggccaccccagcctgaagcaggatgcctgccagggcgacagcggaggagtgtttgctgtgcgggaccccaacacagaccgctgggtggccaccggcatcgtgtcctggggcatcggctgcagccggggctacggcttctacaccaaggtgctgaactacgtggactggatcaagaaggagatggaggaggaggactag

SEQ ID NO: 148166 - DNA, 1131 bp, Artificial Sequence
  Description of Artificial Sequence: Synthetic coding sequence
atgtggctgctgtacctgctggtgcctgccctcttctgcagagctgggggcagcatccccatcccccagaagctgtttggagaggtgaccagccccctcttccccaagccctaccccaacaactttgagaccaccaccgtcatcaccgtgcccaccggctacagagtgaagctggtgttccagcagtttgacctggagcccagcgagggctgcttctatgactatgtgaagatctctgctgacaagaagagcctgggccgcttctgtggccagctgggcagccccctgggcaaccccccaggcaagaaggagttcatgagccagggcaacaagatgctgctgaccttccacacagacttcagcaatgaggagaatggcaccatcatgttctacaagggcttcctggcctactaccaggccgtggacctggatgaatgtgccagccgcagcaagagcggggaggaggacccccagccccagtgccagcacctgtgccacaactacgtgggcggctacttctgcagctgccggcccggctatgagctgcaggaggacagacacagctgccaggccgagtgcagcagcgagctgtacacagaggccagcggctacatcagcagcctggagtaccccaggagctaccccccagacctgcgctgcaactacagcatccgggtggagcggggcctgaccctgcacctgaagttcctggagccctttgatattgatgaccaccagcaggtgcactgcccctatgaccagctgcagatctatgccaacgggaagaacatcggggagttctgtgggaagcagaggcccccagacctggacaccagcagcaatgctgtggacctgctcttcttcacagatgagagcggggacagccggggctggaagctgcgctacaccacagagatcatcaagtgcccccagcccaagaccctggatgagttcaccatcatccagaacctgcagccccagtaccagttccgggactacttcatcgccacctgcaagcagggctaccagctgattgagggctgcaccccagcccagcaccgggccttcggccgcatgaacagaagagagcggcgcttcctgggcgcctgccagtgtgtgggcagcccctag

SEQ ID NO: 148167 - DNA, 1962 bp, Artificial Sequence
  Description of Artificial Sequence: Synthetic coding sequence
tggctgctgtacctgctggtgcctgccctcttctgccgggccggcggcagcatccccatcccccagaagctgtttggagaggtgaccagccccctcttccccaagccctaccccaacaactttgagaccaccaccgtcatcaccgtgcccaccggctacagagtgaagctggtgttccagcagtttgacctggagcccagcgagggctgcttctatgactatgtgaagatctctgctgacaagaagagcctgggccgcttctgtggccagctgggcagccccctgggcaaccccccaggcaagaaggagttcatgagccagggcaacaagatgctgctgaccttccacacagacttcagcaatgaagaaaatggcaccatcatgttctacaagggcttcctggcctactaccaggccgtggacctggatgaatgtgccagccgcagcaagtctggagaggaggacccccagccccagtgccagcacctgtgccacaactacgtgggcggctacttctgcagctgcaggcctggctatgagctgcaggaggacagacacagctgccaggctgaatgtagcagcgagctgtacacagaggccagcggctacatcagcagcctggagtaccccaggagctaccccccagacctgcgctgcaactacagcatccgggtggagcggggcctgaccctgcacctgaagttcctggagccctttgatattgatgaccaccagcaggtgcactgcccctatgaccagctgcagatctatgccaacgggaagaacattggagagttctgtgggaagcagaggcccccagacctggacaccagcagcaatgctgtggacctgctcttcttcacagatgaaagtggggacagccggggctggaagctgcgctacaccacagagatcatcaagtgcccccagcccaagaccctggatgagttcaccatcatccagaacctgcagccccagtaccagttccgggactacttcatcgccacctgcaagcagggctaccagctgattgagggcatccaggtggtggccggcgtggtggatgtgtctgctggccgggtgtcctggagcaccagcagccagacctgctgcaccagggtgtacacctgcacagcccagggcatctggaagaatgagcagaagggggagaagatcccccgctgcctgcctgtgtgtgggaagcctgtgaaccctgtggagcagaggcagaggatcattggaggccagaaggccaagatgggcaacttcccctggcaggtgttcaccaacatccacggccggggcggcggggccctgctgggggaccgctggatcctgacagctgcccacaccctgtaccccaaggagcacgaggcccagagcaatgccagcctggatgtgttcctgggccacaccaacgtggaggagctgatgaagctgggcaaccaccccatccggcgggtgtctgtgcacccagactaccggcaggatgagagctacaactttgaaggagacatcgccctgctggagctggagaacagcgtgaccctgggccccaacctgctgcccatctgcctgcctgacaatgacaccttctatgacctgggcctgatgggctacgtgtctggcttcggcgtgatggaggagaagatcgcccatgacctgcgctttgtgcggctgcctgtggccaacccccaggcctgtgagaactggctgcggggcaagaacaggatggatgtgttcagccagaacatgttctgtgccggccaccccagcctgaagcaggatgcctgccagggcgacagcggcggcgtgtttgctgtgcgggaccccaacacagaccgctgggtggccactggaattgtgtcctggggcatcggctgcagccggggctacggcttctacaccaaggtgctgaactacgtggactggatcaagaaggagatggaggaggaggactag

SEQ ID NO: 148168 - DNA, 1464 bp, Artificial Sequence
  Description of Artificial Sequence: Synthetic coding sequence
atgcctggcccccgggtgtggggcaagtacctgtggaggagcccccacagcaagggctgccctggggccatgtggtggctgctgctgtggggcgtgctgcaggcctgccccacccggggctctgtgctgctggcccaggagctgccccagcagctgaccagccctggctacccagagccctacggcaagggccaggagagcagcacagacatcaaggcccctgagggctttgctgtgcggctggtgttccaggactttgacctggagcccagccaggactgtgccggggacagcgtgaccatcagctttgtgggcagtgaccccagccagttctgtggccagcagggcagccccctgggccggcccccaggccagcgggagtttgtgagcagcggccgcagcctgcggctgaccttccgcacccagcccagcagcgagaacaagacagcccacctgcacaagggcttcctggccctgtaccagacagtggccgtgaactacagccagcccatcagcgaggccagccggggcagcgaggccatcaatgcccctggggacaacccagccaaggtgcagaaccactgccaggagccctactaccaggccgctgctgctggggccctgacctgtgccaccccaggcacctggaaggaccggcaggatggagaggaggtgctgcagtgcatgcctgtgtgtggccggcctgtgacccccatcgcccagaaccagaccaccctgggcagcagccgggccaagctgggcaacttcccctggcaggccttcaccagcatccacggccggggcggcggggccctgctgggggaccgctggatcctgacagctgcccacaccatctaccccaaggacagcgtgtccctgaggaagaaccagagcgtgaatgtgttcctgggccacacagccattgatgagatgctgaagctgggcaaccaccctgtgcaccgggtggtggtgcacccagactaccggcagaatgaaagccacaacttcagcggggacatcgccctgctggagctgcagcacagcatccccctgggccccaacgtgctgcctgtgtgcctgcctgacaatgagaccctgtacagaagtggcctgctgggctacgtgtctggcttcggcatggagatgggctggctgaccacagagctgaagtacagccggctgcctgtggccccccgggaggcctgcaatgcctggctgcagaagaggcagaggcctgaggtgttcagtgacaacatgttctgtgtgggagatgagacccagaggcacagcgtgtgccagggcgacagcggctctgtgtatgtggtgtgggacaaccacgcccaccactgggtggccactggaattgtgtcctggggcatcggctgtggggagggctatgacttctacaccaaggtgctgtcctatgtggactggatcaagggcgtgatgaatggcaagaactag

SEQ ID NO: 148169 - DNA, 1317 bp, Artificial Sequence
  Description of Artificial Sequence: Synthetic coding sequence
atgcctggcccccgggtgtggggcaagtacctgtggaggagcccccacagcaagggctgccctggggccatgtggtggctgctgctgtggggcgtgctgcaggcctgccccacccggggctctgtgctgctggcccaggagctgccccagcagctgaccagccctggctacccagagccctacggcaagggccaggagagcagcacagacatcaaggcccctgagggctttgctgtgcggctggtgttccaggactttgacctggagcccagccaggactgtgccggggacagcgtgaccatcagctttgtgggcagtgaccccagccagttctgtggccagcagggcagccccctgggccggcccccaggccagcgggagtttgtgagcagcggccgcagcctgcggctgaccttccgcacccagcccagcagcgagaacaagacagcccacctgcacaagggcttcctggccctgtaccagacagtggccgtgaactacagccagcccatcagcgaggccagccggggcagcgaggccatcaatgcccctggggacaacccagccaaggtgcagaaccactgccaggagccctactaccaggccgctgctgctggggccctgacctgtgccaccccaggcacctggaaggaccggcaggatggagaggaggtgctgcagtgcatgcctgtgtgtggccggcctgtgacccccatcgcccagaaccagaccaccctgggcagcagccgggccaagctgggcaacttcccctggcaggccttcaccagcatccacggccggggcggcggggccctgctgggggaccgctggatcctgacagctgcccacaccatctaccccaaggacagcgtgtccctgaggaagaaccagagcgtgaatgtgttcctgggccacacagccattgatgagatgctgaagctgggcaaccaccctgtgcaccgggtggtggtgcacccagactaccggcagaatgaaagccacaacttcagcggggacatcgccctgctggagctgcagcacagcatccccctgggccccaacgtgctgcctgtgtgcctgcctgacaatgagaccctgtacagaagtggcctgctgggctacgtgtctggcttcggcatggagatgggctggctgaccacagagctgaagtacagccggctgcctgtggccccccgggaggcctgcaatgcctggctgcagaagaggcagaggcctgaggtgttcagtgacaacatgttctgtgtgggagatgaggccggggagagcctggagcccggcagaagaaggctgcagtag

SEQ ID NO: 148170 - DNA, 2067 bp, Artificial Sequence
  Description of Artificial Sequence: Synthetic coding sequence
atgtggtgcatcgtgctcttcagcctgctggcctgggtgtatgcagagcccaccatgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgccctacaacaagctgcaggtgatcttcaagagtgacttcagcaatgaggagcgcttcaccggctttgctgcctactacgtggccacagacatcaatgaatgtacagactttgtggatgtgccctgcagccacttctgcaacaacttcatcggcggctacttctgcagctgccccccagagtacttcctgcatgatgacatgaagaactgtggggtgaactgcagcggagatgtgttcaccgccctgattggagaaattgccagccccaactaccccaagccctacccagagaacagccgctgtgagtaccagatccggctggagaagggcttccaggtggtggtgaccctgcggagagaagattttgatgtggaggccgctgacagcgctggcaactgcctggacagcctggtgtttgtggccggggaccggcagtttggcccctactgcggccacggcttccctggccccctgaacatcgagaccaagagcaatgccctggacatcatcttccagacagacctgaccggccagaagaagggctggaagctgcgctaccacggggaccccatgccctgccccaaggaggacacccccaacagcgtgtgggagcccgccaaggccaagtatgtgttcagagatgtggtgcagatcacctgcctggatggctttgaggtggtggagggccgggtgggcgccaccagcttctacagcacctgccagagcaatggcaagtggagcaacagcaagctgaagtgccagcctgtggactgtggcatccctgagagcattgaaaatggcaaggtggaggaccctgagagcaccctgtttggcagcgtcatccgctacacctgtgaggagccctactactacatggagaatggaggcggcggggagtaccactgtgctggaaatggctcctgggtgaatgaggtgctgggccctgagctgcccaagtgtgtgcctgtgtgtggggtgccccgggagccctttgaggagaagcagaggatcattggaggcagtgatgctgacatcaagaacttcccctggcaggtgttctttgacaacccctgggccggcggggccctgatcaatgagtactgggtgctgacagctgcccacgtggtggagggcaaccgggagcccaccatgtatgtgggcagcacctctgtgcagaccagccggctggccaagagcaagatgctgaccccagagcacgtgttcatccaccctggctggaagctgctggaggtgcctgagggccgcaccaactttgacaatgacatcgccctggtgcggctgaaggaccctgtgaagatgggccccaccgtgagccccatctgcctgcccggcaccagcagtgactacaacctgatggatggagacctgggcctcatcagcggctggggccgcacagagaagagggacagagctgtgcggctgaaggccgcccggctgcctgtggcccccctgaggaagtgcaaggaggtgaaggtggagaagcccacagcagatgctgaggcctacgtgttcacccccaacatgatctgtgccggcggggagaagggcatggacagctgcaagggggacagcggcggggcctttgctgtgcaggaccccaatgacaagaccaagttctatgctgctggcctggtgtcctggggcccccagtgtggcacctacggcctgtacaccagggtgaagaactacgtggactggatcatgaagaccatgcaggagaacagcaccccaagagaagattag

SEQ ID NO: 148171 - DNA, 2067 bp, Artificial Sequence; identical to SEQ ID NO: 148170
  Description of Artificial Sequence: Synthetic coding sequence

SEQ ID NO: 148172 - DNA, 2049 bp, Artificial Sequence
  Description of Artificial Sequence: Synthetic coding sequence
atgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgccctacaacaagctgcaggtgatcttcaagagtgacttcagcaatgaggagcgcttcaccggctttgctgcctactacgtggccacagacaaggatgagtgcagcggccgggcccagctgtggaaccacatgtctgatgtgccctgcagccacttctgcaacaacttcatcggcggctacttctgcagctgccccccagagtacttcctgcatgatgacatgaagaactgtggggtgaactgcagcggagatgtgttcaccgccctgattggagagatcgccagccccaactaccccaagccctacccagagaacagccgctgtgagtaccagatccggctggagaagggcttccaggtgcacctgagcctgctgctgaagctggagtgcagcggggccatcacagcccactgcagcctggacctgctgggcagcattgctggggaccggcagtttggcccctactgcggccacggcttccctggccccctgaacatcgagaccaagagcaatgccctggacatcatcttccagacagacctgaccggccagaagaagggctggaagctgcgctaccacggggaccccatgccctgccccaaggaggacacccccaacagcgtgtgggagcccgccaaggccaagtatgtgttcagagatgtggtgcagatcacctgcctggatggctttgaggtggtggagggccgggtgggcgccaccagcttctacagcacctgccagagcaatggcaagtggagcaacagcaagctgaagtgccagcctgtggactgtggcatccctgagagcattgaaaatggcaaggtggaggaccctgagagcaccctgtttggcagcgtcatccgctacacctgtgaggagccctactactacatggagaatggaggcggcggggaggagcgggagcggggggagtaccactgtgctggaaatggctcctgggtgaatgaggtgctgggccctgagctgcccaagtgtgtgcctgtgtgtggggtgccccgggagccctttgaggagaagcagaggatcattggaggcagtgatgctgacatcaagaacttcccctggcaggtgttctttgacaacccctgggccggcggggccctgatcaatgagtactgggtgctgacagctgcccacgtggtggagggcaaccgggagcccaccatgtatgtgggcagcacctctgtgcagaccagccggctggccaagagcaagatgctgaccccagagcacgtgttcatccaccctggctggaagctgctggaggtgcctgagggccgcaccaactttgacaatgacatcgccctggtgcggctgaaggaccctgtgaagatgggccccaccgtgagccccatctgcctgcccggcaccagcagtgactacaacctgatggatggagacctgggcctcatcagcggctggggccgcacagagaagagggacagagctgtgcggctgaaggccgcccggctgcctgtggcccccctgaggaagtgcaaggaggtgaaggtggagaagcccacagcagatgctgaggcctacgtgttcacccccaacatgatctgtgccggcggggagaagggcatggacagctgcaagggggacagcggcggggcctttgctgtgcaggaccccaatgacaagaccaagttctatgctgctggcctggtgtcctggggcccccagtgtggcacctacggcctgtacaccagggtgaagaactacgtggactggatcatgaagaccatgcaggagaacagcaccccaagagaagattag

SEQ ID NO: 148173 - DNA, 507 bp, Artificial Sequence
  Description of Artificial Sequence: Synthetic coding sequence
atgtggtgcatcgtgctcttcagcctgctggcctgggtgtatgcagagcccaccatgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgccctacaacaagctgcaggtgatcttcaagagtgacttcagcaatgaggagcgcttcaccggctttgctgcctactacgtggccacagacatcaatgaatgtacagactttgtggatgtgccctgcagccacttctgcaacaacttcatcggcggctacttctgcagctgccccccagagtacttcctgcatgatgacatgtag

SEQ ID NO: 148174 - DNA, 2067 bp, Artificial Sequence; identical to SEQ ID NO: 148170
  Description of Artificial Sequence: Synthetic coding sequence

SEQ ID NO: 148175 - DNA, 312 bp, Artificial Sequence
  Description of Artificial Sequence: Synthetic coding sequence
atgtggtgcatcgtgctcttcagcctgctggcctgggtgtatgcagagcccaccatgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgccctactag

SEQ ID NO: 148176 - DNA, 306 bp, Artificial Sequence
  Description of Artificial Sequence: Synthetic coding sequence
atgtggtgcatcgtgctcttcagcctgctggcctgggtgtatgcagagcccaccatgtacggggagatcctgagccccaactacccccaggcctaccccagcgaggtggagaagtcctgggacatcgaggtgcctgagggctacggcatccacctgtacttcacccacctggacatcgagctgtctgagaactgtgcctatgattctgtgcagatcatcagcggggacacagaggagggccgcctgtgtggccagaggagcagcaacaacccccacagccccatcgtggaggagttccaggtgtag

SEQ ID NO: 148177 - DNA, 2259 bp, Artificial Sequence
  Description of Artificial Sequence: Synthetic coding sequence
atgggccccctgatggtgctcttctgcctgctcttcctgtacccaggcctggccgacagcgcccccagctgcccccagaatgtgaacatcagcggcggcaccttcaccctgagccacggctgggcccctggcagcctgctgacctacagctgcccccagggcctgtaccccagccctgccagccggctgtgcaagagcagcggccagtggcagacccctggggccaccaggagcctgagcaaggctgtgtgcaagcctgtgcgctgcccagcccctgtgtcctttgaaaatggcatctacaccccccggctgggcagctaccctgtgggcggcaatgtgtcctttgaatgtgaagatggcttcatcctgcggggcagccctgtgcggcagtgccggcccaacggcatgtgggatggagaaacagctgtgtgtgacaacggggccggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggagagcctgggcaggaagatccagatccagaggagcggccacctgaacctgtacctgctgctggactgcagccagagcgtgtctgaaaatgacttcctgatcttcaaggagagcgccagcctgatggtggaccgcatcttctcctttgagatcaacgtgtctgtggccatcatcacctttgccagcgagcccaaggtgctgatgtctgtgctgaatgacaacagccgggacatgacagaggtgatcagcagcctggagaatgccaactacaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggccgtcatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggggagagcggcggcgctgtgttcctggagcggcgcttccgcttcttccaggtgggcctggtgtcctggggcctgtacaacccctgcctgggcagcgctgacaagaacagcaggaagagggcccccaggagcaaggtgcccccaccccgggacttccacatcaacctcttcaggatgcagccctggctgcggcagcacctgggagatgtgctgaacttcctgcccctgtag

SEQ ID NO: 148178 - DNA, 1134 bp, Artificial Sequence
  Description of Artificial Sequence: Synthetic coding sequence
atgacagaggtgatcagcagcctggagaatgccaactacaaggaccatgaaaatggcaccggcaccaacacctacgccgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggctgtgatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggcggcagcggggagctgggcagcctgcagcccctgccctggctgtgctag

SEQ ID NO: 148179 - DNA, 2259 bp, Artificial Sequence; identical to SEQ ID NO: 148177
  Description of Artificial Sequence: Synthetic coding sequence

SEQ ID NO: 148180 - DNA, 1578 bp, Artificial Sequence
  Description of Artificial Sequence: Synthetic coding sequence
atggtgctcttctgcctgctcttcctgtacccagctggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggcaccggcaccaacacctacgccgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggctgtgatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggggagagcggcggcgctgtgttcctggagcggcgcttccgcttcttccaggtgggcctggtgtcctggggcctgtacaacccctgcctgggcagcgctgacaagaacagcaggaagagggcccccaggagcaaggtgcccccaccccgggacttccacatcaacctcttcaggatgcagccctggctgcggcagcacctgggagatgtgctgaacttcctgcccctgtag

SEQ ID NO: 148181 - DNA, 2259 bp, Artificial Sequence; identical to SEQ ID NO: 148177
  Description of Artificial Sequence: Synthetic coding sequence

SEQ ID NO: 148182 - DNA, 1578 bp, Artificial Sequence; identical to SEQ ID NO: 148180
  Description of Artificial Sequence: Synthetic coding sequence

SEQ ID NO: 148183 - DNA, 2259 bp, Artificial Sequence; identical to SEQ ID NO: 148177
  Description of Artificial Sequence: Synthetic coding sequence

SEQ ID NO: 148184 - DNA, 420 bp, Artificial Sequence
  Description of Artificial Sequence: Synthetic coding sequence
atgggccccctgatggtgctcttctgcctgctcttcctgtacccaggcctggccgacagcgcccccagctgcccccagaatgtgaacatcagcggcggcaccttcaccctgagccacggctgggcccctggcagcctgctgacctacagctgcccccagggcctgtaccccagccctgccagccggctgtgcaagagcagcggccagtggcagacccctggggccaccaggagcctgagcaaggctgtgtgcaagcctgtgcgctgcccagcccctgtgtcctttgaaaatggcatctacaccccccggctgggcagctaccctgtgggcggcaatgtgtcctttgaatgtgaagatggcttcatcctgcggggcagccctgtgcggcagtgccggcccaacggcatgtgggatggatag

SEQ ID NO: 148185 - DNA, 510 bp, Artificial Sequence
  Description of Artificial Sequence: Synthetic coding sequence
atgagggccctgtgcatccgggagacctgcagcagcgagctgggcttcagcaggaactggagcaggaggaaggccggccactgccccaaccctggcatcagcctgggcgctgtgaggacaggcttccgcttcggccacggggacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggctag

SEQ ID NO: 148186 - DNA, 420 bp, Artificial Sequence; identical to SEQ ID NO: 148184
  Description of Artificial Sequence: Synthetic coding sequence

SEQ ID NO: 148187 - DNA, 2259 bp, Artificial Sequence; identical to SEQ ID NO: 148177
  Description of Artificial Sequence: Synthetic coding sequence

SEQ ID NO: 148188 - DNA, 378 bp, Artificial Sequence
  Description of Artificial Sequence: Synthetic coding sequence
atgggccccctgatggtgctcttctgcctgctcttcctgtacccaggcctggccgacagcgcccccagctgcccccagaatgtgaacatcagcggcggcaccttcaccctgagccacggctgggcccctggcagcctgctgacctacagctgcccccagggcctgtaccccagccctgccagccggctgtgcaagagcagcggccagtggcagacccctggggccaccaggagcctgagcaaggctgtgtgcaagccaggccactgccccaaccctggcatcagcctgggcgctgtgaggacaggcttccgctttggacatggagacaaggtgcgctaccgctgcagcagcaacctggtgctgaccggcagcagctag

SEQ ID NO: 148189 - DNA, 510 bp, Artificial Sequence; identical to SEQ ID NO: 148185
  Description of Artificial Sequence: Synthetic coding sequence

SEQ ID NO: 148190 - DNA, 1062 bp, Artificial Sequence
  Description of Artificial Sequence: Synthetic coding sequence
atgggccccctgatggtgctcttctgcctgctcttcctgtacccagctggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggagagcctgggcaggaagatccagatccagaggagcggccacctgaacctgtacctgctgctggactgcagccagagcgtgtctgaaaatgacttcctgatcttcaaggagagcgccagcctgatggtggaccgcatcttctcctttgagatcaacgtgtctgtggccatcatcacctttgccagcgagcccaaggtgctgatgtctgtgctgaatgacaacagccgggacatgacagaggtgatcagcagcctggagaatgccaactacaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagtag

SEQ ID NO: 148191 - DNA, 2259 bp, Artificial Sequence; identical to SEQ ID NO: 148177
  Description of Artificial Sequence: Synthetic coding sequence

SEQ ID NO: 148192 - DNA, 1062 bp, Artificial Sequence; identical to SEQ ID NO: 148190
  Description of Artificial Sequence: Synthetic coding sequence

SEQ ID NO: 148193 - DNA, 1062 bp, Artificial Sequence; identical to SEQ ID NO: 148190
  Description of Artificial Sequence: Synthetic coding sequence

SEQ ID NO: 148194 - DNA, 510 bp, Artificial Sequence; identical to SEQ ID NO: 148185
  Description of Artificial Sequence: Synthetic coding sequence

SEQ ID NO: 148195 - DNA, 1578 bp, Artificial Sequence; identical to SEQ ID NO: 148180
  Description of Artificial Sequence: Synthetic coding sequence

SEQ ID NO: 148196 - DNA, 1062 bp, Artificial Sequence; identical to SEQ ID NO: 148190
  Description of Artificial Sequence: Synthetic coding sequence

SEQ ID NO: 148197 - DNA, 405 bp, Artificial Sequence
  Description of Artificial Sequence: Synthetic coding sequence
tgaggccactgccccaaccctggcatcagcctgggcgctgtgaggacaggcttccgcttcggccacggggacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggagagcctgggcaggaagatccagatccagaggagcggccacctgaacctgtacctgctgctggactgcagccagagcgtgtctgaaaatgacttcctgatcttcaaggagagcgccagcctgatggtgtag

SEQ ID NO: 148198 - DNA, 1578 bp, Artificial Sequence; identical to SEQ ID NO: 148180
  Description of Artificial Sequence: Synthetic coding sequence

SEQ ID NO: 148199 - DNA, 1578 bp, Artificial Sequence; identical to SEQ ID NO: 148180
  Description of Artificial Sequence: Synthetic coding sequence

SEQ ID NO: 148200 - DNA, 1062 bp, Artificial Sequence; identical to SEQ ID NO: 148190
  Description of Artificial Sequence: Synthetic coding sequence

SEQ ID NO: 148201 - DNA, 477 bp, Artificial Sequence
  Description of Artificial Sequence: Synthetic coding sequence
atgagggccctgtgcatccgggagacctgcagcagcgagctgggcttcagcaggaactggagcaggaggaaggccggccactgccccaaccctggcatcagcctgggcgctgtgaggacaggcttccgcttcggccacggggacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggagagcctgggcaggaagatccagatccagaggagcggccacctgaacctgtacctgctgctggactgcagccagagcgtgtctgaaaatgacttcctgatcttcaaggagagcgccagcctgatggtgtag

SEQ ID NO: 148202 - DNA, 477 bp, Artificial Sequence; identical to SEQ ID NO: 148201
  Description of Artificial Sequence: Synthetic coding sequence

SEQ ID NO: 148203 - DNA, 978 bp, Artificial Sequence
  Description of Artificial Sequence: Synthetic coding sequence
atgggcaccaggtctgccatcgccgccccccgcatcctgtgcagccggggcctgcggagcggcagcgcccgggccaccggcagcggcgtggagaggagccccagcgctgccaaccccaccctgatgaccagcctgcggacctggcccctgccctgggccctgcccagccccacctgcctgggcccccccatccccccccggcggcagaggatcttctcctttgagatcaacgtgtctgtggccatcatcacctttgccagcgagcccaaggtgctgatgtctgtgctgaatgacaacagccgggacatgacagaggtgatcagcagcctggagaatgccaactacaaggaccatgaaaatggcaccggcaccaacacctacgccgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggcctag

SEQ ID NO: 148204 - DNA, 477 bp, Artificial Sequence; identical to SEQ ID NO: 148201
  Description of Artificial Sequence: Synthetic coding sequence

SEQ ID NO: 148205 - DNA, 1062 bp, Artificial Sequence; identical to SEQ ID NO: 148190
  Description of Artificial Sequence: Synthetic coding sequence

SEQ ID NO: 148206 - DNA, 420 bp, Artificial Sequence; identical to SEQ ID NO: 148184
  Description of Artificial Sequence: Synthetic coding sequence

SEQ ID NO: 148207 - DNA, 438 bp, Artificial Sequence
  Description of Artificial Sequence: Synthetic coding sequence
tgaggccactgccccaaccctggcatcagcctgggcgctgtgaggacaggcttccgcttcggccacggggacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggctag

SEQ ID NO: 148208 - DNA, 378 bp, Artificial Sequence; identical to SEQ ID NO: 148188
  Description of Artificial Sequence: Synthetic coding sequence

SEQ ID NO: 148209 - DNA, 420 bp, Artificial Sequence; identical to SEQ ID NO: 148184
  Description of Artificial Sequence: Synthetic coding sequence

SEQ ID NO: 148210 - DNA, 477 bp, Artificial Sequence; identical to SEQ ID NO: 148201
  Description of Artificial Sequence: Synthetic coding sequence

SEQ ID NO: 148211 - DNA, 378 bp, Artificial Sequence; identical to SEQ ID NO: 148188
  Description of Artificial Sequence: Synthetic coding sequence

SEQ ID NO: 148212 - DNA, 1863 bp, Artificial Sequence
  Description of Artificial Sequence: Synthetic coding sequence
atgggccccctgatggtgctcttctgcctgctcttcctgtacccagctggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggagagcctgggcaggaagatccagatccagaggagcggccacctgaacctgtacctgctgctggactgcagccagagcgtgtctgaaaatgacttcctgatcttcaaggagagcgccagcctgatggtggaccgcatcttctcctttgagatcaacgtgtctgtggccatcatcacctttgccagcgagcccaaggtgctgatgtctgtgctgaatgacaacagccgggacatgacagaggtgatcagcagcctggagaatgccaactacaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggccgtcatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggggagagcggcggcgctgtgttcctggagcggcgcttccgcttcttccaggtgggcctggtgtcctggggcctgtacaacccctgcctgggcagcgctgacaagaacagcaggaagagggcccccaggagcaaggtgcccccaccccgggacttccacatcaacctcttcaggatgcagccctggctgcggcagcacctgggagatgtgctgaacttcctgcccctgtag

SEQ ID NO: 148213 - DNA, 378 bp, Artificial Sequence; identical to SEQ ID NO: 148188
  Description of Artificial Sequence: Synthetic coding sequence

SEQ ID NO: 148214 - DNA, 420 bp, Artificial Sequence; identical to SEQ ID NO: 148184
  Description of Artificial Sequence: Synthetic coding sequence

SEQ ID NO: 148215 - DNA, 378 bp, Artificial Sequence; identical to SEQ ID NO: 148188
  Description of Artificial Sequence: Synthetic coding sequence

SEQ ID NO: 148216 - DNA, 2259 bp, Artificial Sequence; identical to SEQ ID NO: 148177
  Description of Artificial Sequence: Synthetic coding sequence

SEQ ID NO: 148217 - DNA, 378 bp, Artificial Sequence; identical to SEQ ID NO: 148188
  Description of Artificial Sequence: Synthetic coding sequence

SEQ ID NO: 148218 - DNA, 510 bp, Artificial Sequence; identical to SEQ ID NO: 148185
  Description of Artificial Sequence: Synthetic coding sequence

SEQ ID NO: 148219 - DNA, 1578 bp, Artificial Sequence; identical to SEQ ID NO: 148180
  Description of Artificial Sequence: Synthetic coding sequence

SEQ ID NO: 148220 - DNA, 438 bp, Artificial Sequence; identical to SEQ ID NO: 148207
  Description of Artificial Sequence: Synthetic coding sequence

SEQ ID NO: 148221 - DNA, 405 bp, Artificial Sequence; identical to SEQ ID NO: 148197
  Description of Artificial Sequence: Synthetic coding sequence

SEQ ID NO: 148222 - DNA, 420 bp, Artificial Sequence; identical to SEQ ID NO: 148184
  Description of Artificial Sequence: Synthetic coding sequence

SEQ ID NO: 148223 - DNA, 420 bp, Artificial Sequence; identical to SEQ ID NO: 148184
  Description of Artificial Sequence: Synthetic coding sequence

SEQ ID NO: 148224 - DNA, 1617 bp, Artificial Sequence
  Description of Artificial Sequence: Synthetic coding sequence
atgagggccctgtgcatccgggagacctgcagcagcgagctgggcttcagcaggaactggagcaggaggaaggccggccactgccccaaccctggcatcagcctgggcgctgtgaggacaggcttccgcttcggccacggggacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggccgtcatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggggagagcggcggcgctgtgttcctggagcggcgcttccgcttcttccaggtgggcctggtgtcctggggcctgtacaacccctgcctgggcagcgctgacaagaacagcaggaagagggcccccaggagcaaggtgcccccaccccgggacttccacatcaacctcttcaggatgcagccctggctgcggcagcacctgggagatgtgctgaacttcctgcccctgtag

SEQ ID NO: 148225 - DNA, 1521 bp, Artificial Sequence
  Description of Artificial Sequence: Synthetic coding sequence
atgggcaccaggtctgccatcgccgccccccgcatcctgtgcagccggggcctgcggagcggcagcgcccgggccaccggcagcggcgtggagaggagccccagcgctgccatcttctcctttgagatcaacgtgtctgtggccatcatcacctttgccagcgagcccaaggtgctgatgtctgtgctgaatgacaacagccgggacatgacagaggtgatcagcagcctggagaatgccaactacaaggaccatgaaaatggaacaggcaccaacacctatgctgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggccgtcatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggggagagcggcggcgctgtgttcctggagcggcgcttccgcttcttccaggtgggcctggtgtcctggggcctgtacaacccctgcctgggcagcgctgacaagaacagcaggaagagggcccccaggagcaaggtgcccccaccccgggacttccacatcaacctcttcaggatgcagccctggctgcggcagcacctgggagatgtgctgaacttcctgcccctgtag

SEQ ID NO: 148226 - DNA, 1521 bp, Artificial Sequence; identical to SEQ ID NO: 148225
  Description of Artificial Sequence: Synthetic coding sequence

SEQ ID NO: 148227 - DNA, 1521 bp, Artificial Sequence; identical to SEQ ID NO: 148225
  Description of Artificial Sequence: Synthetic coding sequence

SEQ ID NO: 148228 - DNA, 1134 bp, Artificial Sequence; identical to SEQ ID NO: 148178
  Description of Artificial Sequence: Synthetic coding sequence

SEQ ID NO: 148229 - DNA, 978 bp, Artificial Sequence; identical to SEQ ID NO: 148203
  Description of Artificial Sequence: Synthetic coding sequence

SEQ ID NO: 148230 - DNA, 1521 bp, Artificial Sequence; identical to SEQ ID NO: 148225
  Description of Artificial Sequence: Synthetic coding sequence

SEQ ID NO: 148231 - DNA, 1521 bp, Artificial Sequence; identical to SEQ ID NO: 148225
  Description of Artificial Sequence: Synthetic coding sequence

SEQ ID NO: 148232 - DNA, 1617 bp, Artificial Sequence; identical to SEQ ID NO: 148224
  Description of Artificial Sequence: Synthetic coding sequence

SEQ ID NO: 148233 - DNA, 1134 bp, Artificial Sequence; identical to SEQ ID NO: 148178
  Description of Artificial Sequence: Synthetic coding sequence

SEQ ID NO: 148234 - DNA, 1863 bp, Artificial Sequence; identical to SEQ ID NO: 148212
  Description of Artificial Sequence: Synthetic coding sequence

SEQ ID NO: 148235 - DNA, 1863 bp, Artificial Sequence; identical to SEQ ID NO: 148212
  Description of Artificial Sequence: Synthetic coding sequence

SEQ ID NO: 148236 - DNA, 978 bp, Artificial Sequence; identical to SEQ ID NO: 148203
  Description of Artificial Sequence: Synthetic coding sequence

SEQ ID NO: 148237 - DNA, 978 bp, Artificial Sequence; identical to SEQ ID NO: 148203
  Description of Artificial Sequence: Synthetic coding sequence

SEQ ID NO: 148238 - DNA, 1521 bp, Artificial Sequence; identical to SEQ ID NO: 148225
  Description of Artificial Sequence: Synthetic coding sequence

SEQ ID NO: 148239 - DNA, 978 bp, Artificial Sequence; identical to SEQ ID NO: 148203
  Description of Artificial Sequence: Synthetic coding sequence

SEQ ID NO: 148240 - DNA, 1863 bp, Artificial Sequence; identical to SEQ ID NO: 148212
  Description of Artificial Sequence: Synthetic coding sequence

SEQ ID NO: 148241 - DNA, 1134 bp, Artificial Sequence; identical to SEQ ID NO: 148178
  Description of Artificial Sequence: Synthetic coding sequence

SEQ ID NO: 148242 - DNA, 1134 bp, Artificial Sequence; identical to SEQ ID NO: 148178
  Description of Artificial Sequence: Synthetic coding sequence

SEQ ID NO: 148243 - DNA, 978 bp, Artificial Sequence; identical to SEQ ID NO: 148203
  Description of Artificial Sequence: Synthetic coding sequence

SEQ ID NO: 148244 - DNA, 1134 bp, Artificial Sequence; identical to SEQ ID NO: 148178
  Description of Artificial Sequence: Synthetic coding sequence

SEQ ID NO: 148245 - DNA, 1617 bp, Artificial Sequence; identical to SEQ ID NO: 148224
  Description of Artificial Sequence: Synthetic coding sequence

SEQ ID NO: 148246 - DNA, 1863 bp, Artificial Sequence; identical to SEQ ID NO: 148212
  Description of Artificial Sequence: Synthetic coding sequence

SEQ ID NO: 148247 - DNA, 1863 bp, Artificial Sequence; identical to SEQ ID NO: 148212
  Description of Artificial Sequence: Synthetic coding sequence

SEQ ID NO: 148248 - DNA, 1863 bp, Artificial Sequence; identical to SEQ ID NO: 148212
  Description of Artificial Sequence: Synthetic coding sequence

SEQ ID NO: 148249 - DNA, 978 bp, Artificial Sequence; identical to SEQ ID NO: 148203
  Description of Artificial Sequence: Synthetic coding sequence

SEQ ID NO: 148250 - DNA, 1134 bp, Artificial Sequence; identical to SEQ ID NO: 148178
  Description of Artificial Sequence: Synthetic coding sequence

SEQ ID NO: 148251 - DNA, 1617 bp, Artificial Sequence; identical to SEQ ID NO: 148224
  Description of Artificial Sequence: Synthetic coding sequence

SEQ ID NO: 148252 - DNA, 1617 bp, Artificial Sequence; identical to SEQ ID NO: 148224
  Description of Artificial Sequence: Synthetic coding sequence

SEQ ID NO: 148253 - DNA, 4992 bp, Artificial Sequence
  Description of Artificial Sequence: Synthetic coding sequence
atgggccccaccagcggccccagcctgctgctgctgctgctgacccacctgcccctggccctgggcagccccatgtacagcatcatcacccccaacatcctgcggctggagagcgaggagaccatggtgctggaggcccatgatgcccagggagatgtgcctgtgacagtgacagtgcatgacttccctgggaagaagctggtgctgagcagcgagaagacagtgctgaccccagccaccaaccacatgggaaatgtgaccttcaccatcccagccaaccgggagttcaagtctgagaagggcaggaacaagtttgtgacagtgcaggccaccttcggcacccaggtggtggagaaggtggtgctggtgtccctgcagagcggctacctgttcatccagacagacaagaccatctacaccccaggcagcacagtgctgtaccgcatcttcaccgtgaaccacaagctgctgcctgtgggccgcacagtgatggtgaacatcgagaaccctgagggcatccctgtgaagcaggacagcctgagcagccagaaccagctgggcgtgctgcccctgtcctgggacatccctgagctggtgaacatgggccagtggaagatccgggcctactatgagaacagcccccagcaggtgttcagcacagaatttgaggtgaaggagtatgtgctgcccagctttgaggtgattgtggagcccacagagaagttctactacatctacaatgagaagggcctggaggtgaccatcacagcccgcttcctgtatggcaagaaggtggagggcacagccttcgtcatcttcggcatccaggatggagagcagaggatcagcctgcctgagagcctgaagaggatccccattgaagatggcagcggggaggtggtgctgagcaggaaggtgctgctggatggagtgcagaaccccagggctgaggacctggtgggcaagagcctgtatgtgtctgccaccgtcatcctgcacagcggcagtgacatggtgcaggccgagaggagcggcatccccatcgtgaccagcccctaccagatccacttcaccaagacccccaagtacttcaagccaggcatgccctttgacctgatggtgtttgtgaccaacccagatggcagccctgcctacagagtgcctgtggccgtgcagggcgaggacacagtgcagagcctgacccagggagatggagtggccaagctgagcatcaacacccaccccagccagaagcccctgagcatcaccgtgaggaccaagaagcaggagctgtctgaggccgagcaggccaccaggaccatgcaggccctgccctacagcacagtgggcaacagcaacaactacctgcacctgtctgtgctgaggacagagctgcggcctggagagaccctgaatgtgaacttcctgctgaggatggaccgggcccacgaggccaagatccgctactacacctacctgatcatgaacaagggccgcctgctgaaggccggccggcaggtgcgggagcccggccaggacctggtggtgctgcccctgagcatcaccacagacttcatccccagcttccggctggtggcctactacaccctcatcggggccagcggccagcgggaggtggtggccgacagcgtgtgggtggatgtgaaggacagctgtgtgggcagcctggtggtgaagagcggccagagtgaagatcggcagcctgtgcccggccagcagatgaccctgaagattgaaggagaccatggagcccgggtggtgctggtggccgtggacaagggcgtgtttgtgctgaacaagaagaacaagctgacccagagcaagatctgggatgtggtggagaaggctgacatcggctgcaccccaggcagcggcaaggactatgctggggtcttcagtgatgctggcctgaccttcaccagcagcagcggccagcagacagcccagagagctgagctgcagtgcccccagcctgctgccaggagaagaagatctgtgcagctgacagagaagaggatggacaaggtgggcaagtaccccaaggagctgaggaagtgctgtgaagatggcatgagggagaaccccatgaggttcagctgccagaggaggacccgcttcatcagcctgggggaggcctgcaagaaggtgttcctggactgctgcaactacatcacagagctgcggcggcagcacgcccgggccagccacctgggcctggcccggagcaacctggatgaggacatcatcgccgaggagaacatcgtgagccgctctgagttccctgagagctggctgtggaatgtggaggacctgaaggagccccccaagaatggcatcagcaccaagctgatgaacatcttcctgaaggacagcatcaccacctgggagatcctggccgtgtccatgtctgacaagaagggcatctgtgtggccgacccctttgaggtgacagtgatgcaggacttcttcatcgacctgcggctgccctacagcgtggtgagaaatgagcaggtggagatccgggctgtgctgtacaactaccggcagaaccaggagctgaaggtgcgggtggagctgctgcacaacccagccttctgcagcctggccaccaccaagaggaggcaccagcagacagtgaccatcccccccaagagcagcctgtctgtgccctacgtgattgtgcccctgaagacaggcctgcaggaggtggaggtgaaggctgctgtgtaccaccacttcatcagtgatggagtgaggaagagcctgaaggtggtgcctgagggcatccgcatgaacaagacagtggccgtgaggaccctggaccctgagcggctgggccgggagggcgtgcagaaggaggacatccccccagctgacctgagtgaccaggtgcctgacacagagagcgagacccgcatcctgctgcagggcacccctgtggcccagatgacagaagatgctgtggatgctgagcggctgaagcacctgattgtgacccccagcggctgtggggagcagaacatgattggcatgacccccaccgtgattgctgtgcactacctggatgaaacagagcagtgggagaagtttggcctggagaagaggcagggcgccctggagctgatcaagaagggctacacccagcagctggccttccggcagcccagcagcgcctttgctgcctttgtgaagagggcccccagcacctggctgacagcctacgtggtgaaggtgttcagcctggccgtgaacctgattgccatcgacagccaggtgctgtgtggggctgtgaagtggctgatcctggagaagcagaagccagatggagtcttccaggaggatgcccctgtgatccaccaggagatgattggaggcctgaggaacaacaatgagaaggacatggccctgacagcctttgtgctgatcagcctgcaggaggccaaggacatctgtgaggagcaggtgaacagcctgcccggcagcatcaccaaggccggggacttcctggaggccaactacatgaacctgcagaggagctacacagtggccatcgccggctacgccctggcccagatgggccgcctgaagggccccctgctgaacaagttcctgaccacagccaaggacaagaaccgctgggaggaccccgggaagcagctgtacaacgtggaggccaccagctatgccctgctggccctgctgcagctgaaggactttgattttgtgccccctgtggtgcgctggctgaatgagcagcgctactacggcggcggctacggcagcacccaggccaccttcatggtgttccaggccctggcccagtaccagaaggatgccccagaccaccaggagctgaacctggatgtgtccctgcagctgcccagccgcagcagcaagatcacccaccgcatccactgggagagcgccagcctgctgcggtctgaggagaccaaggaaaatgaaggcttcaccgtgacagctgagggcaagggccagggcaccctgtctgtggtgaccatgtaccacgccaaggccaaggaccagctgacctgcaacaagtttgacctgaaggtgaccatcaagccagcccctgagacagagaagaggccccaggatgccaagaacaccatgatcctggagatctgcacccgctacagaggagaccaggatgccaccatgagcatcctggacatctccatgatgactggatttgccccagacacagatgacctgaagcagctggccaatggagtggaccgctacatcagcaaatatgagctggacaaggccttcagtgacaggaacaccctcatcatctacctggacaaggtgagccacagtgaagatgactgcctggccttcaaggtgcaccagtacttcaacgtggagctgatccagcccggggctgtgaaggtgtatgcctactacaacctggaggagagctgcacccgcttctaccaccctgagaaggaggatggcaagctgaacaagctgtgcagagatgagctgtgccgctgtgccgaggagaactgcttcatccagaagagtgatgacaaggtgaccctggaggagcggctggacaaggcctgtgagcccggggtggactatgtgtacaagacccggctggtgaaggtgcagctgagcaatgactttgatgagtacatcatggccatcgagcagaccatcaagagcggcagtgatgaggtgcaggtgggccagcagaggaccttcatcagccccatcaagtgccgggaggccctgaagctggaggagaagaagcactacctgatgtggggcctgagcagtgacttctggggcgagaagcccaacctgagctacatcatcggcaaggacacctgggtggagcactggccagaggaggatgagtgccaggatgaggagaaccagaagcagtgccaggacctgggcgccttcacagagagcatggtggtgtttggctgccccaactag

SEQ ID NO: 148254 - DNA, 1794 bp, Artificial Sequence
  Description of Artificial Sequence: Synthetic coding sequence
atgcacccccccaagacccccagcggggccctgcacaggaagaggaagatggccgcctggcccttcagccggctgtggaaggtgtctgaccccatcctcttccagatgaccctgattgctgccctgctgcctgctgtgctgggcaactgtggccccccacccaccctgagctttgctgcccccatggacatcaccctgacagagacccgcttcaagacaggcaccaccctgaagtacacctgcctgcccggctacgtgcgcagccacagcacccagaccctgacctgcaacagtgatggagagtgggtgtacaacaccttctgcatctacaagcgctgccgccaccctggagagctgagaaatggccaggtggagatcaagacagacctgagctttggcagccagatcgagttcagctgcagcgagggcttcttcctgattggcagcaccaccagccgctgtgaggtgcaggaccggggcgtgggctggagccaccccctgccccagtgtgagatcgtgaagtgcaagcccccaccagacatcagaaatggccgccacagcggggaggagaacttctacgcctacggcttctctgtgacctacagctgtgacccccgcttcagcctgctgggccacgccagcatcagctgcaccgtggagaatgagaccatcggcgtgtggaggcccagcccccccacctgtgagaagatcacctgcaggaagccagatgtgagccacggggagatggtgtctggcttcggccccatctacaactacaaggacaccatcgtgttcaagtgccagaagggctttgtgctgcggggcagcagcgtcatccactgtgatgctgacagcaagtggaaccccagccccccagcctgtgagcccaacagctgcatcaacctgcctgacatcccccacgcctcctgggagacctacccccggcccaccaaggaggatgtgtatgtggtgggcaccgtgctgcgctaccgctgccaccctggctacaagcccaccacagatgagcccaccaccgtcatctgccagaagaacctgcgctggaccccctaccagggctgtgaggccctgtgctgcccagagcccaagctgaacaacggggagatcacccagcacaggaagagcaggcctgccaaccactgtgtgtacttctatggagatgagatctccttcagctgccacgagaccagccgcttcagcgccatctgccagggagatggcacctggagccccaggacccccagctgtggggacatctgcaacttcccccccaagatcgcccacggccactacaagcagagcagcagctacagcttcttcaaggaggagatcatctatgaatgtgacaagggctacatcctggtgggccaggccaagctgagctgcagctacagccactggagcgccccagccccccagtgcaaggccctgtgcaggaagccagagctggtgaatggccgcctgtctgtggacaaggaccagtatgtggagccagaaaatgtgaccatccagtgtgacagcggctatggagtggtgggcccccagagcatcacctgcagcggcaacagaacctggtacccagaggtgcccaagtgtgagtgggagaccccagagggctgtgagcaggtgctgaccgggaagaggctgatgcagtgcctgcccaacccagaagatgtgaagatggccctggaggtgtacaagctgagcctggagattgagcagctggagctgcagagggacagcgcccggcagagcaccctggacaaggagctgtag

SEQ ID NO: 148255 - DNA, 459 bp, Artificial Sequence
  Description of Artificial Sequence: Synthetic coding sequence
atgcacccccccaagacccccagcggggccctgcacaggaagaggaagatggccgcctggcccttcagccggctgtggaaggtgtctgaccccatcctcttccagatgaccctgattgctgccctgctgcctgctgtgctgggcaactgtggccccccacccaccctgagctttgctgcccccatggacatcaccctgacagagacccgcttcaagacaggcaccaccctgaagtacacctgcctgcccggctacgtgcgcagccacagcacccagaccctgacctgcaacagtgatggagagtgggtgtacaacaccttctgcatctacaagcgctgccgccaccctggagagctgagaaatggccaggtggagatcaagacagacctgagctttggcagccagatcgagttcagctgcagcgagggcttcttcctgattggcagcaccaccagctag

SEQ ID NO: 148256 - DNA, 759 bp, Artificial Sequence
  Description of Artificial Sequence: Synthetic coding sequence
atgttcttctggtgtgcctgctgcctgatggtggcctggagggtgtctgccagtgatgctgagcactgcccagagctgccccctgtggacaacagcatctttgtggccaaggaggtggagggccagatcctgggcacctacgtgtgcatcaagggctaccacctggtgggcaagaagaccctcttctgcaatgccagcaaggagtgggacaacaccaccacagaatgtcggctgggccactgcccagaccctgtgctggtgaatggagagttcagcagcagcggccctgtgaatgtgtctgacaagatcaccttcatgtgcaatgaccactacatcctgaagggcagcaacagaagccagtgcctggaggaccacacctgggccccacccttccccatctgcaagagccgggactgtgaccccccaggcaaccctgtgcacggctactttgagggcaacaacttcaccctgggcagcaccatctcctactactgtgaggaccgctactacctggtgggcgtgcaggagcagcagtgtgtggatggagagtggagcagcgccctgcctgtgtgcaagctgatccaggaggcccccaagccagaatgtgagaaggccctgctggccttccaggagagcaagaacctgtgtgaggccatggagaacttcatgcagcagctgaaggagagcggcatgaccatggaggagctgaagtacagcctggagctgaagaaggccgagctgaaggccaagctgctgtag

SEQ ID NO: 148257 - DNA, 756 bp, Artificial Sequence
  Description of Artificial Sequence: Synthetic coding sequence
atgttcttctggtgtgcctgctgcctgatggtggcctggagggtgtctgccagtgatgagcactgcccagagctgccccctgtggacaacagcatctttgtggccaaggaggtggagggccagatcctgggcacctacgtgtgcatcaagggctaccacctggtgggcaagaagaccctcttctgcaatgccagcaaggagtgggacaacaccaccacagagtgccgcctgggccactgcccagaccctgtgctggtgaatggagagttcagcagcagcggccctgtgaatgtgtctgacaagatcaccttcatgtgcaatgaccactacatcctgaagggcagcaacagaagccagtgcctggaggaccacacctgggccccacccttccccatctgcaagagccgggactgtgaccccccaggcaaccctgtgcacggctactttgagggcaacaacttcaccctgggcagcaccatctcctactactgtgaagatcgctactacctggtgggcgtgcaggagcagcagtgtgtggatggagagtggagcagcgccctgcctgtgtgcaagctgatccaggaggcccccaagccagaatgtgagaaggccctgctggccttccaggagagcaagaacctgtgtgaggccatggagaacttcatgcagcagctgaaggagagcggcatgaccatggaggagctgaagtacagcctggagctgaagaaggccgagctgaaggccaagctgctgtag

SEQ ID NO: 148258 - DNA, 759 bp, Artificial Sequence; identical to SEQ ID NO: 148256
  Description of Artificial Sequence: Synthetic coding sequence

SEQ ID NO: 148259 - DNA, 759 bp, Artificial Sequence; identical to SEQ ID NO: 148256
  Description of Artificial Sequence: Synthetic coding sequence

SEQ ID NO: 148260 - DNA, 657 bp, Artificial Sequence
  Description of Artificial Sequence: Synthetic coding sequence
atggtggcctggagggtgtctgccagtgatgagcactgcccagagctgccccctgtggacaacagcatctttgtggccaaggaggtggagggccagatcctgggcacctacgtgtgcatcaagggctaccacctggtgggcaagaagaccctcttctgcaatgccagcaaggagtgggacaacaccaccacagaatgtcggctgggccactgcccagaccctgtgctggtgaatggagagttcagcagcagcggccctgtgaatgtgtctgacaagatcaccttcatgtgcaatgaccactacatcctgaagggcagcaacagaagccagtgcctggaggaccacacctgggccccacccttccccatctgcaagagcatcccccagacccggcccctgcccttccagccctgcagccccctcttcctgttcctgctgcggcagagcctggccctcttcccccggctggagtgcagcggccgcatcctggcccactgcaacctgcacctgcccggcagcagcagcagccacgccagcgccagccaggtggccggcatcactggagcccacccccgctgggccaacttctgcatcttcagccgggactgggtgagcccctgctggccaggctggagccagatcccagacctgaggtag

SEQ ID NO: 148261 - DNA, 546 bp, Artificial Sequence
  Description of Artificial Sequence: Synthetic coding sequence
atgttcttctggtgtgcctgctgcctgatggtggcctggagggtgtctgccagtgatgctgagcactgcccagagctgccccctgtggacaacagcatctttgtggccaaggaggtggagggccagatcctgggcacctacgtgtgcatcaagggctaccacctggtgggcaagaagaccctcttctgcaatgccagcaaggagtgggacaacaccaccacagaatgtcggctgggccactgcccagaccctgtgctggtgaatggagagttcagcagcagcggccctgtgaatgtgtctgacaagatcaccttcatgtgcaatgaccactacatcctgaagggcagcaacagaagccagtgcctggaggaccacacctgggccccacccttccccatctgcaagagccgggactgtgaccccccaggcaaccctgtgcacggctactttgagggcaacaacttcaccctgggcagcaccatctcctactactgtgaggaccgctactacctggtgggcgtgcaggagcagcagtgtgtggactag

SEQ ID NO: 148262 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgagtggccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148263 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148264 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148265 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccagcgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148266 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccagcgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148267 - DNA, 813 bp, Artificial Sequence
  Description of Artificial Sequence: Synthetic coding sequence
atgtgcccagaggacagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctgggggctag

SEQ ID NO: 148268 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgagtggccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148269 - DNA, 1536 bp, Artificial Sequence
  Description of Artificial Sequence: Synthetic coding sequence
atggccaagggcctgtctgtgcagaatgacaagcaccctggctaccagcctgccctgctgctgagccctggggcccccctgtttgctgatggccctgcctatgccctgctgcacctgctgctgcacgagggcaaggccgagatggctgaccaggccgccgcctggctgacccggcagggcagcttccagggcggcttccgcagcacccaggacaccgtcatcgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaagattatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgaccgctacgtgagccactttgaaacagagggcccccacgtgctgctgtactttgattctgtgcccaccagcagagaatgtgtgggctttgaagctgtgcaggaggtgcctgtgggcctggtgcagcctgccagcgccaccctgtatgactactacaaccctgagcggcgctgcagcgtcttctatggagcccccagcaagagccggctgctggccaccctgtgcagcgctgaggtgtgccagtgtgccgagggcaaatgtccccggcagaggcgggccctggagcggggcctgcaggatgaagatggctacaggatgaagtttgcctgctactacccccgggtggagtatggcttccaggtgaaggtgctgcgggaggacagcagagctgccttccggctgtttgagaccaagatcacccaggtgctgcacttcaccaaggatgtgaaggctgctgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148270 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148271 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccgggacagcagcacctggctgacagcctttgtgctgaaggtgctgagcctggcccaggagcaggtgggcggcagccctgagaagctgcaggagaccagcaactggctgctgagccagcagcaggctgatggcagcttccaggacccctgccctgtgctggaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggcccctgtggacctgctgggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148272 - DNA, 1536 bp, Artificial Sequence; identical to SEQ ID NO: 148269
  Description of Artificial Sequence: Synthetic coding sequence

SEQ ID NO: 148273 - DNA, 813 bp, Artificial Sequence
  Description of Artificial Sequence: Synthetic coding sequence
atgtgcccagaggacagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagtacccaggcggctag

SEQ ID NO: 148274 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgccacagctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148275 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgccacagctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148276 - DNA, 5235 bp, Artificial Sequence; identical to SEQ ID NO: 148274
  Description of Artificial Sequence: Synthetic coding sequence

SEQ ID NO: 148277 - DNA, 5235 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148278 - DNA, 807 bp, Artificial Sequence
  Description of Artificial Sequence: Synthetic coding sequence
atgtgcccagaggacagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagcccctag

SEQ ID NO: 148279 - DNA, 5097 bp, Artificial Sequence
  Description of Artificial Sequence: Synthetic coding sequence
atgaggctgctgtggggcctcatctgggccagcagcttcttcaccctgagcctgcagaagccccggctgctgctcttcagccccagcgtggtgcacctgggcgtgcccctgtctgtgggcgtgcagctgcaggatgtgccccggggccaggtggtgaagggctctgtgttcctgaggaaccccagcagaaataatgtgccctgcagccccaaggtggacttcaccctgagcagcgagcgggactttgccctgctgagcctgcaggtgcccctgaaggatgccaagagctgtggcctgcaccagctgctgcggggccctgaggtgcagctggtggcccacagcccctggctgaaggacagcctgagcaggaccaccaacatccagggcatcaacctgctcttcagcagcagaagaggccacctgttcctgcagacagaccagcccatctacaaccctggccagagggtgcgctacagagtgtttgccctggaccagaagatgaggcccagcacagacaccatcaccgtgatggtggagaacagccacggcctgcgggtgaggaagaaggaggtgtacatgcccagcagcatcttccaggatgactttgtgatcccagacatcagcgagcccggcacctggaagatcagcgcccgcttcagtgatggcctggagagcaacagcagcacccagtttgaggtgaagaagtatgtgctgcccaactttgaggtgaagatcaccccaggcaagccctacatcctgactgtgcccggccacctggatgagatgcagctggacatccaggcccgctacatctacggcaagcctgtgcagggcgtggcctacgtgcgcttcggcctgctggatgaagatggcaagaagaccttcttccggggcctggagagccagaccaagctggtgaatggccagagccacatcagcctgagcaaggccgagttccaggatgccctggagaagctgaacatgggcatcacagacctgcagggcctgcggctgtatgtggccgccgccatcatcgagagccctggaggagagatggaggaggccgagctgacctcctggtactttgtgagcagccccttcagcctggacctgagcaagaccaagaggcacctggtgcctggggcccccttcctgctgcaggccctggtgcgggagatgagcggcagccctgccagcggcatccctgtgaaggtgtctgccaccgtgagcagccctggctctgtgcctgaggtgcaggacatccagcagaacacagatggcagcggccaggtgtccatccccatcatcatcccccagaccatcagcgagctgcagctgtctgtgtctgctggcagcccccacccagccatcgcccggctgactgtggccgcccctccttctgggggccctggcttcctgagcattgaaagaccagacagccggcccccccgggtgggggacaccctgaacctgaacctgcgggctgtgggcagcggggccaccttcagccactactactacatgatcctgagccggggccagatcgtgttcatgaaccgggagcccaagaggaccctgacctctgtgtctgtgtttgtggaccaccacctggcccccagcttctactttgtggccttctactaccatggagaccaccctgtggccaacagcctgcgggtggatgtgcaggccggggcctgtgagggcaagctggagctgtctgtggatggagccaagcagtacagaaatggagagagcgtgaagctgcacctggagacagacagcctggccctggtggccctgggcgccctggacacagccctgtatgctgctggcagcaagagccacaagcccctgaacatgggcaaggtgtttgaggccatgaacagctatgacctgggctgcggccctgggggcggggacagcgccctgcaggtgttccaggccgccggcctggccttcagtgatggagaccagtggaccctgagcaggaagaggctgagctgccccaaggagaagaccaccaggaagaagagaaatgtgaacttccagaaggccatcaatgagaagctgggccagtatgccagccccacagccaagcgctgctgccaggatggagtgacccggctgcccatgatgaggagctgtgagcagagagctgcccgggtgcagcagcctgactgccgggagcccttcctgagctgctgccagtttgctgagagcctgaggaagaagagccgggacaagggccaggccggcctgcagagggccctggagatcctgcaggaggaggacctgattgatgaagatgacatccctgtgcgctccttcttccctgagaactggctgtggagggtggagaccgtggaccgcttccagatcctgaccctgtggctgcctgacagcctgaccacctgggagatccacggcctgagcctgagcaagaccaagggcctgtgtgtggccacccctgtgcagctgcgggtcttccgggagttccacctgcacctgcggctgcccatgtctgtgagaagatttgagcagctggagctgcggcctgtgctgtacaactacctggacaagaacctgactgtgtctgtgcacgtgtcccctgtggagggcctgtgcctggccggcggcggcggcctggcccagcaggtgctggtgcctgctggcagcgcccggcctgtggccttctctgtggtgcccacagctgctgctgctgtgtccctgaaggtggtggcccggggcagctttgagttccctgtgggagatgctgtgtccaaggtgctgcagatcgagaaggagggcgccatccaccgggaggagctggtgtatgagctgaaccccctggaccaccggggccgcaccctggagatccctggcaacagcgaccccaacatgatcccagatggagacttcaacagctatgtgcgggtgacagccagtgaccccctggacaccctgggcagcgagggcgccctgagccctggaggagtggccagcctgctgcggctgccccggggctgtggggagcagaccatgatctacctggcccccaccctggccgccagccgctacctggacaagacagagcagtggagcaccctgcccccagagaccaaggaccatgctgtggacctgatccagaagggctacatgaggatccagcagttcaggaaggcagatggcagctatgctgcctggctgagccggggcagcagcacctggctgacagcctttgtgctgaaggtgctgagcctggcccaggagcaggtgggcggcagccctgagaagctgcaggagaccagcaactggctgctgagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccaacagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148280 - DNA, 813 bp, Artificial Sequence; identical to SEQ ID NO: 148267
  Description of Artificial Sequence: Synthetic coding sequence

SEQ ID NO: 148281 - DNA, 5097 bp, Artificial Sequence; identical to SEQ ID NO: 148275
  Description of Artificial Sequence: Synthetic coding sequence

SEQ ID NO: 148282 - DNA, 1536 bp, Artificial Sequence; identical to SEQ ID NO: 148269
  Description of Artificial Sequence: Synthetic coding sequence

SEQ ID NO: 148283 - DNA, 1953 bp, Artificial Sequence
  Description of Artificial Sequence: Synthetic coding sequence
atgggcagccagtgccggggctggcacatgtgtgccctgggcagccagcagcaggctgatggcagcttccaggacctgagccctgtgatccaccgctccatgcagggcggcctggtgggcaatgatgagaccgtggccctgacagcctttgtgaccatcgccctgcaccacggcctggccgtgttccaggatgagggcgctgagcccctgaagcagagggtggaggccagcatcagcaaggccagcagcttcctgggggagaaggccagcgctggcctgctgggcgcccacgccgccgccatcacagcctatgccctgaccctgaccaaggccccagctgacctgcggggcgtggcccacaacaacctgatggccatggcccaggagaccggggacaacctgtactggggctctgtgacaggcagccagagcaatgctgtgagccccaccccagcccccaggaaccccagcgaccccatgccccaggccccagccctgtggattgagaccacagcctatgccctgctgcacctgctgctgcacgagggcaaggccgagatggctgaccaggccgccgcctggctgacccggcagggcagcttccagggcggcttccgcagcacccaggacacagtgattgccctggatgccctgagcgcctactggatcgccagccacaccacagaggagcggggcctgaatgtgaccctgagcagcactggaagaaatggcttcaagagccacgccctgcagctgaacaaccggcagatccggggcctggaggaggagctgcagttcagcctgggcagcaagatcaacgtgaaggtgggcggcaacagcaagggcaccctgaaggtgctgcggacctacaacgtgctggacatgaagaacaccacctgccaggacctgcagatcgaggtgacagtgaagggccacgtggagtacaccatggaggccaatgaagattatgaggactatgaatatgatgagctgcctgccaaggatgatcctgatgcccccctgcagcctgtgacccccctgcagctgtttgagggcagaagaaacagaagaagaagagaggcccccaaggtggtggaggagcaggagagccgggtgcactacacagtgtgcatctggagaaatggcaaggtgggcctgagcggcatggccatcgcagatgtgaccctgctgagcggcttccacgccctgcgggctgacctggagaagctgaccagcctgagtgacagatatgtgagccactttgaaacagagggcccccacgtgctgctgtactttgacagcgtgcccaccagccgggagtgtgtgggctttgaggccgtgcaggaggtgcctgtgggcctggtgcagcctgccagcgccaccctgtatgactactacaaccctgagcggcgctgcagcgtcttctacggggcccccagcaagagccggctgctggccaccctgtgcagcgctgaggtgtgccagtgtgccgagggcaagtgcccccggcagaggcgggccctggagcggggcctgcaggatgaagatggctacaggatgaagtttgcctgctactacccccgggtggagtatggcttccaggtgaaggtgctgcgggaggacagccgggccgccttccggctgtttgagaccaagatcacccaggtgctgcacttcaccaaggatgtgaaggccgccgccaaccagatgaggaacttcctggtgcgggccagctgccgcctgcggctggagcccgggaaggagtacctgatcatgggcctggatggagccacctatgacctggagggccacccccagtacctgctggacagcaacagctggattgaggagatgcccagcgagcggctgtgccgcagcacccggcagagagctgcctgtgcccagctgaatgacttcctgcaggagtatggcacccagggctgccaggtgtag

SEQ ID NO: 148284 - DNA, 291 bp, Artificial Sequence
  Description of Artificial Sequence: Synthetic coding sequence
atgcctggccccaccccatctggcaccaacgtgggcagcagcggccgcagccccagcaaggctgtggccgcccgggctgctggcagcacagtgcggcagaggaagaatgccagctgtggcaccaggtctgctggccgcaccaccagcgctggcaccggcggcatgtggaggttctacacagaggacagccctggcctgaaggtgggccctgtgcctgtgctggtgatgagcctgctcttcatcgcctctgtgttcatgctgcacatctggggcaagtacaccaggagctag

SEQ ID NO: 148285 - DNA, 3318 bp, Artificial Sequence
  Description of Artificial Sequence: Synthetic coding sequence
ggccgggccggggaggtgcgggccctgagcagcggggcccagaggcggggcagccactttgtggtgctgtgccgcctgccccggggccgggcccgggtggtgggcgccagcctgagccacgcccccctgcccctgcgctactgctggaagggccggggcggcgtgtcccggctcttctgcagccagagggccaggatgcctggcagcctgggccgggaggccagcggccgggccggccccaccggctgtggggcctttgccttcggcctgcgctgccgctacgtgatcagcgcccccaagatcttccgggtgggcgccagcgagaacatcgtcatccaggtgtatggctacacagaggcctttgatgccaccatcagcatcaagagctacccagacaagaagttctcctacagcagcggccacgtgcacctgagcagcgagaacaagttccagaacagcgccatcctgaccatccagcccaagcagctgcccggcggccagaaccctgtgtcctatgtgtacctggaggtggtgtccaagcacttcagcaagagcaagaggatgcccatcacctatgacaatggcttcctgttcatccacacagacaagcctgtgtacaccccagaccagagcgtgaaggtgcgggtgtacagcctgaatgatgacctgaagccagccaagcgggagaccgtgctgaccttcattgatcctgagggcagcgaggtggacatggtggaggagattgaccacatcggcatcatctccttcccagacttcaagatccccagcaaccccaggtatggcatgtggaccatcaaggccaagtacaaggaggacttcagcaccactggaacagcctactttgaggtgaaggagtatgtgctgccccacttctctgtgtccattgagcctgagtacaacttcatcggctacaagaacttcaagaactttgagatcaccatcaaggcccgctacttctacaacaaggtggtgacagaagcagatgtgtacatcaccttcggcatccgggaggacctgaaggatgaccagaaggagatgatgcagacagccatgcagaacaccatgctgatcaatggaattgcccaggtgacctttgacagcgagacagctgtgaaggagctgagctactacagcctggaggacctgaacaacaagtacctgtacatcgctgtgacagtgattgagagcactggaggcttcagcgaggaggccgagatccctggcatcaagtatgtgctgagcccctacaagctgaacctggtggccacccccctcttcctgaagccaggcatcccctaccccatcaaggtgcaggtgaaggacagcctggaccagctggtgggcggcgtgcctgtgaccctgaatgcccagaccattgatgtgaaccaggagaccagtgacctggaccccagcaagtctgtgaccagggtggatgatggagtggccagctttgtgctgaacctgcccagcggcgtgacagtgctggagttcaacgtgaagacagatgccccagacctgcctgaggagaaccaggcccgggagggctaccgggccatcgcctacagcagcctgagccagagctacctgtacatcgactggacagacaaccacaaggccctgctggtgggggagcacctgaacatcatcgtgacccccaagagcccctacatcgacaagatcacccactacaactacctgatcctgagcaagggcaagatcatccacttcggcacccgggagaagttcagtgatgccagctaccagagcatcaacatccctgtgacccagaacatggtgcccagcagccggctgctggtgtactacatcgtgactggagagcagacagctgagctggtgtctgattctgtgtggctgaacatcgaggagaagtgtggcaaccagctgcaggtgcacctgagcccagatgctgatgcctacagccctggccagacagtgtccctgaacatggccaccggcatggacagctgggtggccctggccgctgtggacagcgctgtgtatggagtgcagagaggagccaagaagcccctggagagggtcttccagttcctggagaagagtgacctgggctgtggggccggcggcggcctgaacaatgccaacgtgttccacctggccggcctgaccttcctgaccaatgccaatgctgatgacagccaggagaatgatgagccctgcaaggagatcctgcggcccaggaggaccctgcagaagaagattgaggagattgctgccaagtacaagcacagcgtggtgaagaagtgctgctatgatggagcctgtgtgaacaatgatgagacctgtgagcagagagctgcccgcatcagcctgggcccccgctgcatcaaggccttcacagagtgctgcgtggtggccagccagctgcgggccaacatcagccacaaggacatgcagctgggccgcctgcacatgaagaccctgctgcctgtgtccaagccagagatccgcagctacttccctgagagctggctgtgggaggtgcacctggtgcccaggaggaagcagctgcagtttgccctgcctgacagcctgaccacctgggagatccagggcgtgggcatcagcaacacaggcatctgtgtggccgacacagtgaaggccaaggtgttcaaggatgtgttcctggagatgaacatcccctacagcgtggtgcggggggagcagatccagctgaagggcaccgtgtacaactaccgcaccagcggcatgcagttctgtgtgaagatgtctgctgtggagggcatctgcaccagcgagagccctgtgattgaccaccagggcaccaagagcagcaaatgtgtgcggcagaaggtggagggcagcagcagccacctggtgaccttcaccgtgctgcccctggagatcggcctgcacaacatcaacttcagcctggagacctggtttgggaaggagatcctggtgaagaccctgcgggtggtgcctgagggcgtgaagcgggagagctacagcggcgtgaccctggacccccggggcatctacggcaccatcagcaggaggaaggagttcccctaccgcatccccctggacctggtgcccaagacagagatcaagaggatcctgtctgtgaagggcctgctggtgggggagatcctgtctgctgtgctgagccaggagggcatcaacatcctgacccacctgcccaagggcagcgctgaggccgagctgatgtctgtggtgcctgtgttctacgtgtttcctggcaacaggaagagcctggagcacttctccttctag

SEQ ID NO: 148286 - DNA, 2805 bp, Artificial Sequence
  Description of Artificial Sequence: Synthetic coding sequence
atggccaggagatctgtgctgtacttcatcctgctgaatgccctgatcaacaagggccaggcctgcttctgtgaccactacgcctggacccagtggaccagctgcagcaagacctgcaacagcggcacccagagccgccaccggcagatcgtggtggacaagtactaccaggagaacttctgtgagcagatctgcagcaagcaggagacccgggagtgcaactggcagcgctgccccatcaactgcctgctgggggactttggcccctggagcgactgtgacccctgcatcgagaagcagagcaaggtgcgctctgtgctgcggcccagccagtttggaggccagccctgcacagcccccctggtggccttccagccctgcatccccagcaagctgtgcaagattgaggaggccgactgcaagaacaagttccgctgtgacagcggccgctgcatcgccaggaagctggagtgcaatggagaaaatgactgtggggacaacagtgatgagcgggactgtggccgcaccaaggctgtgtgcaccaggaagtacaaccccatccccagcgtgcagctgatgggaaatggcttccacttcctggccggggagcccagaggagaggtgctggacaacagcttcaccggcggcatctgcaagacagtgaagagcagcaggaccagcaacccctacagagtgcctgccaacctggagaatgtgggctttgaggtgcagacagcagaagatgacctgaagacagacttctacaaggacctgaccagcctgggccacaatgaaaaccagcagggcagcttcagcagccagggcggcagcagcttctctgtgcccatcttctacagcagcaagagaagtgagaacatcaaccacaacagcgccttcaagcaggccatccaggccagccacaagaaggacagcagcttcatccgcatccacaaggtgatgaaggtgctgaacttcaccaccaaggccaaggacctgcacctgagtgatgtgttcctgaaggccctgaaccacctgcccctggagtacaacagcgccctgtacagccgcatctttgatgactttggcacccactacttcaccagcggcagcctgggcggcgtgtatgacctgctgtaccagttcagcagcgaggagctgaagaacagcggcctgacagaggaggaggccaagcactgtgtgcgcatcgagaccaagaagagggtgctgtttgccaagaagaccaaggtggagcaccgctgcaccaccaacaagctgtctgagaagcatgagggcagcttcatccagggcgctgagaagagcatcagcctcatccggggcggccgctcagaatatggagctgccctggcctgggagaagggcagcagcggcctggaggagaagaccttcagcgagtggctggagagcgtgaaggagaacccagctgtgattgactttgagctggcccccatcgtggacctggtgaggaacatcccctgtgctgtgaccaagaggaacaacctgaggaaggccctgcaggagtatgctgccaagtttgacccctgccagtgtgccccctgccccaacaacggccggcccaccctgtctggaacagagtgcctgtgtgtgtgccagagcggcacctacggggagaactgtgagaagcagagcccagactacaagagcaatgctgtggatggccagtggggctgctggagctcctggagcacctgtgatgccacctacaagaggagcaggacccgggagtgcaacaacccagccccccagagaggaggcaagagatgtgagggggagaagaggcaggaggaggactgcaccttcagcatcatggagaacaacggccagccctgcatcaatgatgatgaggagatgaaggaggtggacctgcctgagattgaggccgacagcggctgcccccagcctgtgcccccagaaaatggcttcatcagaaatgagaagcagctgtacctggtgggggaggatgtggagatcagctgcctgaccggctttgagaccgtgggctaccagtacttccgctgcctgcctgatggcacctggaggcagggagatgtggagtgccagaggacagagtgcatcaagcctgtggtgcaggaggtgctgaccatcacccccttccagaggctgtaccgcatcggggagagcattgagctgacctgccccaagggctttgtggtggccggccccagccgctacacctgccagggcaacagctggaccccacccatcagcaacagcctgacctgtgagaaggacaccctgaccaagctgaagggccactgccagctgggccagaagcagagcggcagcgagtgcatctgcatgagccctgaggaggactgcagccaccacagcgaggacctgtgtgtgtttgacacagacagcaatgactacttcaccagccctgcctgcaagttcctggccgagaagtgcctgaacaaccagcagctgcacttcctgcacatcggcagctgccaggacggccggcagctggagtggggcctggagaggacccggctgagcagcaacagcaccaagaaggagagctgtggctatgacacctgctatgactgggagaagtgcagcgccagcaccagcaaatgtgtgtgcctgctgcccccccagtgcttcaagggcggcaaccagctgtactgtgtgaagatgggcagcagcaccagcgagaagaccctgaacatctgtgaggtgggcaccatccgctgtgccaacaggaagatggagatcctgcaccctgggaagtgcctggcctag

SEQ ID NO: 148287 - DNA, 2805 bp, Artificial Sequence; identical to SEQ ID NO: 148286
  Description of Artificial Sequence: Synthetic coding sequence

SEQ ID NO: 148288 - DNA, 2532 bp, Artificial Sequence
  Description of Artificial Sequence: Synthetic coding sequence
atgaaggtgatcagcctcttcatcctggtgggcttcatcggggagttccagagcttcagcagcgccagcagccctgtgaactgccagtgggacttctacgccccctggagcgagtgcaatggctgcaccaagacccagaccaggagaagatctgtggccgtgtatggccagtatggaggccagccctgtgtgggcaatgcctttgagacccagagctgtgagcccacccggggctgccccacagaggagggctgtggggagcgcttccgctgcttcagcggccagtgcatcagcaagagcctggtgtgcaatggagacagcgactgtgatgaagattctgcagatgaggacagatgtgaggacagcgagcggcggcccagctgtgacatcgacaagcccccacccaacatcgagctgactggaaatggctacaatgagctgaccggccagttcaggaacagagtcatcaacaccaagagctttggaggccagtgcaggaaggtgttttctggagatggcaaggacttctaccgcctgtctggaaatgtgctgagctacaccttccaggtgaagatcaacaatgacttcaactatgagttctacaacagcacctggagctatgtgaagcacaccagcacagagcacaccagcagcagcaggaagaggagcttcttccgcagcagcagcagcagcagccgcagctacaccagccacaccaatgagatccacaagggcaagagctaccagctgctggtggtggagaacacagtggaggtggcccagttcatcaacaacaaccctgagttcctgcagctggccgagcccttctggaaggagctgagccacctgcccagcctgtatgactacagcgcctacagaaggctgattgaccagtatggcacccactacctgcagagcggcagcctgggcggggagtacagagtgctcttctacgtggacagcgagaagctgaagcagaatgacttcaacagcgtggaggagaagaagtgcaagagcagcggctggcactttgtggtgaagttcagcagccacggctgcaaggagctggagaatgccctgaaggccgccagcggcacccagaacaacgtgctgcggggggagcccttcatccggggcggcggggccggcttcatcagcggcctgagctacctggagctggacaacccagctggcaacaagaggcgctacagcgcctgggccgagagcgtgaccaacctgccccaggtgatcaagcagaagctgacccccctgtatgagctggtgaaggaggtgccctgtgcctctgtgaagaagctgtacctgaagtgggccctggaggagtacctggatgaatttgacccctgccactgccggccctgccagaatggaggcctggccaccgtggagggcacccactgcctgtgccactgcaagccctacaccttcggggccgcctgtgagcagggcgtgctggtgggcaaccaggccggcggcgtggatggcggctggagctgctggagctcctggagcccctgtgtgcagggcaagaagaccaggagccgggagtgcaacaaccccccaccttctgggggcggccgcagctgtgtgggggagaccacagagagcacccagtgtgaagatgaggagctggagcacctgcggctgctggagccccactgcttccccctgagcctggtgcccacagagttctgccccagccccccagccctgaaggatggctttgtgcaggatgagggcaccatgtttcctgtgggcaagaatgtggtgtacacctgcaatgaaggctacagcctcatcggcaaccctgtggcccgctgtggggaggacctgcgctggctggtgggggagatgcactgccagaagatcgcctgtgtgctgcctgtgctgatggatggcatccagagccacccccagaagcccttctacacagtgggggagaaggtgacagtgtcctgcagcggcggcatgagcctggagggccccagcgccttcctgtgtggcagcagcctgaagtggagccctgagatgaagaatgcccgctgtgtgcagaaggagaaccccctgacccaggccgtgcccaagtgccagcgctgggagaagctgcagaacagccgctgtgtgtgcaagatgccctatgaatgtggccccagcctggatgtgtgtgcccaggatgagaggagcaagaggatcctgcccctgactgtgtgcaagatgcacgtgctgcactgccagggcaggaactacaccctgaccggccgggacagctgcaccctgcctgccagcgctgagaaggcctgtggggcctgccccctgtggggcaaatgtgatgctgagagcagcaaatgtgtgtgccgggaggcctctgaatgtgaggaggagggcttcagcatctgtgtggaggtgaatggcaaggagcagaccatgtctgaatgtgaggccggggccctgcgctgccggggccagagcatctctgtgaccagcatccggccctgtgccgctgagacccagtag

SEQ ID NO: 148289 - DNA, 1461 bp, Artificial Sequence
  Description of Artificial Sequence: Synthetic coding sequence
atgaaggtgatcagcctcttcatcctggtgggcttcatcggggagttccagagcttcagcagcgccagcagccctgtgaactgccagtgggacttctacgccccctggagcgagtgcaatggctgcaccaagacccagaccaggagaagatctgtggccgtgtatggccagtatggaggccagccctgtgtgggcaatgcctttgagacccagagctgtgagcccacccggggctgccccacagaggagggctgtggggagcgcttccgctgcttcagcggccagtgcatcagcaagagcctggtgtgcaatggagacagcgactgtgatgaagattctgcagatgaggacagatgtgaggacagcgagcggcggcccagctgtgacatcgacaagcccccacccaacatcgagctgactggaaatggctacaatgagctgaccggccagttcaggaacagagtgctcttctacgtggacagcgagaagctgaagcagaatgacttcaacagcgtggaggagaagaagtgcaagagcagcggctggcactttgtggtgaagttcagcagccacggctgcaaggagctggagaatgccctgaaggccgccagcggcacccagaacaacgtgctgcggggggagcccttcatccggggcggcggggccggcttcatcagcggcctgagctacctggagctggacaacccagctggcaacaagaggcgctacagcgcctgggccgagagcgtgaccaacctgccccaggtgatcaagcagaagctgacccccctgtatgagctggtgaaggaggtgccctgtgcctctgtgaagaagctgtacctgaagtgggccctggaggagtacctggatgaatttgacccctgccactgccggccctgccagaatggaggcctggccaccgtggagggcacccactgcctgtgccactgcaagccctacaccttcggggccgcctgtgagcagggcgtgctggtgggcaaccaggccggcggcgtggatggcggctggagctgctggagctcctggagcccctgtgtgcagggcaagaagaccaggagccgggagtgcaacaaccccccaccttctgggggcggccgcagctgtgtgggggagaccacagagagcacccagtgtgaagatgaggagctggagcacctgcggctgctggagccccactgcttccccctgagcctggtgcccacagagttctgccccagccccccagccctgaaggatggctttgtgcaggatgagggcaccatgtttcctgtgggcaagaatgtggtgtacacctgcaatgaaggctacagcctcatcggcaaccctgtggcccgctgtggggaggacctgcgctggctggtgggggagatgcactgccagaatggcaagatcagcaactggatgaaggtgaatgagaccctgctggtggagcaccactag

SEQ ID NO: 148290 - DNA, 1032 bp, Artificial Sequence
  Description of Artificial Sequence: Synthetic coding sequence
atgaaggtgatcagcctcttcatcctggtgggcttcatcggggagttccagagcttcagcagcgccagcagccctgtgaactgccagtgggacttctacgccccctggagcgagtgcaatggctgcaccaagacccagaccaggagaagatctgtggccgtgtatggccagtatggaggccagccctgtgtgggcaatgcctttgagacccagagctgtgagcccacccggggctgccccacagaggagggctgtggggagcgcttccgctgcttcagcggccagtgcatcagcaagagcctggtgtgcaatggagacagcgactgtgatgaagattctgcagatgaggacagatgtgaggacagcgagcggcggcccagctgtgacatcgacaagcccccacccaacatcgagctgactggaaatggctacaatgagctgaccggccagttcaggaacagagtcatcaacaccaagagctttggaggccagtgcaggaaggtgttttctggagatggcaaggacttctaccgcctgtctggaaatgtgctgagctacaccttccaggtgaagatcaacaatgacttcaactatgagttctacaacagcacctggagctatgtgaagcacaccagcacagagcacaccagcagcagcaggaagaggagcttcttccgcagcagcagcagcagcagccgcagctacaccagccacaccaatgagatccacaagggcaagagctaccagctgctggtggtggagaacacagtggaggtggcccagttcatcaacaacaaccctgagttcctgcagctggccgagcccttctggaaggagctgagccacctgcccagcctgtatgactacagcgcctacagaaggctgattgaccagtatggcacccactacctgcagagcggcagcctgggcggggagtacagagtgctcttctacgtggacagcgagaagctgaagcagaatgacttcaacagcgtggagaagaagaagaagaagaagaagaagaagaagtag

SEQ ID NO: 148291 - DNA, 1755 bp, Artificial Sequence
  Description of Artificial Sequence: Synthetic coding sequence
atgtttgctgtggtgttcttcatcctgagcctgatgacctgccagcccggggtgacagcccaggagaaggtgaaccagagggtgagaagagctgccaccccagctgctgtgacctgccagctgagcaactggagcgagtggacagactgcttcccctgccaggacaagaagtaccgccacaggagcctgctgcagcccaacaagtttggaggcaccatctgcagcggggacatctgggaccaggccagctgcagcagcagcaccacctgtgtgcggcaggcccagtgtggccaggacttccagtgcaaggagaccggccgctgcctgaagaggcacctggtgtgcaatggagaccaggactgcctggatggcagtgatgaagatgactgtgaagatgtgcgggccattgatgaggactgcagccagtatgagcccatccctggcagccagaaggccgccctgggctacaacatcctgacccaggaggatgcccagagcgtgtatgatgccagctactatggaggccagtgtgaaacagtgtacaacggggagtggagggagctgcgctatgacagcacctgtgagcggctgtactatggagatgatgagaagtacttcaggaagccctacaacttcctgaagtaccactttgaggccctggccgacaccggcatcagcagcgagttctatgacaatgccaatgacctgctgagcaaggtgaagaaggacaagagtgacagctttggagtgaccatcggcatcggccctgctggcagccccctgctggtgggcgtgggcgtgagccacagccaggacaccagcttcctgaatgagctgaacaagtacaatgagaagaagttcatcttcacccgcatcttcaccaaggtgcagacagcccacttcaagatgaggaaggatgacatcatgctggatgagggcatgctgcagagcctgatggagctgcctgaccagtacaactacggcatgtatgccaagttcatcaatgactatggcacccactacatcaccagcggctccatgggcggcatctatgagtacatcctggtgattgacaaggccaagatggagagcctgggcatcaccagccgggacatcaccacctgcttcggcggcagcctgggcatccagtatgaggacaagatcaacgtgggcggcggcctgagcggggaccactgcaagaagtttggaggcggcaagacagagcgggccaggaaggccatggctgtggaggacatcatcagccgggtgcggggcggcagcagcggctggagcggcggcctggcccagaacagaagcaccatcacctaccgctcctggggccgcagcctgaagtacaaccctgtggtgattgactttgagatgcagcccatccacgaggtgctgcggcacaccagcctgggccccctggaggccaagaggcagaacctgcggcgggccctggaccagtacctgatggagttcaatgcctgccgctgtggcccctgcttcaacaatggagtgcccatcctggagggcaccagctgccgctgccagtgccgcctgggcagcctgggcgccgcctgtgagcagacccagacagaaggagccaaggcagatggctcctggagctgctggagctcctggagcgtgtgcagagctggcatccaggagaggagaagagaatgtgacaacccagccccccagaatggaggagccagctgccccggcaggaaggtgcagacccaggcctgctag

SEQ ID NO: 148292 - DNA, 1776 bp, Artificial Sequence
  Description of Artificial Sequence: Synthetic coding sequence
atgaagaacagcaggacctgggcctggagggcccctgtggagctgttcctgctgtgtgccgccctgggctgcctgagcctgcccggcagcagaggagagcggccccacagctttggcagcaatgctgtgaacaagagctttgccaagagccggcagatgaggtctgtggatgtgaccctgatgcccatcgactgtgagctgagctcctggagctcctggaccacctgtgacccctgccagaagaagcgctaccgctatgcctacctgctgcagcccagccagttccacggggagccctgcaacttcagtgacaaggaggtggaggactgtgtgaccaaccggccctgtggcagccaggtgcgctgtgagggctttgtgtgtgcccagacaggccgctgtgtgaacagaaggctgctgtgcaatggagacaatgactgtggggaccagagtgatgaggccaactgccgccgcatctacaagaagtgccagcacgagatggaccagtactggggcatcggcagcctggccagcggcatcaacctcttcaccaacagctttgagggccctgtgctggaccaccgctactatgccggcggctgcagcccccactacatcctgaacacccgcttcaggaagccctacaacgtggagagctacaccccccagacccagggcaagtatgagttcatcctgaaggagtatgagagctacagcgactttgaaagaaatgtgacagagaagatggccagcaagagcggcttctcctttggcttcaagatccctggcatctttgagctgggcatcagcagccagagcgaccggggcaagcactacatccggaggaccaagcgcttcagccacaccaagagcgtcttcctgcacgcccggagtgacctggaggtggcccactacaagctgaagcccaggagcctgatgctgcactatgagttcctgcagagggtgaagaggctgcccctggagtacagctatggagagtacagagacctcttccgggactttggcacccactacatcacagaggccgtgctgggcggcatctatgagtacaccctggtgatgaacaaggaggccatggagcggggggactacaccctgaacaacgtgcacgcctgtgccaagaatgacttcaagattggaggagccatcgaggaggtgtatgtgtccctgggcgtgtctgtgggcaagtgccggggcatcctgaatgagatcaaggacaggaacaagagggacaccatggtggaggacctggtggtgctggtgcggggcggggccagcgagcacatcaccaccctggcctaccaggagctgcccacagctgacctgatgcaggagtggggagatgctgtgcagtacaacccagccatcatcaaggtgaaggtggagcccctgtatgagctggtgacagccacagactttgcctacagcagcacagtgcggcagaacatgaagcaggccctggaggagttccagaaggaggtgagcagctgccactgtgccccctgccagggcaatggagtgcctgtgctgaagggcagccgctgtgactgcatctgccctgtgggcagccagggcctggcctgtgaggtgtcctacaggaagaacacccccattgatggcaagtggaactgctggagcaactggagcagctgcagcggccgcaggaagacccggcagaggcagtgcaacaaccccccaccccagaatggaggcagcccctgcagcggccctgccagcgagaccctggactgcagctag

SEQ ID NO: 148293 - DNA, 1590 bp, Artificial Sequence
  Description of Artificial Sequence: Synthetic coding sequence
atggacacctgcatgaccctggccttcaccctgagcggccgcttcttcatgctgctgagccagtaccgctatgcctacctgctgcagcccagccagttccacggggagccctgcaacttcagtgacaaggaggtggaggactgtgtgaccaaccggccctgtggcagccaggtgcgctgtgagggctttgtgtgtgcccagacaggccgctgtgtgaacagaaggctgctgtgcaatggagacaatgactgtggggaccagagtgatgaggccaactgccgccgcatctacaagaagtgccagcacgagatggaccagtactggggcatcggcagcctggccagcggcatcaacctcttcaccaacagctttgagggccctgtgctggaccaccgctactatgccggcggctgcagcccccactacatcctgaacacccgcttcaggaagccctacaacgtggagagctacaccccccagacccagggcaagtatgagttcatcctgaaggagtatgagagctacagcgactttgaaagaaatgtgacagagaagatggccagcaagagcggcttctcctttggcttcaagatccctggcatctttgagctgggcatcagcagccagagcgaccggggcaagcactacatccggaggaccaagcgcttcagccacaccaagagcgtcttcctgcacgcccggagtgacctggaggtggcccactacaagctgaagcccaggagcctgatgctgcactatgagttcctgcagagggtgaagaggctgcccctggagtacagctatggagagtacagagacctcttccgggactttggcacccactacatcacagaggccgtgctgggcggcatctatgagtacaccctggtgatgaacaaggaggccatggagcggggggactacaccctgaacaacgtgcacgcctgtgccaagaatgacttcaagattggaggagccatcgaggaggtgtatgtgtccctgggcgtgtctgtgggcaagtgccggggcatcctgaatgagatcaaggacaggaacaagagggacaccatggtggaggacctggtggtgctggtgcggggcggggccagcgagcacatcaccaccctggcctaccaggagctgcccacagctgacctgatgcaggagtggggagatgctgtgcagtacaacccagccatcatcaaggtgaaggtggagcccctgtatgagctggtgacagccacagactttgcctacagcagcacagtgcggcagaacatgaagcaggccctggaggagttccagaaggaggtgagcagctgccactgtgccccctgccagggcaatggagtgcctgtgctgaagggcagccgctgtgactgcatctgccctgtgggcagccagggcctggcctgtgaggtgtcctacaggaagaacacccccattgatggcaagtggaactgctggagcaactggagcagctgcagcggccgcaggaagacccggcagaggcagtgcaacaaccccccaccccagaatggaggcagcccctgcagcggccctgccagcgagaccctggactgcagctag

SEQ ID NO: 148294 - DNA, 1620 bp, Artificial Sequence
  Description of Artificial Sequence: Synthetic coding sequence
atgaggtctgtggatgtgaccctgatgcccatcgactgtgagctgagctcctggagctcctggaccacctgtgacccctgccagaagaagcgctaccgctatgcctacctgctgcagcccagccagttccacggggagccctgcaacttcagtgacaaggaggtggaggactgtgtgaccaaccggccctgtggcagccaggtgcgctgtgagggctttgtgtgtgcccagacaggccgctgtgtgaacagaaggctgctgtgcaatggagacaatgactgtggggaccagagtgatgaggccaactgccgccgcatctacaagaagtgccagcacgagatggaccagtactggggcatcggcagcctggccagcggcatcaacctcttcaccaacagctttgagggccctgtgctggaccaccgctactatgccggcggctgcagcccccactacatcctgaacacccgcttcaggaagccctacaacgtggagagctacaccccccagacccagggcaagtatgagttcatcctgaaggagtatgagagctacagcgactttgaaagaaatgtgacagagaagatggccagcaagagcggcttctcctttggcttcaagatccctggcatctttgagctgggcatcagcagccagagcgaccggggcaagcactacatccggaggaccaagcgcttcagccacaccaagagcgtcttcctgcacgcccggagtgacctggaggtggcccactacaagctgaagcccaggagcctgatgctgcactatgagttcctgcagagggtgaagaggctgcccctggagtacagctatggagagtacagagacctcttccgggactttggcacccactacatcacagaggccgtgctgggcggcatctatgagtacaccctggtgatgaacaaggaggccatggagcggggggactacaccctgaacaacgtgcacgcctgtgccaagaatgacttcaagattggaggagccatcgaggaggtgtatgtgtccctgggcgtgtctgtgggcaagtgccggggcatcctgaatgagatcaaggacaggaacaagagggacaccatggtggaggacctggtggtgctggtgcggggcggggccagcgagcacatcaccaccctggcctaccaggagctgcccacagctgacctgatgcaggagtggggagatgctgtgcagtacaacccagccatcatcaaggtgaaggtggagcccctgtatgagctggtgacagccacagactttgcctacagcagcacagtgcggcagaacatgaagcaggccctggaggagttccagaaggaggtgagcagctgccactgtgccccctgccagggcaatggagtgcctgtgctgaagggcagccgctgtgactgcatctgccctgtgggcagccagggcctggcctgtgaggtgtcctacaggaagaacacccccattgatggcaagtggaactgctggagcaactggagcagctgcagcggccgcaggaagacccggcagaggcagtgcaacaaccccccaccccagaatggaggcagcccctgcagcggccctgccagcgagaccctggactgcagctag

SEQ ID NO: 148295 - DNA, 675 bp, Artificial Sequence
  Description of Artificial Sequence: Synthetic coding sequence
atggccacccaccacaccctgtggatgggcctggccctgctgggcgtgctgggggacctgcaggccgcccctgaggcccaggtgtctgtgcagcccaacttccagcaggacaagttcctgggccgctggttctctgctggcctggccagcaacagctcctggctgcgggagaagaaggccgccctgtccatgtgcaagtctgtggtggccccagccacagatggcggcctgaacctgaccagcaccttcctgaggaagaaccagtgtgagaccaggaccatgctgctgcagcctgctggcagcctgggcagctacagctaccgcagcccccgggagtggggcctgcaccggcccccaggccccagcctgggcgccaccctggccggcaccaccctgggccagcccccagctgctgagatccatggagtgggggactggggcagcacctacagcgtgtctgtggtggagacagattatgaccagtatgccctgctgtacagccagggcagcaaaggacctggagaggacttcaggatggccaccctgtacagcaggacccagacccccagggctgagctgaaggagaagttcaccgccttctgcaaggcccagggcttcacagaggacaccatcgtgttcctgccccagacagacaagtgcatgacagagcagtag

SEQ ID NO: 148296 - DNA, 495 bp, Artificial Sequence
  Description of Artificial Sequence: Synthetic coding sequence
atgctgcccccaggcacagccaccctgctgaccctgctgctggccgccggcagcctgggccagaagccccagaggcccaggaggcctgccagccccatcagcaccatccagcccaaggccaactttgatgcccagcagtttgctggcacctggctgctggtggccgtgggcagcgcctgccgcttcctgcaggagcagggccacagagctgaggccaccaccctgcacgtggccccccagggcacagccatggctgtgtccaccttcaggaagctggatggcatctgctggcaggtgcggcagctgtatggagacaccggggtgctgggccgcttcctgctgcaggccagagatgcccggggagctgtgcacgtggtggtggccgagacagactaccagagctttgctgtgctgtacctggagagagctggccagctgtctgtgaagctgtatggagcccagggcgtggtgacagacaggcctggggtgggctag

SEQ ID NO: 148297 - DNA, 1680 bp, Artificial Sequence
  Description of Artificial Sequence: Synthetic coding sequence
atgtctgcctgccgcagctttgctgtggccatctgcatcctggagatcagcatcctgacagcccagtacaccaccagctatgaccctgagctgacagagagcagcggcagcgccagccacatcgactgcaggatgagcccctggagcgagtggagccagtgtgacccctgcctgcggcagatgttccgcagccgcagcattgaggtgtttggccagttcaacgggaagcgctgcacagatgctgtgggggaccggcggcagtgtgtgcccacagagccctgtgaagatgctgaagatgactgtggaaatgacttccagtgcagcacaggccgctgcatcaagatgaggctgcgctgcaatggagacaatgactgtggggacttcagtgatgaagatgactgtgagagcgagccccggcccccctgccgggacagagtggtggaggagagcgagctggccaggacagctggctacggcatcaacatcctgggcatggaccccctgagcaccccatttgacaatgagttctacaacggcctgtgcaacagagacagagatggcaacaccctgacctactaccgccggccctggaatgtggccagcctcatctatgagaccaagggggagaagaacttcagaacagagcactatgaggagcagatcgaggccttcaagagcatcatccaggagaagaccagcaacttcaatgctgccatcagcctgaagttcacccccacagagaccaacaaggccgagcagtgctgtgaggagacagccagcagcatcagcctgcacggcaagggcagcttccgcttctcctacagcaagaatgagacctaccagctgttcctgagctacagcagcaagaaggagaagatgttcctgcacgtgaagggggagatccacctgggccgctttgtgatgaggaacagagatgtggtgctgaccaccacctttgtggatgacatcaaggccctgcccaccacctatgagaagggggagtactttgccttcctggagacctacggcacccactacagcagcagcggcagcctgggcggcctgtatgagctgatctacgtgctggacaaggcctccatgaagaggaagggcgtggagctgaaggacatcaagcgctgcctgggctaccacctggatgtgtccctggccttcagcgagatctctgtgggcgctgagttcaacaaggatgactgtgtgaagagaggagagggccgggctgtgaacatcaccagcgagaacctgattgatgatgtggtgtccctcatccggggcggcaccaggaaatatgcctttgagctgaaggagaagctgctgcggggcaccgtgattgatgtgacagactttgtgaactgggccagcagcatcaatgatgcccctgtgctgatcagccagaagctgagccccatctacaacctggtgcctgtgaagatgaagaatgcccacctgaagaagcagaacctggagcgggccatcgaggactacatcaatgagttctctgtgaggaagtgccacacctgccagaatggaggcaccgtcatcctgatggatggcaagtgcctgtgtgcctgccccttcaagtttgagggcatcgcctgtgagatcagcaagcagaagatcagcgagggcctgcctgccctggagttccccaatgagaagtag

SEQ ID NO: 148298 - DNA, 1770 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggcccagccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacctgccaggtgaatggccgctggagcggccagacagccatctgtgacaacggggccggctactgcagcaaccctggcatccccatcggcaccaggaaggtgggcagccagtaccgcctggaggacagcgtgacctaccactgcagccggggcctgaccctgcggggcagccagaggaggacctgccaggagggcggctcctggagcggcacagagcccagctgccaggacagcttcatgtatgacaccccccaggaggtggccgaggccttcctgagcagcctgacagagaccatcgagggcgtggatgctgaagatggccacggccctggagagcagcagaagaggaagatcgtgctggaccccagcggctccatgaacatctacctggtgctggatggcagtgacagcattggagccagcaacttcaccggggccaagaagtgcctggtgaacctgattgagaaggtggccagctatggagtgaagcccaggtatggcctggtgacctacgccacctaccccaagatctgggtgaaggtgtctgaggccgacagcagcaatgctgactgggtgaccaagcagctgaatgagatcaactatgaggaccacaagctgaagagcggcaccaacaccaagaaggccctgcaggccgtgtacagcatgatgtcctggccagatgatgtgcccccagagggctggaacagaaccaggcatgtgatcatcctgatgacagatggcctgcacaacatgggcggggaccccatcaccgtgattgatgagatccgggacctgctgtacatcggcaaggacaggaagaacccccgggaggactacctggatgtgtatgtgtttggagtgggccccctggtgaaccaggtgaacatcaatgccctggccagcaagaaggacaatgagcagcacgtgttcaaggtgaaggacatggagaacctggaggatgtgttctaccagatgattgatgagagccagagcctgagcctgtgtggcatggtgtgggagcacaggaagggcacagactaccacaagcagccctggcaggccaagatcagcgtcatccggcccagcaagggccacgagagctgcatgggcgctgtggtgtctgagtactttgtgctgacagctgcccactgcttcaccgtggatgacaaggagcacagcatcaaggtgtctgtgggcggggagaagagggacctggagattgaggtggtgctcttccaccccaactacaacatcaacgggaagaaggaggccggcatccctgagttctatgactatgatgtggccctgatcaagctgaagaacaagctgaagtatggatag

SEQ ID NO: 148299 - DNA, 1770 bp, Artificial Sequence; identical to SEQ ID NO: 148298
  Description of Artificial Sequence: Synthetic coding sequence

SEQ ID NO: 148300 - DNA, 2295 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggcccggccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacctgccaggtgaatggccgctggagcggccagacagccatctgtgacaacggggccggctactgcagcaaccctggcatccccatcggcaccaggaaggtgggcagccagtaccgcctggaggacagcgtgacctaccactgcagccggggcctgaccctgcggggcagccagaggaggacctgccaggagggcggctcctggagcggcacagagcccagctgccaggacagcttcatgtatgacaccccccaggaggtggccgaggccttcctgagcagcctgacagagaccatcgagggcgtggatgctgaagatggccacggccctggagagcagcagaagaggaagatcgtgctggaccccagcggctccatgaacatctacctggtgctggatggcagtgacagcattggagccagcaacttcaccggggccaagaagtgcctggtgaacctgattgagaaggtggccagctatggagtgaagcccaggtatggcctggtgacctacgccacctaccccaagatctgggtgaaggtgtctgaggccgacagcagcaatgctgactgggtgaccaagcagctgaatgagatcaactatgaggaccacaagctgaagagcggcaccaacaccaagaaggccctgcaggccgtgtacagcatgatgtcctggccagatgatgtgcccccagagggctggaacagaaccaggcatgtgatcatcctgatgacagatggcctgcacaacatgggcggggaccccatcaccgtgattgatgagatccgggacctgctgtacatcggcaaggacaggaagaacccccgggaggactacctggatgtgtatgtgtttggagtgggccccctggtgaaccaggtgaacatcaatgccctggccagcaagaaggacaatgagcagcacgtgttcaaggtgaaggacatggagaacctggaggatgtgttctaccagatgattgatgagagccagagcctgagcctgtgtggcatggtgtgggagcacaggaagggcacagactaccacaagcagccctggcaggccaagatcagcgtcatccggcccagcaagggccacgagagctgcatgggcgctgtggtgtctgagtactttgtgctgacagctgcccactgcttcaccgtggatgacaaggagcacagcatcaaggtgtctgtgggcggggagaagagggacctggagattgaggtggtgctcttccaccccaactacaacatcaacgggaaggaggaggccggcatccctgagttctatgactatgatgtggccctgatcaagctgaagaacaagctgaagtatggccagaccatccggcccatctgcctgccctgcacagagggcaccacccgggccctgcggctgccccccaccaccacctgccagcagcagaaggaggagctgctgcctgcccaggacatcaaggccctgtttgtgtctgaggaggagaagaagctgaccaggaaggaggtgtacatcaagaatggagacaagaagggcagctgtgaaagagatgcccagtatgcccctggctatgacaaggtgaaggacatcagcgaggtggtgaccccccgcttcctgtgcacaggaggagtgagcccctatgctgaccccaacacctgccgcggggacagcggcggccccctcatcgtgcacaagaggagccgcttcatccaggtgggcgtcatctcctggggcgtggtggatgtgtgcaagaaccagaagaggcagaagcaggtgcctgcccacgcccgggacttccacatcaacctcttccaggtgctgccctggctgaaggagaagctgcaggatgaggacctgggcttcctgtag

SEQ ID NO: 148301 - DNA, 2295 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggcccggccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacctgccaggtgaatggccgctggagcggccagacagccatctgtgacaacggggccggctactgcagcaaccctggcatccccatcggcaccaggaaggtgggcagccagtaccgcctggaggacagcgtgacctaccactgcagccggggcctgaccctgcggggcagccagaggaggacctgccaggagggcggctcctggagcggcacagagcccagctgccaggacagcttcatgtatgacaccccccaggaggtggccgaggccttcctgagcagcctgacagagaccatcgagggcgtggatgctgaagatggccacggccctggagagcagcagaagaggaagatcgtgctggaccccagcggctccatgaacatctacctggtgctggatggcagtgacagcattggagccagcaacttcaccggggccaagaagtgcctggtgaacctgattgagaaggtggccagctatggagtgaagcccaggtatggcctggtgacctacgccacctaccccaagatctgggtgaaggtgtctgaggccgacagcagcaatgctgactgggtgaccaagcagctgaatgagatcaactatgaggaccacaagctgaagagcggcaccaacaccaagaaggccctgcaggccgtgtacagcatgatgtcctggccagatgatgtgcccccagagggctggaacagaaccaggcatgtgatcatcctgatgacagatggcctgcacaacatgggcggggaccccatcaccgtgattgatgagatccgggacctgctgtacatcggcaaggacaggaagaacccccgggaggactacctggatgtgtatgtgtttggagtgggccccctggtgaaccaggtgaacatcaatgccctggccagcaagaaggacaatgagcagcacgtgttcaaggtgaaggacatggagaacctggaggatgtgttctaccagatgattgatgagagccagagcctgagcctgtgtggcatggtgtgggagcacaggaagggcacagactaccacaagcagccctggcaggccaagatcagcgtcatccggcccagcaagggccacgagagctgcatgggcgctgtggtgtctgagtactttgtgctgacagctgcccactgcttcaccgtggatgacaaggagcacagcatcaaggtgtctgtgggcggggagaagagggacctggagattgaggtggtgctcttccaccccaactacaacatcaacgggaagaaggaggccggcatccctgagttctatgactatgatgtggccctgatcaagctgaagaacaagctgaagtatggccagaccatccggcccatctgcctgccctgcacagagggcaccacccgggccctgcggctgccccccaccaccacctgccagcagcagaaggaggagctgctgcctgcccaggacatcaaggccctgtttgtgtctgaggaggagaagaagctgaccaggaaggaggtgtacatcaagaatggagacaagaagggcagctgtgaaagagatgcccagtatgcccctggctatgacaaggtgaaggacatcagcgaggtggtgaccccccgcttcctgtgcacaggaggagtgagcccctatgctgaccccaacacctgccgcggggacagcggcggccccctcatcgtgcacaagaggagccgcttcatccaggtgggcgtcatctcctggggcgtggtggatgtgtgcaagaaccagaagaggcagaagcaggtgcctgcccacgcccgggacttccacatcaacctcttccaggtgctgccctggctgaaggagaagctgcaggatgaggacctgggcttcctgtag

SEQ ID NO: 148302 - DNA, 2295 bp, Artificial Sequence; identical to SEQ ID NO: 148301
  Description of Artificial Sequence: Synthetic coding sequence

SEQ ID NO: 148303 - DNA, 2295 bp, Artificial Sequence; identical to SEQ ID NO: 148300
  Description of Artificial Sequence: Synthetic coding sequence

SEQ ID NO: 148304 - DNA, 2295 bp, Artificial Sequence; identical to SEQ ID NO: 148301
  Description of Artificial Sequence: Synthetic coding sequence

SEQ ID NO: 148305 - DNA, 2295 bp, Artificial Sequence; identical to SEQ ID NO: 148301
  Description of Artificial Sequence: Synthetic coding sequence

SEQ ID NO: 148306 - DNA, 2295 bp, Artificial Sequence; identical to SEQ ID NO: 148301
  Description of Artificial Sequence: Synthetic coding sequence

SEQ ID NO: 148307 - DNA, 2295 bp, Artificial Sequence; identical to SEQ ID NO: 148301
  Description of Artificial Sequence: Synthetic coding sequence

SEQ ID NO: 148308 - DNA, 2295 bp, Artificial Sequence; identical to SEQ ID NO: 148301
  Description of Artificial Sequence: Synthetic coding sequence

SEQ ID NO: 148309 - DNA, 2295 bp, Artificial Sequence; identical to SEQ ID NO: 148301
  Description of Artificial Sequence: Synthetic coding sequence

SEQ ID NO: 148310 - DNA, 2295 bp, Artificial Sequence; identical to SEQ ID NO: 148301
  Description of Artificial Sequence: Synthetic coding sequence

SEQ ID NO: 148311 - DNA, 435 bp, Artificial Sequence
  Description of Artificial Sequence: Synthetic coding sequence
atgggcagcaacctgagcccccagctgtgcctgatgcccttcatcctgggcctgctgagcggcggcgtgaccaccaccccctggagcctggcccggccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacatag

SEQ ID NO: 148312 - DNA, 3801 bp, Artificial Sequence
  Description of Artificial Sequence: Synthetic coding sequence
atgggccccctgatggtgctcttctgcctgctcttcctgtacccaggcctggccgacagcgcccccagctgcccccagaatgtgaacatcagcggcggcaccttcaccctgagccacggctgggcccctggcagcctgctgacctacagctgcccccagggcctgtaccccagccctgccagccggctgtgcaagagcagcggccagtggcagacccctggggccaccaggagcctgagcaaggctgtgtgcaagccaggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggcaccggcaccaacacctacgccgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggctgtgatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggcgtgaccaccaccccctggagcctggcccggccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacctgccaggtgaatggccgctggagcggccagacagccatctgtgacaacggggccggctactgcagcaaccctggcatccccatcggcaccaggaaggtgggcagccagtaccgcctggaggacagcgtgacctaccactgcagccggggcctgaccctgcggggcagccagaggaggacctgccaggagggcggctcctggagcggcacagagcccagctgccaggacagcttcatgtatgacaccccccaggaggtggccgaggccttcctgagcagcctgacagagaccatcgagggcgtggatgctgaagatggccacggccctggagagcagcagaagaggaagatcgtgctggaccccagcggctccatgaacatctacctggtgctggatggcagtgacagcattggagccagcaacttcaccggggccaagaagtgcctggtgaacctgattgagaaggtggccagctatggagtgaagcccaggtatggcctggtgacctacgccacctaccccaagatctgggtgaaggtgtctgaggccgacagcagcaatgctgactgggtgaccaagcagctgaatgagatcaactatgaggaccacaagctgaagagcggcaccaacaccaagaaggccctgcaggccgtgtacagcatgatgtcctggccagatgatgtgcccccagagggctggaacagaaccaggcatgtgatcatcctgatgacagatggcctgcacaacatgggcggggaccccatcaccgtgattgatgagatccgggacctgctgtacatcggcaaggacaggaagaacccccgggaggactacctggatgtgtatgtgtttggagtgggccccctggtgaaccaggtgaacatcaatgccctggccagcaagaaggacaatgagcagcacgtgttcaaggtgaaggacatggagaacctggaggatgtgttctaccagatgattgatgagagccagagcctgagcctgtgtggcatggtgtgggagcacaggaagggcacagactaccacaagcagccctggcaggccaagatcagcgtcatccggcccagcaagggccacgagagctgcatgggcgctgtggtgtctgagtactttgtgctgacagctgcccactgcttcaccgtggatgacaaggagcacagcatcaaggtgtctgtgggcggggagaagagggacctggagattgaggtggtgctcttccaccccaactacaacatcaacgggaagaaggaggccggcatccctgagttctatgactatgatgtggccctgatcaagctgaagaacaagctgaagtatggccagaccatccggcccatctgcctgccctgcacagagggcaccacccgggccctgcggctgccccccaccaccacctgccagcagcagaaggaggagctgctgcctgcccaggacatcaaggccctgtttgtgtctgaggaggagaagaagctgaccaggaaggaggtgtacatcaagaatggagacaagaagggcagctgtgaaagagatgcccagtatgcccctggctatgacaaggtgaaggacatcagcgaggtggtgaccccccgcttcctgtgcacaggaggagtgagcccctatgctgaccccaacacctgccgcggggacagcggcggccccctcatcgtgcacaagaggagccgcttcatccaggtgggcgtcatctcctggggcgtggtggatgtgtgcaagaaccagaagaggcagaagcaggtgcctgcccacgcccgggacttccacatcaacctcttccaggtgctgccctggctgaaggagaagctgcaggatgaggacctgggcttcctgtag

SEQ ID NO: 148313 - DNA, 3801 bp, Artificial Sequence
  Description of Artificial Sequence: Synthetic coding sequence
atgggccccctgatggtgctcttctgcctgctcttcctgtacccaggcctggccgacagcgcccccagctgcccccagaatgtgaacatcagcggcggcaccttcaccctgagccacggctgggcccctggcagcctgctgacctacagctgcccccagggcctgtaccccagccctgccagccggctgtgcaagagcagcggccagtggcagacccctggggccaccaggagcctgagcaaggctgtgtgcaagccaggccactgccccaaccctggcatcagcctgggcgctgtgaggacaggcttccgctttggacatggagacaaggtgcgctaccgctgcagcagcaacctggtgctgaccggcagcagcgagcgggagtgccagggcaatggagtgtggagcggcacagagcccatctgccggcagccctacagctatgacttcccagaagatgtggccccagccctgggcaccagcttcagccacatgctgggcgccaccaaccccacccagaagaccaaggaccatgaaaatggcaccggcaccaacacctacgccgccctgaacagcgtgtacctgatgatgaacaaccagatgaggctgctgggcatggagaccatggcctggcaggagatcagacatgccatcatcctgctgacagatggcaagagcaacatgggcggcagccccaagacagctgtggaccacatccgggagatcctgaacatcaaccagaagagaaatgactacctggacatctatgccatcggcgtgggcaagctggatgtggactggagggagctgaatgagctgggcagcaagaaggatggagagagacatgccttcatcctgcaggacaccaaggccctgcaccaggtgtttgagcacatgctggatgtgtccaagctgacagacaccatctgtggggtgggcaacatgtctgccaatgccagtgaccaggagaggaccccctggcacgtgaccatcaagcccaagagccaggagacctgccgcggggccctgatcagtgaccagtgggtgctgacagctgcccactgcttcagagatggaaatgaccacagcctgtggagggtgaatgtgggggaccccaagagccagtggggcaaggagttcctgattgagaaggctgtgatcagccctggctttgatgtgtttgccaagaagaaccagggcatcctggagttctatggagatgacatcgccctgctgaagctggcccagaaggtgaagatgagcacccacgcccggcccatctgcctgccctgcaccatggaggccaacctggccctgcggcggccccagggcagcacctgccgggaccatgaaaatgagctgctgaacaagcagagcgtgcctgcccactttgtggccctgaatggcagcaagctgaacatcaacctgaagatgggcgtggagtggaccagctgtgccgaggtggtgtcccaggagaagaccatgttccccaacctgacagatgtgcgggaggtggtgacagaccagttcctgtgcagcggcacccaggaggatgagagcccctgcaagggcgtgaccaccaccccctggagcctggcccggccccagggcagctgcagcctggagggcgtggagatcaagggcggcagcttccggctgctgcaggagggccaggccctggagtatgtgtgccccagcggcttctacccctaccctgtgcagaccaggacctgccgcagcacaggctcctggagcaccctgaagacccaggaccagaagacagtgaggaaggcagaatgtcgggccatccactgcccccggccccatgactttgaaaatggagagtactggcccaggagcccctactacaacgtgtctgatgagatctccttccactgctatgatggctacaccctgcggggcagcgccaacagaacctgccaggtgaatggccgctggagcggccagacagccatctgtgacaacggggccggctactgcagcaaccctggcatccccatcggcaccaggaaggtgggcagccagtaccgcctggaggacagcgtgacctaccactgcagccggggcctgaccctgcggggcagccagaggaggacctgccaggagggcggctcctggagcggcacagagcccagctgccaggacagcttcatgtatgacaccccccaggaggtggccgaggccttcctgagcagcctgacagagaccatcgagggcgtggatgctgaagatggccacggccctggagagcagcagaagaggaagatcgtgctggaccccagcggctccatgaacatctacctggtgctggatggcagtgacagcattggagccagcaacttcaccggggccaagaagtgcctggtgaacctgattgagaaggtggccagctatggagtgaagcccaggtatggcctggtgacctacgccacctaccccaagatctgggtgaaggtgtctgaggccgacagcagcaatgctgactgggtgaccaagcagctgaatgagatcaactatgaggaccacaagctgaagagcggcaccaacaccaagaaggccctgcaggccgtgtacagcatgatgtcctggccagatgatgtgcccccagagggctggaacagaaccaggcatgtgatcatcctgatgacagatggcctgcacaacatgggcggggaccccatcaccgtgattgatgagatccgggacctgctgtacatcggcaaggacaggaagaacccccgggaggactacctggatgtgtatgtgtttggagtgggccccctggtgaaccaggtgaacatcaatgccctggccagcaagaaggacaatgagcagcacgtgttcaaggtgaaggacatggagaacctggaggatgtgttctaccagatgattgatgagagccagagcctgagcctgtgtggcatggtgtgggagcacaggaagggcacagactaccacaagcagccctggcaggccaagatcagcgtcatccggcccagcaagggccacgagagctgcatgggcgctgtggtgtctgagtactttgtgctgacagctgcccactgcttcaccgtggatgacaaggagcacagcatcaaggtgtctgtgggcggggagaagagggacctggagattgaggtggtgctcttccaccccaactacaacatcaacgggaaggaggaggccggcatccctgagttctatgactatgatgtggccctgatcaagctgaagaacaagctgaagtatggccagaccatccggcccatctgcctgccctgcacagagggcaccacccgggccctgcggctgccccccaccaccacctgccagcagcagaaggaggagctgctgcctgcccaggacatcaaggccctgtttgtgtctgaggaggagaagaagctgaccaggaaggaggtgtacatcaagaatggagacaagaagggcagctgtgaaagagatgcccagtatgcccctggctatgacaaggtgaaggacatcagcgaggtggtgaccccccgcttcctgtgcacaggaggagtgagcccctatgctgaccccaacacctgccgcggggacagcggcggccccctcatcgtgcacaagaggagccgcttcatccaggtgggcgtcatctcctggggcgtggtggatgtgtgcaagaaccagaagaggcagaagcaggtgcctgcccacgcccgggacttccacatcaacctcttccaggtgctgccctggctgaaggagaagctgcaggatgaggacctgggcttcctgtag

SEQ ID NO: 148314 - DNA, 3801 bp, Artificial Sequence; identical to SEQ ID NO: 148312
  Description of Artificial Sequence: Synthetic coding sequence

SEQ ID NO: 148315 - DNA, 3801 bp, Artificial Sequence; identical to SEQ ID NO: 148312
  Description of Artificial Sequence: Synthetic coding sequence

SEQ ID NO: 148316 - DNA, 3801 bp, Artificial Sequence; identical to SEQ ID NO: 148312
  Description of Artificial Sequence: Synthetic coding sequence

SEQ ID NO: 148317 - DNA, 3801 bp, Artificial Sequence; identical to SEQ ID NO: 148312
  Description of Artificial Sequence: Synthetic coding sequence

SEQ ID NO: 148318 - DNA, 762 bp, Artificial Sequence
  Description of Artificial Sequence: Synthetic coding sequence
atgcacagctgggagcggctggccgtgctggtgctgctgggcgccgccgcctgtgccgccccaccccggggccgcatcctgggcggccgggaggccgaggcccacgcccggccctacatggcctctgtgcagctgaatggagcccacctgtgtggcggcgtgctggtggccgagcagtgggtgctgtctgctgcccactgcctggaggatgctgctgatggcaaggtgcaggtgctgctgggcgcccacagcctgagccagcctgagcccagcaagaggctgtatgatgtgctgcgggctgtgccccacccagacagccagcctgacaccatcgaccatgacctgctgctgctgcagctgtctgagaaggccaccctgggccctgctgtgcggcccctgccctggcagagggtggacagagatgtggcccctggcaccctgtgtgatgtggccggctggggcatcgtgaaccacgccggcagaagaccagacagcctgcagcacgtgctgctgcctgtgctggaccgggccacctgcaacagaaggacccaccatgatggagccatcacagagcggctgatgtgtgccgagagcaacagaagagacagctgcaagggggacagcggcggccccctggtgtgtggcggcgtgctggagggcgtggtgaccagcggcagccgggtgtgtggcaacaggaagaagccaggcatctacaccagggtggccagctatgctgcctggattgacagcgtgctggcctag

SEQ ID NO: 148319 - DNA, 993 bp, Artificial Sequence
  Description of Artificial Sequence: Synthetic coding sequence
atgtggctgctggtgtctgtcatcctgatcagccgcatcagctctgtgggcggggaggccaccttctgtgacttccccaagatcaaccacggcatcctgtatgatgaggagaagtacaagcccttcagccaggtgcccactggagaggtgttctactacagctgtgagtacaactttgtgagccccagcaagagcttctggacccgcatcacctgcacagaggagggctggagccccacccccaagtgcctgcggctgtgcttcttcccctttgtggagaatggccacagcgagagcagcggccagacccacctggagggggacacagtgcagatcatctgcaacacaggctaccgcctgcagaacaatgaaaacaacatcagctgtgtggagcggggctggagcaccccacccaagtgccgcagcacagacaccagctgtgtgaacccccccaccgtgcagaatgcccacatcctgagccggcagatgagcaagtaccccagcggggagcgggtgcgctatgaatgtcgcagcccctatgagatgtttggagatgaggaggtgatgtgcctgaatggaaactggacagagcccccccagtgcaaggacagcactggaaaatgtggccccccaccacccatcgacaacggggacatcaccagcttccccctgtctgtgtatgccccagccagctctgtggagtaccagtgccagaacctgtaccagctggagggcaacaagaggatcacctgcagaaatggccagtggagcgagccccccaagtgcctgcacccctgcgtcatcagccgggagatcatggagaactacaacatcgccctgcgctggacagccaagcagaagctgtacctgaggactggagagagcgctgagtttgtgtgcaagaggggctaccgcctgagcagccgcagccacaccctgcggaccacctgctgggatggcaagctggagtaccccacctgtgccaagaggtag

SEQ ID NO: 148320 - DNA, 813 bp, Artificial Sequence
  Description of Artificial Sequence: Synthetic coding sequence
atgtggctgctggtgtctgtcatcctgatcagccgcatcagctctgtgggcggggaggccatgttctgtgacttccccaagatcaaccacggcatcctgtatgatgaggagaagtacaagcccttcagccaggtgcccactggagaggtgttctactacagctgtgagtacaactttgtgagccccagcaagagcttctggacccgcatcacctgtgccgaggagggctggagccccacccccaagtgcctgcggctgtgcttcttcccctttgtggagaatggccacagcgagagcagcggccagacccacctggagggggacacagtgcagatcatctgcaacacaggctaccgcctgcagaacaatgaaaacaacatcagctgtgtggagcggggctggagcaccccacccaagtgccgcagcaccatctctgctgagaagtgtggccccccaccacccatcgacaatggagacatcaccagcttcctgctgtctgtgtatgcccctggcagctctgtggagtaccagtgccagaacctgtaccagctggagggcaacaaccagatcacctgcagaaatggccagtggagcgagccccccaagtgcctggacccctgtgtgatcagccaggagatcatggagaagtacaacatcaagctgaagtggaccaaccagcagaagctgtacagcaggactggagacatcgtggagtttgtgtgcaagagcggctaccaccccaccaagagccacagcttccgggccatgtgccagaatggcaagctggtgtaccccagctgtgaggagaagtag

SEQ ID NO: 148321 - DNA, 813 bp, Artificial Sequence; identical to SEQ ID NO: 148320
  Description of Artificial Sequence: Synthetic coding sequence

SEQ ID NO: 148322 - DNA, 993 bp, Artificial Sequence
  Description of Artificial Sequence: Synthetic coding sequence
atgctgctgctgatcaacgtcatcctgaccctgtgggtgtcctgtgccaacggccaggtgaagccctgtgacttcccagacatcaagcacggcggcctcttccacgagaacatgagaagaccctacttccctgtggccgtgggcaagtactacagctactactgtgatgagcactttgagaccccatctggcagctactgggactacatccactgcacccagaatggctggagccctgctgtgccctgcctgaggaagtgctacttcccctacctggagaatggctacaaccagaactacggcaggaagtttgtgcagggcaacagcacagaggtggcctgccaccctggctacggcctgcccaaggcccagaccaccgtgacctgcacagagaagggctggagccccaccccccgctgcatccgggtgaggacctgcagcaagagtgacattgaaattgaaaatggcttcatcagcgagagcagcagcatctacatcctgaacaaggagatccagtacaagtgcaagccaggctacgccacagcagatggcaacagcagcggcagcatcacctgcctgcagaatggctggagcgcccagcccatctgcatcaacagcagcgagaagtgtggccccccaccacccatcagcaatggagacaccaccagcttcctgctgaaggtgtatgtgccccagagccgggtggagtaccagtgccagccctactatgagctgcagggcagcaactacgtgacctgcagcaatggagagtggagcgagcccccacgctgcatccacccctgcatcatcacagaggagaacatgaacaagaacaacatcaagctgaagggccgcagtgacaggaagtactatgccaagacaggagacaccatcgagttcatgtgcaagctgggctacaatgccaacaccagcatcctgtccttccaggccgtgtgccgggagggcatcgtggagtacccccgctgtgagtag

SEQ ID NO: 148323 - DNA, 588 bp, Artificial Sequence
  Description of Artificial Sequence: Synthetic coding sequence
atgctgctgctgatcaacgtcatcctgaccctgtgggtgtcctgtgccaacggccaggtgaagccctgtgacttcccagacatcaagcacggcggcctcttccacgagaacatgagaagaccctacttccctgtggccgtgggcaagtactacagctactactgtgatgagcactttgagaccccatctggcagctactgggactacatccactgcacccagaatggctggagccctgctgtgccctgcctgaggaagtgctacttcccctacctggagaatggctacaaccagaactacggcaggaagtttgtgcagggcaacagcacagaggtggcctgccaccctggctacggcctgcccaaggcccagaccaccgtgacctgcacagagaagggctggagccccaccccccgctgcatccgggtgaggacctgcagcaagagtgacattgaaattgaaaatggcttcatcagcgagagcagcagcatctacatcctgaacaaggagatccagtacaagtgcaagccaggctacgccacagcagatggcaacagcagtgacatggtgttctgcatctcctactag

SEQ ID NO: 148324 - DNA, 810 bp, Artificial Sequence
  Description of Artificial Sequence: Synthetic coding sequence
atgctgctgctgatcaacgtcatcctgaccctgtgggtgtcctgtgccaacggccaggtgaagccctgtgacttcccagacatcaagcacggcggcctcttccacgagaacatgagaagaccctacttccctgtggccgtgggcaagtactacagctactactgtgatgagcactttgagaccccatctggcagctactgggactacatccactgcacccagaatggctggagccctgctgtgccctgcctgaggaagtgctacttcccctacctggagaatggctacaaccagaactacggcaggaagtttgtgcagggcaacagcacagaggtggcctgccaccctggctacggcctgcccaaggcccagaccaccgtgacctgcacagagaagggctggagccccaccccccgctgcatccgggtgaacagcagcgagaagtgtggccccccaccacccatcagcaatggagacaccaccagcttcctgctgaaggtgtatgtgccccagagccgggtggagtaccagtgccagccctactatgagctgcagggcagcaactacgtgacctgcagcaatggagagtggagcgagcccccacgctgcatccacccctgcatcatcacagaggagaacatgaacaagaacaacatcaagctgaagggccgcagtgacaggaagtactatgccaagacaggagacaccatcgagttcatgtgcaagctgggctacaatgccaacaccagcatcctgtccttccaggccgtgtgccgggagggcatcgtggagtacccccgctgtgagtag

SEQ ID NO: 148325 - DNA, 996 bp, Artificial Sequence
  Description of Artificial Sequence: Synthetic coding sequence
atgctgctgctgatcaacgtcatcctgaccctgtgggtgtcctgtgccaacggccaggaggtgaagccctgtgacttccctgagatccagcacggcggcctgtactacaagagcctgcggcggctgtacttccctgctgctgctggccagagctacagctactactgtgaccagaactttgtgacccccagcggcagctactgggactacatccactgcacccaggacggctggagccccaccgtgccctgcctgcggacctgcagcaagagtgacattgaaattgaaaatggcttcatcagcgagagcagcagcatctacatcctgaacaaggagatccagtacaagtgcaagccaggctacgccacagcagatggcaacagcagcggcagcatcacctgcctgcagaatggctggagcgcccagcccatctgcatcaagttctgtgacatgcctgtgtttgagaacagccgggccaagagcaatggcatgaggttcaagctgcatgacaccctggactatgaatgttatgatggctatgagatctcctatggcaacaccaccggcagcatcgtgtgtggagaagatggctggagccacttccccacctgctacaacagcagcgagaagtgtggccccccaccacccatcagcaatggagacaccaccagcttcctgctgaaggtgtatgtgccccagagccgggtggagtaccagtgccagagctactatgagctgcagggcagcaactacgtgacctgcagcaatggagagtggagcgagcccccacgctgcatccacccctgcatcatcacagaggagaacatgaacaagaacaacatccagctgaagggcaagagtgacatcaagtactatgccaagacaggagacaccatcgagttcatgtgcaagctgggctacaatgccaacacctctgtgctgtccttccaggccgtgtgccgggagggcatcgtggagtacccccgctgtgagtag

SEQ ID NO: 148326 - DNA, 1734 bp, Artificial Sequence
  Description of Artificial Sequence: Synthetic coding sequence
atgctgctgctgatcaacgtcatcctgaccctgtgggtgtcctgtgccaacggccaggtgaagccctgtgacttccctgagatccagcacggcggcctgtactacaagagcctgcggcggctgtacttccctgctgctgctggccagagctacagctactactgtgaccagaactttgtgaccccatctggcagctactgggactacatccactgcacccaggacggctggagccccaccgtgccctgcctgcggacctgcagcaagagtgatgtggagattgaaaatggcttcatcagcgagagcagcagcatctacatcctgaatgaggagacccagtacaactgcaagccaggctacgccacagctgagggcaacagcagcggcagcatcacctgcctgcagaatggctggagcacccagcccatctgcatcaagttctgtgacatgcctgtgtttgagaacagccgggccaagagcaatggcatgtggttcaagctgcatgacaccctggactatgagtgctatgatggctatgagagcagctatggcaacaccacagacagcatcgtgtgtggggaggatggctggagccacctgcccacctgctacaacagcagcgagaactgtggccccccaccacccatcagcaatggagacaccaccagcttcccccagaaggtgtacctgccctggagccgggtggagtaccagtgccagagctactatgagctgcagggcagcaaatatgtgacctgcagcaatggagactggagcgagcccccacgctgcatctccatgaagccctgtgagttccctgagatccagcacggccacctgtactatgagaacacccggcggccctacttccctgtggccaccggccagagctacagctactactgtgaccagaactttgtgacccccagcggcagctactgggactacatccactgcacccaggacggctggctgcccaccgtgccctgcctgcggacctgcagcaagagtgacattgaaattgaaaatggcttcatcagcgagagcagcagcatctacatcctgaacaaggagatccagtacaagtgcaagccaggctacgccacagcagatggcaacagcagcggcagcatcacctgcctgcagaatggctggagcgcccagcccatctgcatcaagttctgtgacatgcctgtgtttgagaacagccgggccaagagcaatggcatgaggttcaagctgcatgacaccctggactatgaatgttatgatggctatgagatctcctatggcaacaccaccggcagcatcgtgtgtggagaagatggctggagccacttccccacctgctacaacagcagcgagaagtgtggccccccaccacccatcagcaatggagacaccaccagcttcctgctgaaggtgtatgtgccccagagccgggtggagtaccagtgccagagctactatgagctgcagggcagcaactacgtgacctgcagcaatggagagtggagcgagcccccacgctgcatccacccctgcatcatcacagaggagaacatgaacaagaacaacatccagctgaagggcaagagtgacatcaagtactatgccaagacaggagacaccatcgagttcatgtgcaagctgggctacaatgccaacacctctgtgctgtccttccaggccgtgtgccgggagggcatcgtggagtacccccgctgtgagtag

SEQ ID NO: 148327 - DNA, 996 bp, Artificial Sequence
  Description of Artificial Sequence: Synthetic coding sequence
atgctgctgctgatcaacgtcatcctgaccctgtgggtgtcctgtgccaacggccaggccatgaagccctgtgagttccctgagatccagcacggccacctgtactatgagaacacccggcggccctacttccctgtggccaccggccagagctacagctactactgtgaccagaactttgtgacccccagcggcagctactgggactacatccactgcacccaggacggctggctgcccaccgtgccctgcctgcggacctgcagcaagagtgacattgaaattgaaaatggcttcatcagcgagagcagcagcatctacatcctgaacaaggagatccagtacaagtgcaagccaggctacgccacagcagatggcaacagcagcggcagcatcacctgcctgcagaatggctggagcgcccagcccatctgcatcaagttctgtgacatgcctgtgtttgagaacagccgggccaagagcaatggcatgaggttcaagctgcatgacaccctggactatgaatgttatgatggctatgagatctcctatggcaacaccaccggcagcatcgtgtgtggagaagatggctggagccacttccccacctgctacaacagcagcgagaagtgtggccccccaccacccatcagcaatggagacaccaccagcttcctgctgaaggtgtatgtgccccagagccgggtggagtaccagtgccagagctactatgagctgcagggcagcaactacgtgacctgcagcaatggagagtggagcgagcccccacgctgcatccacccctgcatcatcacagaggagaacatgaacaagaacaacatccagctgaagggcaagagtgacatcaagtactatgccaagacaggagacaccatcgagttcatgtgcaagctgggctacaatgccaacacctctgtgctgtccttccaggccgtgtgccgggagggcatcgtggagtacccccgctgtgagtag

SEQ ID NO: 148328 - DNA, 996 bp, Artificial Sequence
  Description of Artificial Sequence: Synthetic coding sequence
atgctgctgctgatcaacgtcatcctgaccctgtgggtgtcctgtgccaacggccaggaggtgaagccctgtgacttccctgagatccagcacggcggcctgtactacaagagcctgcggcggctgtacttccctgctgctgctggccagagctacagctactactgtgaccagaactttgtgacccccagcggcagctactgggactacatccactgcacccaggacggctggctgcccaccgtgccctgcctgcggacctgcagcaagagtgacattgaaattgaaaatggcttcatcagcgagagcagcagcatctacatcctgaacaaggagatccagtacaagtgcaagccaggctacgccacagcagatggcaacagcagcggcagcatcacctgcctgcagaatggctggagcgcccagcccatctgcatcaagttctgtgacatgcctgtgtttgagaacagccgggccaagagcaatggcatgaggttcaagctgcatgacaccctggactatgaatgttatgatggctatgagatctcctatggcaacaccaccggcagcatcgtgtgtggagaagatggctggagccacttccccacctgctacaacagcagcgagaagtgtggccccccaccacccatcagcaatggagacaccaccagcttcctgctgaaggtgtatgtgccccagagccgggtggagtaccagtgccagagctactatgagctgcagggcagcaactacgtgacctgcagcaatggagagtggagcgagcccccacgctgcatccacccctgcatcatcacagaggagaacatgaacaagaacaacatccagctgaagggcaagagtgacatcaagtactatgccaagacaggagacaccatcgagttcatgtgcaagctgggctacaatgccaacacctctgtgctgtccttccaggccgtgtgccgggagggcatcgtggagtacccccgctgtgagtag

SEQ ID NO: 148329 - DNA, 1752 bp, Artificial Sequence
  Description of Artificial Sequence: Synthetic coding sequence
atgaagctgctgcacgtgttcctgctcttcctgtgcttccacctgcgcttctgcaaggtgacctacaccagccaggaggacctggtggagaagaagtgcctggccaagaagtacacccacctgagctgtgacaaggtgttctgccagccctggcagcgctgcatcgagggcacctgtgtgtgcaagctgccctaccagtgccccaagaatggaacagctgtgtgtgccaccaacagaagaagcttccccacctactgccagcagaagagcctggagtgcctgcaccctggcaccaagttcctgaacaacggcacctgcacagctgagggcaagttctctgtgtccctgaagcacggcaacacagattctgagggcatcgtggaggtgaagctggtggaccaggacaagaccatgttcatctgcaagagctcctggagcatgagggaggccaacgtggcctgcctggacctgggcttccagcagggcgctgacacccagaggcgcttcaagctgagtgacctgagcatcaacagcacagagtgcctgcacgtgcactgccggggcctggagaccagcctggctgaatgtaccttcaccaagaggaggaccatgggctaccaggactttgctgatgtggtgtgctacacccagaaggctgacagccccatggatgacttcttccagtgtgtgaatggcaagtacatcagccagatgaaggcctgtgatggcatcaatgactgtggggaccagagtgatgagctgtgctgcaaggcctgccagggcaagggcttccactgcaagagcggcgtgtgcatccccagccagtaccagtgcaatggagaggtggactgcatcaccggggaggatgaggtgggctgtgccggctttgcctctgtgacccaggaggagacagagatcctgacagctgacatggatgctgagcggcggcgcatcaagagcctgctgcccaagctgagctgtggggtgaagaacaggatgcacatccggaggaagagaattgtgggcggcaagagggcccagctgggggacctgccctggcaggtggccatcaaggatgccagcggcatcacctgtggcggcatctacatcggcggctgctggatcctgacagctgcccactgcctgcgggccagcaagacccaccgctaccagatctggaccaccgtggtggactggatccacccagacctgaagagaattgtgattgaatatgtggaccgcatcatcttccacgagaactacaatgccggcacctaccagaatgacatcgccctgattgagatgaagaaggatggcaacaagaaggactgtgagctgcccaggagcatcccagcctgtgtgccctggagcccctacctgttccagcccaatgacacctgcatcgtgtctggctggggccgggagaaggacaatgaaagagtcttcagcctgcagtggggcgaggtgaagctgatcagcaactgcagcaagttctacggcaaccgcttctatgagaaggagatggagtgtgccggcacctatgatggcagcattgatgcctgcaagggggacagcggcggccccctggtgtgcatggatgccaacaacgtgacctacgtgtggggcgtggtgtcctggggcgagaactgtgggaagccagagttccctggggtgtacaccaaggtggccaactactttgactggatctcctaccacgtgggccggcccttcatcagccagtacaacgtgtag

SEQ ID NO: 148330 - DNA, 1776 bp, Artificial Sequence
  Description of Artificial Sequence: Synthetic coding sequence
atgaagctgctgcacgtgttcctgctcttcctgtgcttccacctgcgcttctgcaaggtgacctacaccagccaggaggacctggtggagaagaagtgcctggccaagaagtacacccacctgagctgtgacaaggtgttctgccagccctggcagcgctgcatcgagggcacctgtgtgtgcaagctgccctaccagtgccccaagaatggaacagctgtgtgtgccaccaacagaagaagcttccccacctactgccagcagaagagcctggagtgcctgcaccctggcaccaagttcctgaacaacggcacctgcacagctgagggcaagttctctgtgtccctgaagcacggcaacacagattctgagggcatcgtggaggtgaagctggtggaccaggacaagaccatgttcatctgcaagagctcctggagcatgagggaggccaacgtggcctgcctggacctgggcttccagcagggcgctgacacccagaggcgcttcaagctgagtgacctgagcatcaacagcacagagtgcctgcacgtgcactgccggggcctggagaccagcctggctgaatgtaccttcaccaagaggaggaccatgggctaccaggactttgctgatgtggtgtgctacacccagaaggctgacagccccatggatgacttcttccagtgtgtgaatggcaagtacatcagccagatgaaggcctgtgatggcatcaatgactgtggggaccagagtgatgagctgtgctgcaaggcctgccagggcaagggcttccactgcaagagcggcgtgtgcatccccagccagtaccagtgcaatggagaggtggactgcatcaccggggaggatgaggtgggctgtgccgccgcccggcaccccaccatccagggctttgcctctgtgacccaggaggagacagagatcctgacagctgacatggatgctgagcggcggcgcatcaagagcctgctgcccaagctgagctgtggggtgaagaacaggatgcacatccggaggaagagaattgtgggcggcaagagggcccagctgggggacctgccctggcaggtggccatcaaggatgccagcggcatcacctgtggcggcatctacatcggcggctgctggatcctgacagctgcccactgcctgcgggccagcaagacccaccgctaccagatctggaccaccgtggtggactggatccacccagacctgaagagaattgtgattgaatatgtggaccgcatcatcttccacgagaactacaatgccggcacctaccagaatgacatcgccctgattgagatgaagaaggatggcaacaagaaggactgtgagctgcccaggagcatcccagcctgtgtgccctggagcccctacctgttccagcccaatgacacctgcatcgtgtctggctggggccgggagaaggacaatgaaagagtcttcagcctgcagtggggcgaggtgaagctgatcagcaactgcagcaagttctacggcaaccgcttctatgagaaggagatggagtgtgccggcacctatgatggcagcattgatgcctgcaagggggacagcggcggccccctggtgtgcatggatgccaacaacgtgacctacgtgtggggcgtggtgtcctggggcgagaactgtgggaagccagagttccctggggtgtacaccaaggtggccaactactttgactggatctcctaccacgtgggccggcccttcatcagccagtacaacgtgtag

SEQ ID NO: 148331 - DNA, 1731 bp, Artificial Sequence
  Description of Artificial Sequence: Synthetic coding sequence
atgaagctgctgcacgtgttcctgctcttcctgtgcttccacctgcgcttctgcaaggtgacctacaccagccaggaggacctggtggagaagaagtgcctggccaagaagtacacccacctgagctgtgacaaggtgttctgccagccctggcagcgctgcatcgagggcacctgtgtgtgcaagctgccctaccagtgccccaagaatggaacagctgtgtgtgccaccaacagaagaagcttccccacctactgccagcagaagagcctggagtgcctgcaccctggcaccaagttcctgaacaacggcacctgcacagctgagggcaagttctctgtgtccctgaagcacggcaacacagattctgagggcatcgtggaggtgaagctggtggaccaggacaagaccatgttcatctgcaagagctcctggagcatgagggaggccaacgtggcctgcctggacctgggcttccagcagggcgctgacacccagaggcgcttcaagctgagtgacctgagcatcaacagcacagagtgcctgcacgtgcactgccggggcctggagaccagcctggctgaatgtaccttcaccaagaggaggaccatgggctaccaggactttgctgatgtggtgtgctacacccagaaggctgacagccccatggatgacttcttccagtgtgtgaatggcaagtacatcagccagatgaaggcctgtgatggcatcaatgactgtggggaccagagtgatgagctgtgctgcaaggcctgccagggcaagggcttccactgcaagagcggcgtgtgcatccccagccagtaccagtgcaatggagaggtggactgcatcaccggggaggatgaggtgggctgtgccgaggagacagagatcctgacagctgacatggatgctgagcggcggcgcatcaagagcctgctgcccaagctgagctgtggggtgaagaacaggatgcacatccggaggaagagaattgtgggcggcaagagggcccagctgggggacctgccctggcaggtggccatcaaggatgccagcggcatcacctgtggcggcatctacatcggcggctgctggatcctgacagctgcccactgcctgcgggccagcaagacccaccgctaccagatctggaccaccgtggtggactggatccacccagacctgaagagaattgtcatcgagtatgtggaccgcatcatcttccacgagaactacaatgccggcacctaccagaatgacatcgccctgattgagatgaagaaggatggcaacaagaaggactgtgagctgcccaggagcatcccagcctgtgtgccctggagcccctacctgttccagcccaatgacacctgcatcgtgtctggctggggccgggagaaggacaatgaaagagtcttcagcctgcagtggggcgaggtgaagctgatcagcaactgcagcaagttctacggcaaccgcttctatgagaaggagatggagtgtgccggcacctatgatggcagcattgatgcctgcaagggggacagcggcggccccctggtgtgcatggatgccaacaacgtgacctacgtgtggggcgtggtgtcctggggcgagaactgtgggaagccagagttccctggggtgtacaccaaggtggccaactactttgactggatctcctaccacgtgggccggcccttcatcagccagtacaacgtgtag

SEQ ID NO: 148332 - DNA, 966 bp, Artificial Sequence
  Description of Artificial Sequence: Synthetic coding sequence
caggtgacctacaccagccaggaggacctggtggagaagaagtgcctggccaagaagtacacccacctgagctgtgacaaggtgttctgccagccctggcagcgctgcatcgagggcacctgtgtgtgcaagctgccctaccagtgccccaagaatggaacagctgtgtgtgccaccaacagaagaagcttccccacctactgccagcagaagagcctggagtgcctgcaccctggcaccaagttcctgaacaacggcacctgcacagctgagggcaagttctctgtgtccctgaagcacggcaacacagattctgagggcatcgtggaggtgaagctggtggaccaggacaagaccatgttcatctgcaagagctcctggagcatgagggaggccaacgtggcctgcctggacctgggcttccagcagggcgctgacacccagaggcgcttcaagctgagtgacctgagcatcaacagcacagagtgcctgcacgtgcactgccggggcctggagaccagcctggctgaatgtaccttcaccaagaggaggaccatgggctaccaggactttgctgatgtggtgtgctacacccagaaggctgacagccccatggatgacttcttccagtgtgtgaatggcaagtacatcagccagatgaaggcctgtgatggcatcaatgactgtggggaccagagtgatgagctgtgctgcaaggcctgccagggcaagggcttccactgcaagagcggcgtgtgcatccccagccagtaccagtgcaatggagaggtggactgcatcaccggggaggatgaggtgggctgtgccgcctttgctgagctgtgcatcgaggagacagagatcctgacagctgacatggatgctgagcggcggcgcatcaagagcctgctgcccaagctgagctgtggggtgaagaacaggatgcacatccggaggaagaggtag

SEQ ID NO: 148333 - DNA, 1134 bp, Artificial Sequence
  Description of Artificial Sequence: Synthetic coding sequence
atgaagctgctgcacgtgttcctgctcttcctgtgcttccacctgcgcttctgcaaggtgacctacaccagccaggaggacctggtggagaagaagtgcctggccaagaagtacacccacctgagctgtgacaaggtgttctgccagccctggcagcgctgcatcgagggcacctgtgtgtgcaagctgccctaccagtgccccaagaatggaacagctgtgtgtgccaccaacagaagaagcttccccacctactgccagcagaagagcctggagtgcctgcaccctggcaccaagttcctgaacaacggcacctgcacagctgagggcaagttctctgtgtccctgaagcacggcaacacagattctgagggcatcgtggaggtgaagctggtggaccaggacaagaccatgttcatctgcaagagctcctggagcatgagggaggccaacgtggcctgcctggacctgggcttccagcagggcgctgacacccagaggcgcttcaagctgagtgacctgagcatcaacagcacagagtgcctgcacgtgcactgccggggcctggagaccagcctggctgaatgtaccttcaccaagaggaggaccatgggctaccaggactttgctgatgtggtgtgctacacccagaaggctgacagccccatggatgacttcttccagtgtgtgaatggcaagtacatcagccagatgaaggcctgtgatggcatcaatgactgtggggaccagagtgatgagctgtgctgcaaggcctgccagggcaagggcttccactgcaagagcggcgtgtgcatccccagccagtaccagtgcaatggagaggtggactgcatcaccggggaggatgaggtgggctgtgccggctttgcctctgtgacccaggaggagacagagatcctgacagctgacatggatgctgagcggcggcgcatcaagagcctgctgcccaagctgagctgtggggtgaagaacaggatgcacatccggaggaagagaattgtgggcggcaagagggcccagctgggcaagatgaagcagatcagcctggacatcttcaagggcctgcaccgggtgtatgccatcctggagttctgctgcatcatcctgaagtag

SEQ ID NO: 148334 - DNA, 405 bp, Artificial Sequence
  Description of Artificial Sequence: Synthetic coding sequence
atggagtttgtgatgaagcaggccctgggcggggccaccaaggacatgggcaagatgctgggcggagatgaggagaaggaccctgatgctgccaagaaggaggaggagcggcaggaggccctgcggcaggccgaggaggagaggaaggccaagtatgccaagatggaggccgagcgggaggccgtgcggcagggcatccgggacaagtatggcatcaagaagaaggaggagcgggaggccgaggcccaggccgccatggaggccaacagcgagggcagcctgacccggcccaagaaggccatccccccaggctgtggagatgaggtggaggaggaggatgagagcatcctggacaccgtcatcaagtacctgcccggccccctgcaggacatgctgaagaagtag

SEQ ID NO: 148335 - DNA, 405 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagcggcaggaggccctgcggcagcaggaggaggagaggaaggccaagcacgccaggatggaggccgagcgggagaaggtgcggcagcagatccgggacaagtatggcctgaagaagaaggaggagaaggaggccgaggagaaggccgccctggagcagccctgtgagggcagcctgacccggcccaagaaggccatcccagctggctgtggagatgaggaggaggaggaggaggagagcatcctggacacagtgctgaagtacctgcccggccccctgcaggacatgttcaagaagtag

SEQ ID NO: 148336 - DNA, 405 bp, Artificial Sequence; identical to SEQ ID NO: 148335
  Description of Artificial Sequence: Synthetic coding sequence

SEQ ID NO: 148337 - DNA, 555 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagcggcaggaggccctgcggcagcaggaggaggagaggaaggccaagcacgccaggatggaggccgagcgggagaaggtgcggcagcagatccgggacaagtatggcctgaagaagaaggaggagaaggaggccgaggagaaggccgccctgcggggccggggcggcggcggccgcggggagcaccctggccacggggcccagatcccagcccgggctgctgctggccacgtgcaggaggtgacccggcccccagccccagcctacagcacctgctactacttcttcctggtgctgtccttcctgttcatccggctgagcctgaacagcgagggggagaacctgtcctggcccctgcccctcttccctggccagggcctgctgcccctgagcagccccagccacctgcccagcagccagggcatccacctgcaccccacccccaagtag

SEQ ID NO: 148338 - DNA, 234 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagcggcaggaggccctgcggcagcaggaggaggagaggaaggccaagcacgccaggatggaggccgagcgggagaaggtgcggcagcagatccgggacaagtatggcctgaagaagaaggaggagtag

SEQ ID NO: 148339 - DNA, 336 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagcggcaggaggccctgcggcagcaggaggaggagaggaaggccaagcacgccaggatggaggccgagcgggagaaggtgcggcagcagatccgggacaagtatggcctgaagaagaaggaggagaaggaggccgaggagaaggccgccctggagcagccctgtgagggcagcctgacccggcccaagaaggccatcccagctggctgtggagatgaggaggaggagtag

SEQ ID NO: 148340 - DNA, 360 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagcggcaggaggccctgcggcagcaggaggaggagaggaaggccaagcacgccaggatggaggccgagcgggagaaggtgcggcagcagatccgggacaagtatggcctgaagaagaaggaggagaaggaggccgaggagaaggccgccctggagcagccctgtgagggcagcctgacccggcccaagaaggccatcccagctggctgtggagatgaggaggaggaggaggaggagagcatcctggacacctag

SEQ ID NO: 148341 - DNA, 114 bp, Artificial Sequence
  Description of Artificial Sequence: Synthetic coding sequence
atggactttgtgatgaagcaggccctgggcggggccaccaaggacatgggcaagatgctgggcggggaggaggagaaggaccctgatgcccagaagaaggaggaggagaggtag

SEQ ID NO: 148342 - DNA, 405 bp, Artificial Sequence; identical to SEQ ID NO: 148335
  Description of Artificial Sequence: Synthetic coding sequence

SEQ ID NO: 148343 - DNA, 21 bp, Artificial Sequence
  Description of Artificial Sequence: Synthetic coding sequence
atggactttgtgatgaagtag

SEQ ID NO: 148344 - DNA, 2943 bp, Artificial Sequence
  Description of Artificial Sequence: Synthetic coding sequence
atggccacagctgccaccagccctgccctgaagaggctggacctgcgggaccctgctgccctgtttgagacccatggagctgaggagatccggggcctggagcggcaggtgcgggcagaaattgagcacaagaaggaggagctgcggcagatggtgggggagcgctacagagacctgattgaggccgctgacaccatcggccagatgaggcgctgtgctgtgggcctggtggatgctgtgaaggccacagaccagtactgtgcccggctgcggcaggccggcagcgctgccccccggcccccccgggcccagcagccccagcagcccagccaggagaagttctacagcatggccgcccagatcaagctgctgctggagatccctgagaagatctggagctccatggaggccagccagtgcctgcacgccacccagctgtacctgctgtgctgccacctgcacagcctgctgcagctggacagcagcagcagccgctacagccctgtgctgagccgcttccccatcctgatccggcaggtggccgccgccagccacttccgcagcaccatcctgcacgagagcaagatgctgctgaagtgccagggcgtgtctgaccaggccgtggccgaggccctgtgcagcatcatgctgctggaggagagcagcccccggcaggccctgacagacttcctgctggccaggaaggccaccatccagaagctgctgaaccagccccaccacggggccggcatcaaggcccagatctgcagcctggtggagctgctggccaccaccctgaagcaggcccacgccctcttctacaccctgcctgagggcctgctgcctgaccctgccctgccctgtggcctgctcttcagcaccctggagaccatcaccggccagcaccctgctgggaagggcaccggggtgctgcaggaggagatgaagctgtgctcctggttcaagcacctgcctgccagcatcgtggagttccagcccaccctgcggaccctggcccaccccatcagccaggagtacctgaaggacaccctgcagaagtggatccacatgtgcaatgaagacatcaagaatggcatcaccaacctgctgatgtatgtgaagtccatgaagggcctggccggcatcagagatgccatgtgggagctgctgaccaatgaaagcaccaaccacagctgggatgtgctgtgccggcggctgctggagaagcccctgctcttctgggaggacatgatgcagcagctgttcctggaccggctgcagaccctgaccaaggagggctttgacagcatcagcagcagcagcaaggagctgctggtgtctgccctgcaggagctggagagcagcaccagcaacagccccagcaacaagcacatccactttgagtacaacatgagcctcttcctgtggagcgagagccccaatgacctgcccagtgatgctgcctgggtgtctgtggccaacagaggccagtttgccagcagcggcctgtccatgaaggcccaggccatcagcccctgtgtgcagaacttctgcagcgccctggacagcaagctgaaggtgaagctggatgacctgctggcctacctgcccagtgatgacagcagcctgcccaaggatgtgagccccacccaggccaagagcagcgcctttgacagatatgcagatgctggcaccgtgcaggagatgctgcggacccagagcgtggcctgcatcaagcacatcgtggactgcatccgggcagagctgcagagcattgaggagggcgtgcagggccagcaggatgccctgaacagcgccaagctgcacagcgtgctcttcatggcccggctgtgccagagcctgggggagctgtgcccccacctgaagcagtgcatcctgggcaagtctgagagcagcgagaagccagcccgggagttccgggccctgaggaagcagggcaaggtgaagacccaggagatcatccccacccaggccaagtggcaggaggtgaaggaggtgctgctgcagcagagcgtgatgggctaccaggtgtggagcagcgctgtggtgaaggtgctgattcatggcttcacccagagcctgctgctggatgatgctggctctgtgctggccacagccacctcctgggatgagctggagatccaggaggaggccgagagcggcagctctgtgaccagcaagatccggctgcctgcccagcccagctggtacgtgcagagcttcctgttcagcctgtgccaggagatcaacagagtgggcggccacgccctgcccaaggtgaccctgcaggagatgctgaagagctgcatggtgcaggtggtggccgcctatgagaagctgtctgaggagaagcagatcaagaaggagggcgccttccctgtgacccagaacagagccctgcagctgctgtatgacctgcgctacctgaacatcgtgctgacagccaagggagatgaggtgaagagcggccgcagcaagccagacagccgcatcgagaaggtgacagaccacctggaggccctgattgacccctttgacctggatgtgttcaccccccacctgaacagcaacctgcaccggctggtgcagaggacctctgtgctgtttggcctggtgactggaacagagaaccagctggcccccaggagcagcaccttcaacagccaggagccccacaacatcctgcccctggccagcagccagatccgcttcggcctgctgcccctgtccatgaccagcaccaggaaggccaagagcaccaggaacatcgagaccaaggcccaggtggtgcccccagcccggagcacagctggggaccccaccgtgcccggcagcctcttccggcagctggtgtctgaggaggacaacaccagcgcccccagcctcttcaagctgggctggctgagctccatgaccaagtag

SEQ ID NO: 148345 - DNA, 2823 bp, Artificial Sequence
  Description of Artificial Sequence: Synthetic coding sequence
atggccacagctgccaccagccctgccctgaagaggctggacctgcgggaccctgctgccctgtttgagacccatggagctgaggagatccggggcctggagcggcaggtgcgggcagaaattgagcacaagaaggaggagctgcggcagatggtgggggagcgctacagagacctgattgaggccgctgacaccatcggccagatgaggcgctgtgctgtgggcctggtggatgctgtgaaggccacagaccagtactgtgcccggctgcggcaggccggcagcgctgccccccggcccccccgggcccagcagccccagcagcccagccaggagaagttctacagcatggccgcccagatcaagctgctgctggagatccctgagaagatctggagctccatggaggccagccagtgcctgcacgccacccagctgtacctgctgtgctgccacctgcacagcctgctgcagctggacagcagcagcagccgctacagccctgtgctgagccgcttccccatcctgatccggcaggtggccgccgccagccacttccgcagcaccatcctgcacgagagcaagatgctgctgaagtgccagggcgtgtctgaccaggccgtggccgaggccctgtgcagcatcatgctgctggaggagagcagcccccggcaggccctgacagacttcctgctggccaggaaggccaccatccagaagctgctgaaccagccccaccacggggccggcatcaaggcccagatctgcagcctggtggagctgctggccaccaccctgaagcaggcccacgccctcttctacaccctgcctgagggcctgctgcctgaccctgccctgccctgtggcctgctcttcagcaccctggagaccatcaccggccagcaccctgctgggaagggcaccggggtgctgcaggaggagatgaagctgtgctcctggttcaagcacctgcctgccagcatcgtggagttccagcccaccctgcggaccctggcccaccccatcagccaggagtacctgaaggacaccctgcagaagtggatccacatgtgcaatgaagacatcaagaatggcatcaccaacctgctgatgtatgtgaagtccatgaagggcctggccggcatcagagatgccatgtgggagctgctgaccaatgaaagcaccaaccacagctgggatgtgctgtgccggcggctgctggagaagcccctgctcttctgggaggacatgatgcagcagctgttcctggaccggctgcagaccctgaccaaggagggctttgacagcatcagcagcagcagcaaggagctgctggtgtctgccctgcaggagctggagagcagcaccagcaacagccccagcaacaagcacatccactttgagtacaacatgagcctcttcctgtggagcgagagccccaatgacctgcccagtgatgctgcctgggtgtctgtggccaacagaggccagtttgccagcagcggcctgtccatgaaggcccaggccatcagcccctgtgtgcagaacttctgcagcgccctggacagcaagctgaaggtgaagctggatgacctgctggcctacctgcccagtgatgacagcagcctgcccaaggatgtgagccccacccaggccaagagcagcgcctttgacagatatgcagatgctggcaccgtgcaggagatgctgcggacccagagcgtggcctgcatcaagcacatcgtggactgcatccgggcagagctgcagagcattgaggagggcgtgcagggccagcaggatgccctgaacagcgccaagctgcacagcgtgctcttcatggcccggctgtgccagagcctgggggagctgtgcccccacctgaagcagtgcatcctgggcaagtctgagagcagcgagaagccagcccgggagttccgggccctgaggaagcagggcaaggtgaagacccaggagatcatccccacccaggccaagtggcaggaggtgaaggaggtgctgctgcagcagagcgtgatgggctaccaggtgtggagcagcgctgtggtgaaggtgctgattcatggcttcacccagagcctgctgctggatgatgctggctctgtgctggccacagccacctcctgggatgagctggagatccaggaggaggccgagagcggcagctctgtgaccagcaagatccggctgcctgcccagcccagctggtacgtgcagagcttcctgttcagcctgtgccaggagatcaacagagtgggcggccacgccctgcccaaggtgaccctgcaggagatgctgaagagctgcatggtgcaggtggtggccgcctatgagaagctgtctgaggagaagcagatcaagaaggagggcgccttccctgtgacccagaacagagccctgcagctgctgtatgacctgcgctacctgaacatcgtgctgacagccaagggagatgaggtgaagagcggccgcagcaagccagacagccgcatcgagaaggtgacagaccacctggaggccctgattgacccctttgacctggatgtgttcaccccccacctgaacagcaacctgcaccggctggtgcagaggacctctgtgctgtttggcctggtgactggaacagagaaccagctggcccccaggagcagcaccttcaacagccaggagccccacaacatcctgcccctggccagcagccagatccgcttcggcctgctgcccctgtccatgaccagcaccaggaaggccaagagcaccaggaacatcgagaccaaggcccagtatgatgccaactgctag

SEQ ID NO: 148346 - DNA, 2214 bp, Artificial Sequence
  Description of Artificial Sequence: Synthetic coding sequence
atggagaagagcaggatgaacctgcccaagggccctgacaccctgtgctttgacaaggatgagttcatgaaggaggactttgatgtggaccactttgtgtctgactgcaggaagagggtgcagctggaggagctgagagatgacctggagctgtactacaagctgctgaagacagccatggtggagctgatcaacaaggactatgctgactttgtgaacctgagcaccaacctggtgggcatggacaaggccctgaaccagctgtctgtgcccctgggccagctgcgggaggaggtgctgagcctgcggagctctgtgtctgagggcatccgggctgtggatgagaggatgagcaagcaggaggacatcaggaagaagaagatgtgtgtgctgcggctcatccaggtgatccgctctgtggagaagattgagaagatcctgaacagccagagcagcaaggagaccagcgccctggaggccagcagccccctgctgaccggccagatcctggagagaattgccacagagttcaaccagctgcagttccacgctgtgcagagcaagggcatgcccctgctggacaaggtgcggcccagaattgctggcatcacagccatgctgcagcagagcctggagggcctgctgctggagggcctgcagaccagtgatgtggacatcatccgccactgcctgcggacctacgccaccatcgacaagaccagagatgctgaggccctggtgggccaggtgctggtgaagccctacattgatgaagtcatcatcgagcagtttgtggagagccaccccaacggcctgcaggtgatgtacaacaagctgctggagtttgtgccccaccactgccgcctgctgcgggaggtgactggaggagccatcagcagcgagaagggcaacacagtgcccggctatgacttcctggtgaacagcgtgtggccccagatcgtgcagggcctggaggagaagctgcccagcctcttcaaccctggcaacccagatgccttccacgagaagtacaccatctccatggactttgtgcggcggctggagcggcagtgtggcagccaggcctctgtgaagaggctgcgggcccacccagcctaccacagcttcaacaagaagtggaacctgcctgtgtacttccagatccgcttccgggagattgctggcagcctggaggccgccctgacagatgtgctggaggatgccccagctgagagcccctactgcctgctggccagccacaggacctggagcagcctgcggcgctgctggagcgatgagatgttcctgcccctgctggtgcaccggctgtggaggctgaccctgcagatcctggcccgctacagcgtgtttgtgaatgagctgagcctgcggcccatcagcaatgaaagccccaaggagatcaagaagcccctggtgacaggcagcaaggagcccagcatcacccagggcaacacagaggaccagggcagcggccccagcgagaccaagcctgtggtgtccatcagcaggacccagctggtgtatgtggtggccgacctggacaagctgcaggagcagctgcctgagctgctggagatcatcaagcccaagctggagatgattggcttcaagaacttcagcagcatcagcgccctggaggacagccagagcagcttcagcgcctgtgtgcccagcctgagcagcaagatcatccaggacctgagtgacagctgcttcggcttcctgaagagcgccctggaggtgccccggctgtacagaaggaccaacaaggaggtgcccaccacagccagcagctatgtggacagcgccctgaagcccctcttccagctgcagagcggccacaaggacaagctgaagcaggccatcatccagcagtggctggagggcaccctgtctgagagcacccacaagtactatgagaccgtgtctgatgtgctgaacagcgtgaagaagatggaggagagcctgaagaggctgaagcaggccaggaagaccaccccagccaaccctgtgggccccagcggcggcatgtctgatgatgacaagatccggctgcagctggccctggatgtggagtacctgggggagcagatccagaagctgggcctgcaggccagtgacatcaagagcttcagcgccctggccgagctggtggccgccgccaaggaccaggccacagctgagcagccctag

SEQ ID NO: 148347 - DNA, 2217 bp, Artificial Sequence
  Description of Artificial Sequence: Synthetic coding sequence
atggagaagagcaggatgaacctgcccaagggccctgacaccctgtgctttgacaaggatgagttcatgaaggaggactttgatgtggaccactttgtgtctgactgcaggaagagggtgcagctggaggagctgagagatgacctggagctgtactacaagctgctgaagacagccatggtggagctgatcaacaaggactatgctgactttgtgaacctgagcaccaacctggtgggcatggacaaggccctgaaccagctgtctgtgcccctgggccagctgcgggaggaggtgctgagcctgcggagctctgtgtctgagggcatccgggctgtggatgagaggatgagcaagcaggaggacatcaggaagaagaagatgtgtgtgctgcggctcatccaggtgatccgctctgtggagaagattgagaagatcctgaacagccagagcagcaaggagaccagcgccctggaggccagcagccccctgctgaccggccagatcctggagagaattgccacagagttcaaccagctgcagttccacgctgtgcagagcaagggcatgcccctgctggacaaggtgcggcccagaattgctggcatcacagccatgctgcagcagagcctggagggcctgctgctggagggcctgcagaccagtgatgtggacatcatccgccactgcctgcggacctacgccaccatcgacaagaccagagatgctgaggccctggtgggccaggtgctggtgaagccctacattgatgaagtcatcatcgagcagtttgtggagagccaccccaacggcctgcaggtgatgtacaacaagctgctggagtttgtgccccaccactgccgcctgctgcgggaggtgactggaggagccatcagcagcgagaagggcaacacagtgcccggctatgacttcctggtgaacagcgtgtggccccagatcgtgcagggcctggaggagaagctgcccagcctcttcaaccctggcaacccagatgccttccacgagaagtacaccatctccatggactttgtgcggcggctggagcggcagtgtggcagccaggcctctgtgaagaggctgcgggcccacccagcctaccacagcttcaacaagaagtggaacctgcctgtgtacttccagatccgcttccgggagattgctggcagcctggaggccgccctgacagatgtgctggaggatgccccagctgagagcccctactgcctgctggccagccacaggacctggagcagcctgcggcgctgctggagcgatgagatgttcctgcccctgctggtgcaccggctgtggaggctgaccctgcagatcctggcccgctacagcgtgtttgtgaatgagctgagcctgcggcccatcagcaatgaaagccccaaggagatcaagaagcccctggtgacaggcagcaaggagcccagcatcacccagggcaacacagaggaccagggcagcggccccagcgagaccaagcctgtggtgtccatcagcaggacccagctggtgtatgtggtggccgacctggacaagctgcaggagcagctgcctgagctgctggagatcatcaagcccaagctggagatgattggcttcaagaacttcagcagcatctctgctgccctggaggacagccagagcagcttcagcgcctgtgtgcccagcctgagcagcaagatcatccaggacctgagtgacagctgcttcggcttcctgaagagcgccctggaggtgccccggctgtacagaaggaccaacaaggaggtgcccaccacagccagcagctatgtggacagcgccctgaagcccctcttccagctgcagagcggccacaaggacaagctgaagcaggccatcatccagcagtggctggagggcaccctgtctgagagcacccacaagtactatgaaacagtgtctgatgtgctgaacagcgtgaagaagatggaggagagcctgaagaggctgaagcaggccaggaagaccaccccagccaaccctgtgggccccagcggcggcatgtctgatgatgacaagatccggctgcagctggccctggatgtggagtacctgggggagcagatccagaagctgggcctgcaggccagtgacatcaagagcttcagcgccctggccgagctggtggccgccgccaaggaccaggccacagctgagcagccctag

SEQ ID NO: 148348 - DNA, 2040 bp, Artificial Sequence
  Description of Artificial Sequence: Synthetic coding sequence
atggtggagctgatcaacaaggactatgctgactttgtgaacctgagcaccaacctggtgggcatggacaaggccctgaaccagctgtctgtgcccctgggccagctgcgggaggaggtgctgagcctgcggagctctgtgtctgagggcatccgggctgtggatgagaggatgagcaagcaggaggacatcaggaagaagaagatgtgtgtgctgcggctcatccaggtgatccgctctgtggagaagattgagaagatcctgaacagccagagcagcaaggagaccagcgccctggaggccagcagccccctgctgaccggccagatcctggagcgcatcgccacagagttcaaccagctgcagttccacgctgtgcagagcaagggcatgcccctgctggacaaggtgcggcccagaattgctggcatcacagccatgctgcagcagagcctggagggcctgctgctggagggcctgcagaccagtgatgtggacatcatccgccactgcctgcggacctacgccaccatcgacaagaccagagatgctgaggccctggtgggccaggtgctggtgaagccctacattgatgaggtgatcatcgagcagtttgtggagagccaccccaacggcctgcaggtgatgtacaacaagctgctggagtttgtgccccaccactgccgcctgctgcgggaggtgactggaggagccatcagcagcgagaagggcaacacagtgcccggctatgacttcctggtgaacagcgtgtggccccagatcgtgcagggcctggaggagaagctgcccagcctcttcaaccctggcaacccagatgccttccacgagaagtacaccatctccatggactttgtgcggcggctggagcggcagtgtggcagccaggcctctgtgaagaggctgcgggcccacccagcctaccacagcttcaacaagaagtggaacctgcctgtgtacttccagatccgcttccgggagattgctggcagcctggaggccgccctgacagatgtgctggaggatgccccagctgagagcccctactgcctgctggccagccacaggacctggagcagcctgcggcgctgctggagcgatgagatgttcctgcccctgctggtgcaccggctgtggaggctgaccctgcagatcctggcccgctacagcgtgtttgtgaatgagctgagcctgcggcccatcagcaatgaaagccccaaggagatcaagaagcccctggtgacaggcagcaaggagcccagcatcacccagggcaacacagaggaccagggcagcggccccagcgagaccaagcctgtggtgtccatcagcaggacccagctggtgtatgtggtggccgacctggacaagctgcaggagcagctgcctgagctgctggagatcatcaagcccaagctggagatgattggcttcaagaacttcagcagcatctctgctgccctggaggacagccagagcagcttcagcgcctgtgtgcccagcctgagcagcaagatcatccaggacctgagtgacagctgcttcggcttcctgaagagcgccctggaggtgccccggctgtacagaaggaccaacaaggaggtgcccaccacagccagcagctatgtggacagcgccctgaagcccctcttccagctgcagagcggccacaaggacaagctgaagcaggccatcatccagcagtggctggagggcaccctgtctgagagcacccacaagtactatgagaccgtgtctgatgtgctgaacagcgtgaagaagatggaggagagcctgaagaggctgaagcaggccaggaagaccaccccagccaaccctgtgggccccagcggcggcatgtctgatgatgacaagatccggctgcagctggccctggatgtggagtacctgggggagcagatccagaagctgggcctgcaggccagtgacatcaagagcttcagcgccctggccgagctggtggccgccgccaaggaccaggccacagctgagcagccctag

SEQ ID NO: 148349 - DNA, 1869 bp, Artificial Sequence
  Description of Artificial Sequence: Synthetic coding sequence
atgagcaagcaggaggacatcaggaagaagaagatgtgtgtgctgcggctcatccaggtgatccgctctgtggagaagattgagaagatcctgaacagccagagcagcaaggagaccagcgccctggaggccagcagccccctgctgaccggccagatcctggagagaattgccacagagttcaaccagctgcagttccacgctgtgcagagcaagggcatgcccctgctggacaaggtgcggcccagaattgctggcatcacagccatgctgcagcagagcctggagggcctgctgctggagggcctgcagaccagtgatgtggacatcatccgccactgcctgcggacctacgccaccatcgacaagaccagagatgctgaggccctggtgggccaggtgctggtgaagccctacattgatgaagtcatcatcgagcagtttgtggagagccaccccaacggcctgcaggtgatgtacaacaagctgctggagtttgtgccccaccactgccgcctgctgcgggaggtgactggaggagccatcagcagcgagaagggcaacacagtgcccggctatgacttcctggtgaacagcgtgtggccccagatcgtgcagggcctggaggagaagctgcccagcctcttcaaccctggcaacccagatgccttccacgagaagtacaccatctccatggactttgtgcggcggctggagcggcagtgtggcagccaggcctctgtgaagaggctgcgggcccacccagcctaccacagcttcaacaagaagtggaacctgcctgtgtacttccagatccgcttccgggagattgctggcagcctggaggccgccctgacagatgtgctggaggatgccccagctgagagcccctactgcctgctggccagccacaggacctggagcagcctgcggcgctgctggagcgatgagatgttcctgcccctgctggtgcaccggctgtggaggctgaccctgcagatcctggcccgctacagcgtgtttgtgaatgagctgagcctgcggcccatcagcaatgaaagccccaaggagatcaagaagcccctggtgacaggcagcaaggagcccagcatcacccagggcaacacagaggaccagggcagcggccccagcgagaccaagcctgtggtgtccatcagcaggacccagctggtgtatgtggtggccgacctggacaagctgcaggagcagctgcctgagctgctggagatcatcaagcccaagctggagatgattggcttcaagaacttcagcagcatctctgctgccctggaggacagccagagcagcttcagcgcctgtgtgcccagcctgagcagcaagatcatccaggacctgagtgacagctgcttcggcttcctgaagagcgccctggaggtgccccggctgtacagaaggaccaacaaggaggtgcccaccacagccagcagctatgtggacagcgccctgaagcccctcttccagctgcagagcggccacaaggacaagctgaagcaggccatcatccagcagtggctggagggcaccctgtctgagagcacccacaagtactatgaaacagtgtctgatgtgctgaacagcgtgaagaagatggaggagagcctgaagaggctgaagcaggccaggaagaccaccccagccaaccctgtgggccccagcggcggcatgtctgatgatgacaagatccggctgcagctggccctggatgtggagtacctgggggagcagatccagaagctgggcctgcaggccagtgacatcaagagcttcagcgccctggccgagctggtggccgccgccaaggaccaggccacagctgagcagccctag

SEQ ID NO: 148350 - DNA, 1284 bp, Artificial Sequence
  Description of Artificial Sequence: Synthetic coding sequence
atgggctttgccatggaggacacagaggacatcagccagaaccacttcggccacctgtgcatcttcaagtggggccactggaagaaggacctgaagtacaccatctccatggactttgtgcggcggctggagcggcagtgtggcagccaggcctctgtgaagaggctgcgggcccacccagcctaccacagcttcaacaagaagtggaacctgcctgtgtacttccagatccgcttccgggagattgctggcagcctggaggccgccctgacagatgtgctggaggatgccccagctgagagcccctactgcctgctggccagccacaggacctggagcagcctgcggcgctgctggagcgatgagatgttcctgcccctgctggtgcaccggctgtggaggctgaccctgcagatcctggcccgctacagcgtgtttgtgaatgagctgagcctgcggcccatcagcaatgaaagccccaaggagatcaagaagcccctggtgacaggcagcaaggagcccagcatcacccagggcaacacagaggaccagggcagcggccccagcgagaccaagcctgtggtgtccatcagcaggacccagctggtgtatgtggtggccgacctggacaagctgcaggagcagctgcctgagctgctggagatcatcaagcccaagctggagatgattggcttcaagaacttcagcagcatctctgctgccctggaggacagccagagcagcttcagcgcctgtgtgcccagcctgagcagcaagatcatccaggacctgagtgacagctgcttcggcttcctgaagagcgccctggaggtgccccggctgtacagaaggaccaacaaggaggtgcccaccacagccagcagctatgtggacagcgccctgaagcccctcttccagctgcagagcggccacaaggacaagctgaagcaggccatcatccagcagtggctggagggcaccctgtctgagagcacccacaagtactatgagaccgtgtctgatgtgctgaacagcgtgaagaagatggaggagagcctgaagaggctgaagcaggccaggaagaccaccccagccaaccctgtgggccccagcggcggcatgtctgatgatgacaagatccggctgcagctggccctggatgtggagtacctgggggagcagatccagaagctgggcctgcaggccagtgacatcaagagcttcagcgccctggccgagctggtggccgccgccaaggaccaggccacagctgagcagccctag

SEQ ID NO: 148351 - DNA, 2487 bp, Artificial Sequence
  Description of Artificial Sequence: Synthetic coding sequence
atggccgaggccgccctgctgctgctgcctgaggccgctgctgagagagatgcccgggagaagctggccctgtgggacagaagaccagacaccacagcccccctgacagaccggcagacagacagcgtgctggagctgaaggctgctgctgagaacctgcctgtgcctgctgagctgcccatcgaggacctgtgcagcctgaccagccagagcctgcccatcgagctgacctctgtggtgcctgagagcacagaggacatcctgctgaagggcttcaccagcctgggcatggaggaggagcgcatcgagacagcccagcagttcttctcctggtttgccaagctgcagacccagatggaccaggatgagggcaccaagtaccggcagatgagggactacctgagcggcttccaggagcagtgtgatgccatcctgaatgatgtgaacagcgccctgcagcacctggagagcctgcagaagcagtacctgtttgtgagcaacaagacaggcaccctgcacgaggcctgtgagcagctgctgaaggagcagagcgagctggtggacctggccgagaacatccagcagaagctgagctacttcaatgagctggagaccatcaacaccaagctgaacagccccaccctgtctgtgaacagtgatggcttcatccccatgctggccaagctggatgactgcatcacctacatcagcagccaccccaacttcaaggactaccccatctacctgctgaagttcaagcagtgcctgagcaaggccctgcacctgatgaagacctacacagtgaacaccctgcagaccctgaccagccagctgctgaagagggaccccagctctgtgcccaatgctgacaatgccttcaccctcttctacgtgaagttccgggctgctgcccccaaggtgaggaccctgattgagcagatcgagctgcggtctgagaagatccctgagtaccagcagctgctgaatgacatccaccagtgctacctggaccagcgggagctgctgctgggccccagcatcgcctgcaccgtggccgagctgaccagccagaacaacagagaccactgtgccctggtgcgcagcggctgtgccttcatggtgcacgtgtgccaggatgagcaccagctgtacaatgagttcttcaccaagcccaccagcaagctggatgagctgctggagaagctgtgtgtgtccctgtatgatgtgttccggcccctcatcatccacgtgatccacctggagaccctgtctgagctgtgtggcatcctgaagaatgaggtgctggaggaccacgtgcagaacaatgctgagcagctgggcgcctttgctgctggggtgaagcagatgctggaggatgtgcaggagcggctggtgtaccgcacccacatctacatccagacagacatcaccggctacaagccagcccctggggacctggcctacccagacaagctggtgatgatggagcagatcgcccagagcctgaaggatgagcagaagaaggtgcccagcgaggccagcttcagtgatgtgcacctggaggagggggagagcaacagcctgaccaagagcggcagcacagagagcctgaacccccggccccagaccaccatcagccctgctgacctgcacggcatgtggtaccccaccgtgcggaggaccctggtgtgcctgagcaagctgtaccgctgcatcgacagagctgtgttccagggcctgagccaggaggccctgagcgcctgcatccagagcctgctgggcgccagcgagagcatcagcaagaacaagacccagattgatggccagctgttcctgatcaagcacctgctgatcctgcgggagcagatcgcccccttccacacagagttcaccatcaaggagatcagcctggacctgaagaagaccagagatgctgccttcaagatcctgaaccccatgacagtgccccgcttcttccggctgaacagcaacaatgccctgattgagttcctgctggagggcaccccagagatccgggagcactacctggacagcaagaaggatgtggacagacacctgaagagcgcctgtgagcagttcatccagcagcagaccaagctgtttgtggagcagctggaggagttcatgaccaaggtgtctgccctgaagaccatggccagccagggcggccccaagtacaccctgagccagcagccctgggcccagcctgccaaggtgaatgacctggccgccacagcctacaagaccatcaagaccaagctgcctgtgaccctgcgctccatgagcctgtacctgagcaacaaggacacagagttcatcctcttcaagcctgtgaggaacaacatccagcaggtgttccagaagttccacgccctgctgaaggaggagttctccccagaggacatccagatcatcgcctgccccagcatggagcagctgagcctgctgctgctggtgtccaagtag

SEQ ID NO: 148352 - DNA, 2370 bp, Artificial Sequence
  Description of Artificial Sequence: Synthetic coding sequence
atgggcaccaagatggctgacctggacagcccccccaagctgtctggagtgcagcagcccagcgagggcgtgggcggcggccgctgcagcgagatctctgctgagctgatccgcagcctgacagagctgcaggagctggaggccgtgtatgaaaggctgtgtggggaggagaaggtggtggagcgggagctggatgccctgctggagcagcagaacaccatcgagagcaagatggtgaccctgcacaggatgggccccaacctgcagctgattgaaggagatgccaagcagctggccggcatgatcaccttcacctgcaacctggccgagaatgtgagcagcaaggtgcggcagctggacctggccaagaaccggctgtaccaggccatccagagagcagatgacatcctggacctgaagttctgcatggatggagtgcagacagccctgcggagtgaagattatgagcaggccgccgcccacacccaccgctacctgtgcctggacaagtctgtgattgagctgagccggcagggcaaggagggctccatgattgatgccaacctgaagctgctgcaggaggccgagcagaggctgaaggccatcgtggccgagaagtttgccatcgccaccaaggagggggacctgccccaggtggagcgcttcttcaagatcttccccctgctgggcctgcacgaggagggcctgaggaagttcagcgagtacctgtgcaagcaggtggccagcaaggccgaggagaacctgctgatggtgctgggcacagacatgtctgaccggcgggctgctgtgatctttgctgacaccctgaccctgctgtttgagggcatcgcccgcatcgtggagacccaccagcccatcgtggagacctactacggccctggccgcctgtacaccctcatcaagtacctgcaggtggagtgtgaccggcaggtggagaaggtggtggacaagttcatcaagcagagggactaccaccagcagttcagacatgtgcagaacaacctgatgaggaacagcaccacagagaagattgagccccgggagctggaccccatcctgacagaggtgaccctgatgaatgcccggtctgagctgtacctgcgcttcctgaagaagaggatcagcagtgactttgaggtgggggacagcatggccagcgaggaggtgaagcaggagcaccagaagtgcctggacaagctgctgaacaactgcctgctgagctgcaccatgcaggagctgattggcctgtatgtgaccatggaggagtacttcatgagggagaccgtgaacaaggctgtggccctggacacctatgagaagggccagctgaccagctccatggtggatgatgtgttctacatcgtgaagaagtgcatcggccgggccctgagcagcagcagcattgactgcctgtgtgccatgatcaacctggccaccacagagctggagagtgacttcagagatgtgctgtgcaacaagctgaggatgggcttccctgccaccaccttccaggacatccagaggggcgtgaccagcgctgtgaacatcatgcacagcagcctgcagcagggcaagtttgacaccaagggcatcgagagcacagatgaggccaagatgtccttcctggtgaccctgaacaacgtggaggtgtgcagcgagaacatcagcaccctgaagaagaccctggagagtgactgcaccaagctgttcagccagggcattggaggagagcaggcccaggccaagtttgacagctgcctgagtgacctggccgctgtgagcaacaagttccgggacctgctgcaggagggcctgacagagctgaacagcacagccatcaagccccaggtgcagccctggatcaacagcttcttctctgtgagccacaacatcgaggaggaggagttcaatgactatgaggccaatgacccctgggtgcagcagttcatcctgaacctggagcagcagatggccgagttcaaggccagcctgagccctgtgatctatgacagcctgaccggcctgatgaccagcctggtggccgtggagctggagaaggtggtgctgaagagcaccttcaaccggctgggcggcctgcagtttgacaaggagctgcggagcctcatcgcctacctgaccaccgtgaccacctggaccatccgggacaagtttgcccggctgagccagatggccaccatcctgaacctggagcgggtgacagagatcctggactactggggccccaacagcggccccctgacctggaggctgaccccagctgaggtgcggcaggtgctggccctgagaattgacttccgctctgaggacatcaagaggctgcggctgtag

SEQ ID NO: 148353 - DNA, 2295 bp, Artificial Sequence
  Description of Artificial Sequence: Synthetic coding sequence
atggctgacctggacagcccccccaagctgtctggagtgcagcagcccagcgagggcgtgggcggcggccgctgcagcgagatctctgctgagctgatccgcagcctgacagagctgcaggagctggaggccgtgtatgaaaggctgtgtggggaggagaaggtggtggagcgggagctggatgccctgctggagcagcagaacaccatcgagagcaagatggtgaccctgcacaggatgggccccaacctgcagctgattgaaggagatgccaagcagctggccggcatgatcaccttcacctgcaacctggccgagaatgtgagcagcaaggtgcggcagctggacctggccaagaaccggctgtaccaggccatccagagagcagatgacatcctggacctgaagttctgcatggatggagtgcagacagccctgcggagtgaagattatgagcaggccgccgcccacacccaccgctacctgtgcctggacaagtctgtgattgagctgagccggcagggcaaggagggctccatgattgatgccaacctgaagctgctgcaggaggccgagcagaggctgaaggccatcgtggccgagaagtttgccatcgccaccaaggagggggacctgccccaggtggagcgcttcttcaagatcttccccctgctgggcctgcacgaggagggcctgaggaagttcagcgagtacctgtgcaagcaggtggccagcaaggccgaggagaacctgctgatggtgctgggcacagacatgtctgaccggcgggctgctgtgatctttgctgacaccctgaccctgctgtttgagggcatcgcccgcatcgtggagacccaccagcccatcgtggagacctactacggccctggccgcctgtacaccctcatcaagtacctgcaggtggagtgtgaccggcaggtggagaaggtggtggacaagttcatcaagcagagggactaccaccagcagttcagacatgtgcagaacaacctgatgaggaacagcaccacagagaagattgagccccgggagctggaccccatcctgacagaggtgaccctgatgaatgcccggtctgagctgtacctgcgcttcctgaagaagaggatcagcagtgactttgaggtgggggacagcatggccagcgaggaggtgaagcaggagcaccagaagtgcctggacaagctgctgaacaactgcctgctgagctgcaccatgcaggagctgattggcctgtatgtgaccatggaggagtacttcatgagggagaccgtgaacaaggctgtggccctggacacctatgagaagggccagctgaccagctccatggtggatgatgtgttctacatcgtgaagaagtgcatcggccgggccctgagcagcagcagcattgactgcctgtgtgccatgatcaacctggccaccacagagctggagagtgacttcagagatgtgctgtgcaacaagctgaggatgggcttccctgccaccaccttccaggacatccagaggggcgtgaccagcgctgtgaacatcatgcacagcagcctgcagcagggcaagtttgacaccaagggcatcgagagcacagatgaggccaagatgtccttcctgagtgactgcaccaagctgttcagccagggcatcggcggggagcaggcccaggccaagtttgacagctgcctgagtgacctggccgctgtgagcaacaagttccgggacctgctgcaggagggcctgacagagctgaacagcacagccatcaagccccaggtgcagccctggatcaacagcttcttctctgtgagccacaacatcgaggaggaggagttcaatgactatgaggccaatgacccctgggtgcagcagttcatcctgaacctggagcagcagatggccgagttcaaggccagcctgagccctgtgatctatgacagcctgaccggcctgatgaccagcctggtggccgtggagctggagaaggtggtgctgaagagcaccttcaaccggctgggcggcctgcagtttgacaaggagctgcggagcctgattgcctacctgaccaccgtgaccacctggaccatccgggacaagtttgcccggctgagccagatggccaccatcctgaacctggagcgggtgacagagatcctggactactggggccccaacagcggccccctgacctggaggctgaccccagctgaggtgcggcaggtgctggccctgagaattgacttccgctctgaggacatcaagaggctgcggctgtag

SEQ ID NO: 148354 - DNA, 1014 bp, Artificial Sequence
  Description of Artificial Sequence: Synthetic coding sequence
atggctgacctggacagcccccccaagctgtctggagtgcagcagcccagcgagggcgtgggcggcggccgctgcagcgagatctctgctgagctgatccgcagcctgacagagctgcaggagctggaggccgtgtatgaaaggctgtgtggggaggagaaggtggtggagcgggagctggatgccctgctggagcagcagaacaccatcgagagcaagatggtgaccctgcacaggatgggccccaacctgcagctgattgaaggagatgccaagcagctggccggcatgatcaccttcacctgcaacctggccgagaatgtgagcagcaaggtgcggcagctggacctggccaagaaccggctgtaccaggccatccagagagcagatgacatcctggacctgaagttctgcatggatggagtgcagacagccctgcggagtgaagattatgagcaggccgccgcccacacccaccgctacctgtgcctggacaagtctgtgattgagctgagccggcagggcaaggagggctccatgattgatgccaacctgaagctgctgcaggaggccgagcagaggctgaaggccatcgtggccgagaagtttgccatcgccaccaaggagggggacctgccccaggtggagcgcttcttcaagatcttccccctgctgggcctgcacgaggagggcctgaggaagttcagcgagtacctgtgcaagcaggtggccagcaaggccgaggagaacctgctgatggtgctgggcacagacatgtctgaccggcgggctgctgtgatctttgctgacaccctgaccctgctgtttgagggcatcgcccgcatcgtggagacccaccagcccatcgtggagacctactacggccctggccgcctgtacaccctcatcaagtacctgcaggtggagtgtgaccggcaggtggagaaggtggtggacaagttcatcaagcagagggactaccaccagcagaactttgtgttctccttcttctag

SEQ ID NO: 148355 - DNA, 1344 bp, Artificial Sequence
  Description of Artificial Sequence: Synthetic coding sequence
atgaggaacagcaccacagagaagattgagccccgggagctggaccccatcctgacagaggtgaccctgatgaatgcccggtctgagctgtacctgcgcttcctgaagaagaggatcagcagtgactttgaggtgggggacagcatggccagcgaggaggtgaagcaggagcaccagaagtgcctggacaagctgctgaacaactgcctgctgagctgcaccatgcaggagctgattggcctgtatgtgaccatggaggagtacttcatgagggagaccgtgaacaaggctgtggccctggacacctatgagaagggccagctgaccagctccatggtggatgatgtgttctacatcgtgaagaagtgcatcggccgggccctgagcagcagcagcattgactgcctgtgtgccatgatcaacctggccaccacagagctggagagtgacttcagagatgtgctgtgcaacaagctgaggatgggcttccctgccaccaccttccaggacatccagaggggcgtgaccagcgctgtgaacatcatgcacagcagcctgcagcagggcaagtttgacaccaagggcatcgagagcacagatgaggccaagatgtccttcctggtgaccctgaacaacgtggaggtgtgcagcgagaacatcagcaccctgaagaagaccctggagagtgactgcaccaagctgttcagccagggcattggaggagagcaggcccaggccaagtttgacagctgcctgagtgacctggccgctgtgagcaacaagttccgggacctgctgcaggagggcctgacagagctgaacagcacagccatcaagccccaggtgcagccctggatcaacagcttcttctctgtgagccacaacatcgaggaggaggagttcaatgactatgaggccaatgacccctgggtgcagcagttcatcctgaacctggagcagcagatggccgagttcaaggccagcctgagccctgtgatctatgacagcctgaccggcctgatgaccagcctggtggccgtggagctggagaaggtggtgctgaagagcaccttcaaccggctgggcggcctgcagtttgacaaggagctgcggagcctcatcgcctacctgaccaccgtgaccacctggaccatccgggacaagtttgcccggctgagccagatggccaccatcctgaacctggagcgggtgacagagatcctggactactggggccccaacagcggccccctgacctggaggctgaccccagctgaggtgcggcaggtgctggccctgagaattgacttccgctctgaggacatcaagaggctgcggctgtag

SEQ ID NO: 148356 - DNA, 2583 bp, Artificial Sequence
  Description of Artificial Sequence: Synthetic coding sequence
atgggctgggtgggcggcagaagaagagattctgccagccccccaggccgcagccgctctgctgctgatgacatcaacccagccccagccaacatggagggcggcggcggctctgtggccgtggccggcctgggcgcccggggcagcggggctgctgctgccaccgtgcgggagctgctgcaggacggctgctacagcgacttcctgaatgaagattttgatgtgaagacctacaccagccagagcatccaccaggccgtgattgctgagcagctggccaagctggcccagggcatcagccagctggaccgggagctgcacctgcaggtggtggcccggcatgaggacctgctggcccaggccaccggcatcgagagcctggagggcgtgctgcagatgatgcagacccgcatcggggccctgcagggcgctgtggaccgcatcaaggccaagatcgtggagccctacaacaagatcgtggccaggacagcccagctggcccggctgcaggtggcctgtgacctgctgcggcgcatcatccgcatcctgaacctgagcaagaggctgcagggccagctgcagggcggcagccgggagatcaccaaggccgcccagagcctgaatgagctggactacctgagccagggcatcgacctgagcggcatcgaggtgattgaaaatgacctgctcttcatcgcccgggcccggctggaggtggagaaccaggccaagaggctgctggagcagggcctggagacccagaaccccacccaggtgggcacagccctgcaggtgttctacaacctgggcaccctgaaggacaccatcacctctgtggtggatggctactgtgccaccctggaggagaacatcaacagcgccctggacatcaaggtgctgacccagcccagccagagcgctgtgcggggcggccctggccgcagcaccatgcccaccccaggcaacacagctgccctgcgggccagcttctggaccaacatggagaagctgatggaccacatctatgctgtgtgtggccaggtgcagcacctgcagaaggtgctggccaagaagagggaccctgtgagccacatctgcttcatcgaggagatcgtgaaggatggccagcctgagatcttctacaccttctggaacagcgtgacccaggccctgagcagccagttccacatggccaccaacagctccatgttcctgaagcaggcctttgaaggagagtaccccaagctgctgcggctgtacaatgacctgtggaagaggctgcagcagtacagccagcacatccagggcaacttcaatgccagcggcaccacagacctgtatgtggacctgcagcacatggaggatgatgcccaggacatcttcatccccaagaagccagactatgaccctgagaaggccctgaaggacagcctgcagccctatgaagctgcctacctgagcaagagcctgagccggctgtttgaccccatcaacctggtgttccccccaggcggcaggaacccccccagcagtgatgagctggatggcatcatcaagaccatcgccagcgagctgaatgtggccgctgtggacaccaacctgaccctggccgtgtccaagaatgtggccaagaccatccagctgtacagcgtgaagtctgagcagctgctgagcacccagggagatgccagccaggtgattggccccctgacagagggccagaggagaaatgtggccgtggtgaacagcctgtacaagctgcaccagagcgtgaccaaggtggtgagcagccagagcagcttccccctggccgctgagcagaccatcatcagcgccctgaaggccatccacgccctgatggagaatgctgtgcagcccctgctgacctctgtgggagatgccatcgaggccatcatcatcaccatgcaccaggaggacttcagcggcagcctgagcagcagcggcaagccagatgtgccctgcagcctgtacatgaaggagctgcagggcttcatcgcccgggtgatgtctgactacttcaagcactttgagtgcctggactttgtgtttgacaacacagaggccatcgcccagagagctgtggagctgttcatcagacatgccagcctcatccggcccctgggggagggcggcaagatgaggctggccgctgactttgcccagatggagctggccgtgggccccttctgccggcgggtgtctgacctgggcaagagctacaggatgctgcggagcttccggcccctgctcttccaggccagcgagcacgtggccagcagccctgccctgggagatgtgatccccttcagcatcatcatccagttcctgttcacccgggccccagctgagctgaagagccccttccagagagctgagtggagccacacccgcttcagccagtggctggatgaccaccccagcgagaaggaccggctgctgctgatccggggggccctggaggcctacgtgcagagcgtgcgcagccgggagggcaaggagtttgcccctgtgtaccccatcatggtgcagctgctgcagaaggccatgtctgccctgcagtag

SEQ ID NO: 148357 - DNA, 2520 bp, Artificial Sequence
  Description of Artificial Sequence: Synthetic coding sequence
atgggctgggtgggcggcagaagaagagattctgccagccccccaggccgcagccgctctgctgctgatgacatcaacccagccccagccaacatggagggcggcggcggctctgtggccgtggccggcctgggcgcccggggcagcggggctgctgctgccaccgtgcgggagctgctgcaggacggctgctacagcgacttcctgaatgaagattttgatgtgaagacctacaccagccagagcatccaccaggccgtgattgctgagcagctggccaagctggcccagggcatcagccagctggaccgggagctgcacctgcaggtggtggcccggcatgaggacctgctggcccaggccaccggcatcgagagcctggagggcgtgctgcagatgatgcagacccgcatcggggccctgcagggcgctgtggaccgcatcaaggccaagatcgtggagccctacaacaagatcgtggccaggacagcccagctggcccggctgcaggtggcctgtgacctgctgcggcgcatcatccgcatcctgaacctgagcaagaggctgcagggccagctgcagggcggcagccgggagatcaccaaggccgcccagagcctgaatgagctggactacctgagccagggcatcgacctgagcggcatcgaggtgattgaaaatgacctgctcttcatcgcccgggcccggctggaggtggagaaccaggccaagaggctgctggagcagggcctggagacccagaaccccacccaggtgggcacagccctgcaggtgttctacaacctgggcaccctgaaggacaccatcacctctgtggtggatggctactgtgccaccctggaggagaacatcaacagcgccctggacatcaaggtgctgacccagcccagccagagcgctgtgcggggcggccctggccgcagcaccatgcccaccccaggcaacacagctgccctgcgggccagcttctggaccaacatggagaagctgatggaccacatctatgctgtgtgtggccaggtgcagcacctgcagaaggtgctggccaagaagagggaccctgtgagccacatctgcttcatcgaggagatcgtgaaggatggccagcctgagatcttctacaccttctggaacagcgtgacccaggccctgagcagccagttccacatggccaccaacagctccatgttcctgaagcaggcctttgaaggagagtaccccaagctgctgcggctgtacaatgacctgtggaagaggctgcagcagtacagccagcacatccagggcaacttcaatgccagcggcaccacagacctgtatgtggacctgcagcacatggaggatgatgcccaggacatcttcatccccaagaagccagactatgaccctgagaaggccctgaaggacagcctgcagccctatgaagctgcctacctgagcaagagcctgagccggctgtttgaccccatcaacctggtgttccccccaggcggcaggaacccccccagcagtgatgagctggatggcatcatcaagaccatcgccagcgagctgaatgtggccgctgtggacaccaacctgaccctggccgtgtccaagaatgtggccaagaccatccagctgtacagcgtgaagtctgagcagctgctgagcacccagggagatgccagccaggtgattggccccctgacagagggccagaggagaaatgtggccgtggtgaacagcctgtacaagctgcaccagagcgtgaccaaggccatccacgccctgatggagaatgctgtgcagcccctgctgacctctgtgggagatgccatcgaggccatcatcatcaccatgcaccaggaggacttcagcggcagcctgagcagcagcggcaagccagatgtgccctgcagcctgtacatgaaggagctgcagggcttcatcgcccgggtgatgtctgactacttcaagcactttgaatgtctggactttgtgtttgacaacacagaggccatcgcccagagagctgtggagctgttcatcagacatgccagcctcatccggcccctgggggagggcggcaagatgaggctggccgctgactttgcccagatggagctggccgtgggccccttctgcagaagagtgtctgacctgggcaagagctacaggatgctgcgctccttccggcccctgctcttccaggccagcgagcacgtggccagcagccctgccctgggagatgtgatccccttcagcatcatcatccagttcctgttcacccgggccccagctgagctgaagagccccttccagagagctgagtggagccacacccgcttcagccagtggctggatgaccaccccagcgagaaggaccggctgctgctgatccggggggccctggaggcctacgtgcagagcgtgcgcagccgggagggcaaggagtttgcccctgtgtaccccatcatggtgcagctgctgcagaaggccatgtctgccctgcagtag

SEQ ID NO: 148358 - DNA, 2472 bp, Artificial Sequence
  Description of Artificial Sequence: Synthetic coding sequence
atgggctgggtgggcggcagaagaagagattctgccagccccccaggccgcagccgctctgctgctgatgacatcaacccagccccagccaacatggagggcggcggcggctctgtggccgtggccggcctgggcgcccggggcagcggggctgctgctgccaccgtgcgggagctgctgcaggacggctgctacagcgacttcctgaatgaagattttgatgtgaagacctacaccagccagagcatccaccaggccgtgattgctgagcagctggccaagctggcccagggcatcagccagctggaccgggagctgcacctgcaggtggtggcccggcatgaggacctgctggcccaggccaccggcatcgagagcctggagggcgtgctgcagatgatgcagacccgcatcggggccctgcagggcgctgtggaccgcatcaaggccaagatcgtggagccctacaacaagatcgtggccaggacagcccagctggcccggctgcaggtggcctgtgacctgctgcggcgcatcatccgcatcctgaacctgagcaagaggctgcagggccagctgcagggcggcagccgggagatcaccaaggccgcccagagcctgaatgagctggactacctgagccagggcatcgacctgagcggcatcgaggtgattgaaaatgacctgctcttcatcgcccgggcccggctggaggtggagaaccaggccaagaggctgctggagcagggcctggagacccagaaccccacccaggtgggcacagccctgcaggtgttctacaacctgggcaccctgaaggacaccatcacctctgtggtggatggctactgtgccaccctggaggagaacatcaacagcgccctggacatcaaggtgctgacccagcccagccagagcgctgtgcggggcggccctggccgcagcaccatgcccaccccaggcaacacagctgccctgcgggccagcttctggaccaacatggagaagctgatggaccacatctatgctgtgtgtggccaggtgcagcacctgcagaaggtgctggccaagaagagggaccctgtgagccacatctgcttcatcgaggagatcgtgaaggatggccagcctgagatcttctacaccttctggaacagcgtgacccaggccctgagcagccagttccacatggccaccaacagctccatgttcctgaagcaggcctttgaaggagagtaccccaagctgctgcggctgtacaatgacctgtggaagaggctgcagcagtacagccagcacatccagggcaacttcaatgccagcggcaccacagacctgtatgtggacctgcagcacatggaggatgatgcccaggacatcttcatccccaagaagccagactatgaccctgagaaggccctgaaggacagcctgcagccctatgaagctgcctacctgagcaagagcctgagccggctgtttgaccccatcaacctggtgttccccccaggcggcaggaacccccccagcagtgatgagctggatggcatcatcaagaccatcgccagcgagctgaatgtggccgctgtggacaccaacctgaccctggccgtgtccaagaatgtggccaagaccatccagctgtacagcgtgaagtctgagcagctgctgagcacccagggagatgccagccaggtgattggccccctgacagagggccagaggagaaatgtggccgtggtgaacagcctgtacaagctgcaccagagcgtgaccaaggtggtgagcagccagagcagcttccccctggccgctgagcagaccatcatcagcgccctgaaggccatccacgccctgatggagaatgctgtgcagcccctgctgacctctgtgggagatgccatcgaggccatcatcatcaccatgcaccaggaggacttcagcggcagcctgagcagcagcggcaagccagatgtgccctgcagcctgtacatgaaggagctgcagggcttcatcgcccgggtgatgtctgactacttcaagcactttgagtgcctggactttgtgtttgacaacacagaggccatcgcccagagagctgtggagctgttcatcagacatgccagcctcatccggcccctgggggagggcggcaagatgaggctggccgctgactttgcccagatggagctggccgtgggccccttctgccggcgggtgtctgacctgggcaagagctacaggatgctgcggagcttccggcccctgctcttccaggccagcgagcacgtggccagcagccctgccctgggagatgtgatccccttcagcatcatcatccagttcctgttcacccgggccccagctgagctgaagagccccttccagagagctgagtggagccacacccgcttcagccagtggctggatgaccaccccagcgagaaggaccggctgctgctgatcagatag

SEQ ID NO: 148359 - DNA, 2067 bp, Artificial Sequence
  Description of Artificial Sequence: Synthetic coding sequence
atgaggggccgctttgcccacgcccagtacagccgctgcctgcggggcccctgcctggccgaggtggccgccggcggcggcaccaggtctgccatggccgagggcagcggggaggtggtggccgtgtctgccactggagctgccaacggcctgaacaatggagctgggggcaccagcgccaccacctgcaaccccctgagcaggaagctgcacaagatcctggagacccggctggacaatgacaaggagatgctggaggccctgaaggccctgagcaccttctttgtggagaacagcctgcggaccaggaggaacctgcggggggacatcgagaggaagagcctggccatcaatgaggagtttgtgtccatcttcaaggaggtgaaggaggagctggagagcatcagtgaagatgtgcaggccatgagcaactgctgccaggacatgaccagccggctgcaggccgccaaggagcagacccaggacctgattgtgaagaccaccaagctgcagagcgagagccagaagctggagatccgggcccaggtggctgatgccttcctgagcaagttccagctgaccagtgatgagatgagcctgctgcggggcacccgggagggccccatcacagaggacttcttcaaggccctgggccgggtgaagcagatccacaatgatgtgaaggtgctgctgcggaccaaccagcagacagctggcctggagatcatggagcagatggccctgctgcaggagacagcctatgaaagactctaccgctgggcccagagcgagtgcaggaccctgacccaggagagctgtgatgtgtcccctgtgctgacccaggccatggaggccctgcaggacaggcctgtgctgtacaagtacaccctggatgaatttggaacagcccggcgcagcacagtggtgcggggcttcattgatgccctgacccggggcggccctgggggcaccccccggcccatcgagatgcacagccatgaccccctgcgctacgtgggggacatgctggcctggctgcaccaggccacagccagcgagaaggagcacctggaggccctgctgaagcacgtgaccacccagggcgtggaggagaacatccaggaggtggtgggccacatcacagaaggagtgtgccggcccctgaaggtgcgcatcgagcaggtgattgtggccgagcccggggctgtgctgctgtacaagatcagcaacctgctgaagttctaccaccacaccatcagcggcatcgtgggcaacagcgccacagccctgctgaccaccatcgaggagatgcacctgctgagcaagaagatcttcttcaacagcctgagcctgcacgccagcaagctgatggacaaggtggagctgcccccaccagacctgggccccagcagcgccctgaaccagaccctgatgctgctgcgggaggtgctggccagccatgacagctctgtggtgcccctggatgcccggcaggccgactttgtgcaggtgctgagctgtgtgctggaccccctgctgcagatgtgcaccgtgtctgccagcaacctgggcacagctgacatggccaccttcatggtgaacagcctgtacatgatgaagaccaccctggccctgtttgagttcacagaccggcggctggagatgctgcagttccagatcgaggcccacctggacaccctcatcaatgagcaggccagctatgtgctgaccagggtgggcctgagctacatctacaacacagtgcagcagcacaagccagagcagggcagcctggccaacatgcccaacctggacagcgtgaccctgaaggccgccatggtgcagtttgaccgctacctgagcgccccagacaacctgctgatcccccagctgaacttcctgctgagcgccaccgtgaaggagcagatcgtgaagcagagcacagagctggtgtgccgggcctatggagaggtgtatgctgctgtgatgaaccccatcaatgagtacaaggaccctgagaacatcctgcacaggagcccccagcaggtgcagaccctgctgtcctag

SEQ ID NO: 148360 - DNA, 1848 bp, Artificial Sequence
  Description of Artificial Sequence: Synthetic coding sequence
atggccgagggcagcggggaggtggtggccgtgtctgccaccggggccgccaacggcctgaacaacggggccggcggcaccagcgccaccacctgcaaccccctgagcaggaagctgcacaagatcctggagacccggctggacaatgacaaggagatgctggaggccctgaaggccctgagcaccttctttgtggagaacagcctgcggaccaggaggaacctgcggggggacattgaaaggaagagcctggccatcaatgaggagtttgtgtccatcttcaaggaggtgaaggaggagctggagagcatcagtgaagatgtgcaggccatgagcaactgctgccaggacatgaccagccggctgcaggccgccaaggagcagacccaggacctgattgtgaagaccaccaagctgcagagcgagagccagaagctggagatccgggcccaggtggctgatgccttcctgagcaagttccagctgaccagtgatgagatgagcctgctgcggggcacccgggagggccccatcacagaggacttcttcaaggccctgggccgggtgaagcagatccacaatgatgtgaaggtgctgctgcggaccaaccagcagacagctggcctggagatcatggagcagatggccctgctgcaggagacagcctatgagcggctgtaccgctgggcccagagtgaatgtaggaccctgacccaggagagctgtgatgtgtcccctgtgctgacccaggccatggaggccctgcaggacaggcctgtgctgtacaagtacaccctggatgaatttggaacagcccggcgcagcacagtggtgcggggcttcattgatgccctgacccggggcggccctgggggcaccccccggcccatcgagatgcacagccatgaccccctgcgctacgtgggggacatgctggcctggctgcaccaggccacagccagcgagaaggagcacctggaggccctgctgaagcacgtgaccacccagggcgtggaggagaacatccaggaggtggtgggccacatcacagagggcgtgtgccggcccctgaaggtgagaattgagcaggtgattgtggccgagcctggagctgtgctgctgtacaagatcagcaacctgctgaagttctaccaccacaccatctctggaattgtgggcaacagcgccacagccctgctgaccaccatcgaggagatgcacctgctgagcaagaagatcttcttcaacagcctgagcctgcacgccagcaagctgatggacaaggtggagctgcccccaccagacctgggccccagcagcgccctgaaccagaccctgatgctgctgcgggaggtgctggccagccatgacagctctgtggtgcccctggatgcccggcaggccgactttgtgcaggtgctgagctgtgtgctggaccccctgctgcagatgtgcaccgtgtctgccagcaacctgggcacagctgacatggccaccttcatggtgaacagcctgtacatgatgaagaccaccctggccctgtttgagttcacagaccggcggctggagatgctgcagttccagatcgaggcccacctggacaccctcatcaatgagcaggccagctatgtgctgaccagggtgggcctgagctacatctacaacacagtgcagcagcacaagccagagcagggcagcctggccaacatgcccaacctggacagcgtgaccctgaaggccgccatggtgcagtttgaccgctacctgagcgccccagacaacctgctgatcccccagctgaacttcctgctgagcgccaccgtgaagaggcccccaaatggcccctag

SEQ ID NO: 148361 - DNA, 1974 bp, Artificial Sequence
  Description of Artificial Sequence: Synthetic coding sequence
atggccgagggcagcggggaggtggtggccgtgtctgccaccggggccgccaacggcctgaacaacggggccggcggcaccagcgccaccacctgcaaccccctgagcaggaagctgcacaagatcctggagacccggctggacaatgacaaggagatgctggaggccctgaaggccctgagcaccttctttgtggagaacagcctgcggaccaggaggaacctgcggggggacattgaaaggaagagcctggccatcaatgaggagtttgtgtccatcttcaaggaggtgaaggaggagctggagagcatcagtgaagatgtgcaggccatgagcaactgctgccaggacatgaccagccggctgcaggccgccaaggagcagacccaggacctgattgtgaagaccaccaagctgcagagcgagagccagaagctggagatccgggcccaggtggctgatgccttcctgagcaagttccagctgaccagtgatgagatgagcctgctgcggggcacccgggagggccccatcacagaggacttcttcaaggccctgggccgggtgaagcagatccacaatgatgtgaaggtgctgctgcggaccaaccagcagacagctggcctggagatcatggagcagatggccctgctgcaggagacagcctatgagcggctgtaccgctgggcccagagtgaatgtaggaccctgacccaggagagctgtgatgtgtcccctgtgctgacccaggccatggaggccctgcaggacaggcctgtgctgtacaagtacaccctggatgaatttggaacagcccggcgcagcacagtggtgcggggcttcattgatgccctgacccggggcggccctgggggcaccccccggcccatcgagatgcacagccatgaccccctgcgctacgtgggggacatgctggcctggctgcaccaggccacagccagcgagaaggagcacctggaggccctgctgaagcacgtgaccacccagggcgtggaggagaacatccaggaggtggtgggccacatcacagagggcgtgtgccggcccctgaaggtgagaattgagcaggtgattgtggccgagcctggagctgtgctgctgtacaagatcagcaacctgctgaagttctaccaccacaccatctctggaattgtgggcaacagcgccacagccctgctgaccaccatcgaggagatgcacctgctgagcaagaagatcttcttcaacagcctgagcctgcacgccagcaagctgatggacaaggtggagctgcccccaccagacctgggccccagcagcgccctgaaccagaccctgatgctgctgcgggaggtgctggccagccatgacagctctgtggtgcccctggatgcccggcaggccgactttgtgcaggtgctgagctgtgtgctggaccccctgctgcagatgtgcaccgtgtctgccagcaacctgggcacagctgacatggccaccttcatggtgaacagcctgtacatgatgaagaccaccctggccctgtttgagttcacagaccggcggctggagatgctgcagttccagatcgaggcccacctggacaccctcatcaatgagcaggccagctatgtgctgaccagggtgggcctgagctacatctacaacacagtgcagcagcacaagccagagcagggcagcctggccaacatgcccaacctggacagcgtgaccctgaaggccgccatggtgcagtttgaccgctacctgagcgccccagacaacctgctgatcccccagctgaacttcctgctgagcgccaccgtgaaggagcagatcgtgaagcagagcacagagctggtgtgccgggcctacggggaggtgtatgctgctgtgatgaaccccatcaatgagtacaaggaccctgagaacatcctgcacaggagcccccagcaggtgcagaccctgctgtcctag

SEQ ID NO: 148362 - DNA, 2313 bp, Artificial Sequence
  Description of Artificial Sequence: Synthetic coding sequence
atggacttcagcaagttcctggctgatgactttgatgtgaaggagtggatcaatgctgccttccgggccggcagcaaggaggccgccagcggcaaggcagatggccatgctgccaccctggtgatgaagctgcagctgttcatccaggaggtgaaccacgctgtggaggagaccagccaccaggccctgcagaacatgcccaaggtgctgagagatgtggaggccctgaagcaggaggccagcttcctgaaggagcagatgatcctggtgaaggaggacatcaagaagtttgagcaggacaccagccagagcatgcaggtgctggtggagattgaccaggtgaagagcaggatgcagctggccgctgagagcctgcaggaggccgacaagtggagcaccctgtctgctgacatcgaggagaccttcaagacccaggacattgctgtgatcagcgccaagctgaccggcatgcagaacagcctgatgatgctggtggacaccccagactacagcgagaagtgtgtgcacctggaggccctgaagaaccggctggaggccctggccagcccccagatcgtggccgccttcaccagccaggccgtggaccagagcaaggtgtttgtgaaggtgttcacagaaattgacaggatgccccagctgctggcctactactacaagtgccacaaggtgcagctgctggccgcctggcaggagctgtgccagagcgacctgagcctggaccggcagctgaccggcctgtatgatgccctgctgggcgcctggcacacccagatccagtgggccacccaggtgttccagaagccccatgaggtggtgatggtgctgctgatccagaccctgggcgccctgatgcccagcctgcccagctgcctgagcaatggagtggagagagctggccctgagcaggagctgacccggctgctggagttctatgatgccacagcccactttgccaagggcctggagatggccctgctgccccacctgcacgagcacaacctggtgaaggtgacagagctggtggatgctgtgtatgacccctacaagccctaccagctgaagtacggggacatggaggagagcaacctgctgatccagatgtctgctgtgcccctggagcacggggaggtgattgactgtgtgcaggagctgagccacagcgtgaacaagctgtttggcctggccagcgctgctgtggacagatgtgtgcgcttcaccaacggcctgggcacctgtggcctgctgagcgccctgaagagcctgtttgccaagtatgtgtctgacttcaccagcaccctgcagagcatcaggaagaagtgcaagctggaccacatcccccccaacagcctcttccaggaggactggacagccttccagaacagcatccgcatcatcgccacctgtggggagctgctgcggcactgtggggactttgagcagcagctggccaaccgcatcctgagcacagctgggaagtacctgagtgacagctgcagccccaggagcctggccggcttccaggagagcatcctgacagacaagaagaacagcgccaagaacccctggcaggagtacaactacctgcagaaggacaacccagcagaatatgccagcctgatggagatcctgtacaccctgaaggagaagggcagcagcaaccacaacctgctggccgcccccagggctgccctgacccggctgaaccagcaggcccaccagctggcctttgattctgtgttcctgcgcatcaagcagcagctgctgctgatcagcaagatggacagctggaacacagctggcatcggggagaccctgacagatgagctgcctgccttcagcctgacccccctggagtacatcagcaacatcggccagtacatcatgagcctgcccctgaacctggagccctttgtgacccaggaggacagcgccctggagctggccctgcacgccggcaagctgcccttccccccagagcagggagatgagctgcctgagctggacaacatggctgacaactggctgggcagcatcgcccgggccaccatgcagacctactgtgatgccatcctgcagatccctgagctgagcccccacagcgccaagcagctggccacagacatcgactacctgatcaacgtgatggatgccctgggcctgcagcccagcaggaccctgcagcacatcgtgaccctgctgaagaccaggcctgaggactaccggcaggtgtccaagggcctgccccggcggctggccaccaccgtggccaccatgaggtctgtgaactactag

SEQ ID NO: 148363 - DNA, 1839 bp, Artificial Sequence
  Description of Artificial Sequence: Synthetic coding sequence
atggccacagctgccaccatccccagcgtggccacagccacagctgctgccctgggggaggtggaggatgagggcctgctggccagcctcttccgggaccgcttccctgaggcccagtggagggagaggccagatgtgggccgctacctgcgggagctgagcggcagcggcctggagcggctgcggcgggagcctgagcggctggccgaggagcgggcccagctgctgcagcagacccgggacctggcctttgccaactacaagaccttcatcagaggagcagaatgtacagagcgcatccaccggctgtttggagatgtggaggccagcctgggccgcctgctggaccggctgcccagcttccagcagagctgcaggaactttgtgaaggaggccgaggagatcagcagcaacagaaggatgaacagcctgaccctgaacagacacacagagatcctggagatcctggagatcccccagctgatggacacctgtgtgagaaattcctactatgaggaggccctggagctggccgcctacgtgcggcggctggagaggaagtacagcagcatccctgtgatccagggcatcgtgaatgaggtgcggcagagcatgcagctgatgctgagccagctgatccagcagctgcggaccaacatccagctgcctgcctgcctgcgggtgattggctacctgcggaggatggatgtgttcacagaagctgagctgcgggtgaagttcctgcaggccagagatgcctggctgcggagcatcctgacagccatccccaatgatgacccctacttccacatcaccaagaccatcgaggccagccgggtgcacctgtttgacatcatcacccagtaccgggccatcttcagtgatgaggaccccctgctgcccccagccatgggagagcacacagtgaatgaaagtgccatcttccacggctgggtgctgcagaaggtgtcccagttcctgcaggtgctggagacagacctgtaccggggcatcggcggccacctggacagcctgctgggccagtgcatgtacttcggcctgtccttcagccgggtgggcgctgacttccggggccagctggcccctgtgttccagagggtggccatcagcaccttccagaaggccatccaggagaccgtggagaagttccaggaggagatgaacagctacatgctgatcagcgccccagccatcctgggcaccagcaacatgcctgctgctgtgcctgccacccagcccggcaccctgcagccccccatggtgctgctggacttcccccccctggcctgcttcctgaacaacatcctggtggccttcaatgacctgcggctgtgctgccctgtggccctggcccaggatgtgactggagccctggaggatgccctggccaaggtgaccaagatcatcctggccttccacagagctgaggaggccgccttcagcagtggagagcaggagctgtttgtgcagttctgcaccgtcttcctggaggacctggtgccctacctgaaccgctgcctgcaggtgctcttccccccagcccagatcgcccagaccctgggcatcccccccacccagctgagcaaatatggcaacctgggccacgtgaacattggagccatccaggagcccctggccttcatcctgcccaagcgggagaccctcttcaccctggatgaccaggccctgggccctgagctgacagccccagcccctgagcccccagctgaggagccccggctggagcctgctggccctgcctgcccagagggcggccgggcagagacccaggccgagcccccatctgtgggcccctag

SEQ ID NO: 148364 - DNA, 2109 bp, Artificial Sequence
  Description of Artificial Sequence: Synthetic coding sequence
atggagagccccagcgccccaccccaccgctggtgcatcccctggcagaggctgctgctgacagccagcctgctgaccttctggaacccccccaccacagccaagctgaccatcgagagcacccccttcaacgtggccgagggcaaggaggtgctgctgctggtgcacaacctgccccagcacctgtttggctacagctggtacaagggggagcgggtggatggcaaccggcagatcatcggctacgtgattggcacccagcaggccaccccaggccctgcctacagcggccgggagatcatctacccaaatgccagcctgctgatccagaacatcatccagaatgacaccggcttctacaccctgcacgtgatcaagagtgacctggtgaatgaggaggccaccggccagttccgggtgtacccagagctgcccaagcccagcatcagcagcaacaacagcaagcctgtggaggacaaggatgctgtggccttcacctgtgagcctgagacccaggatgccacctacctgtggtgggtgaacaaccagagcctgcctgtgagcccccggctgcagctgagcaatggaaacagaaccctgaccctcttcaacgtgaccagaaatgacacagccagctacaagtgtgagacccagaaccctgtgtctgcccggcggagtgacagcgtcatcctgaatgtgctgtatggcccagatgcccccaccatcagccccctgaacaccagctacagaagtggagagaacctgaacctgagctgccacgccgccagcaaccccccagcccagtacagctggtttgtgaatggcaccttccagcagagcacccaggagctgttcatccccaacatcaccgtgaacaacagcggcagctacacctgccaggcccacaacagcgacaccggcctgaacagaaccaccgtgaccaccatcaccgtgtatgcagagccccccaagcccttcatcaccagcaacaacagcaaccctgtggaggatgaagatgctgtggccctgacctgtgagcctgagatccagaacaccacctacctgtggtgggtgaacaaccagagcctgcctgtgagcccccggctgcagctgagcaatgacaacagaaccctgaccctgctgtctgtgaccagaaatgatgtgggcccctatgaatgtggcatccagaacaagctgtctgtggaccacagcgaccccgtcatcctgaatgtgctgtatggcccagatgaccccaccatcagccccagctacacctactacagacctggggtgaacctgagcctgagctgccacgccgccagcaaccccccagcccagtacagctggctgattgatggcaacatccagcagcacacccaggagctgttcatcagcaacatcacagagaagaacagcggcctgtacacctgccaggccaacaacagcgccagcggccacagcaggaccaccgtgaagaccatcaccgtgtctgctgagctgcccaagcccagcatcagcagcaacaacagcaagcctgtggaggacaaggatgctgtggccttcacctgtgagcctgaggcccagaacaccacctacctgtggtgggtgaatggccagagcctgcctgtgagcccccggctgcagctgagcaatggaaacagaaccctgaccctcttcaacgtgaccagaaatgatgcccgggcctacgtgtgtggcatccagaacagcgtgtctgccaacagaagtgaccctgtgaccctggatgtgctgtatggccctgacacccccatcatcagccccccagacagcagctacctgagcggggccaacctgaacctgagctgccacagcgccagcaaccccagcccccagtacagctggaggatcaatggcatcccccagcagcacacccaggtgctcttcatcgccaagatcacccccaacaacaacggcacctacgcctgctttgtgagcaacctggccaccggcaggaacaacagcatcgtgaagagcatcaccgtgtctgccagcggcaccagccctggcctgtctgctggggccaccgtgggcatcatgattggagtgctggtgggcgtggccctgatctag

SEQ ID NO: 148365 - DNA, 981 bp, Artificial Sequence
  Description of Artificial Sequence: Synthetic coding sequence
atgatggcctacatgaaccctggcccccactacagcgtgaatgccctggccctgagcggccccagcgtggacctgatgcaccaggccgtgccctaccccagcccccccctggccctggaccccccccggcggcagaggcaggagaggacagtgtacacagagagccagcagaaggtgctggagttctacttccagaaggaccagtaccccaactatgaccagaggctgaacctggccgagatgctgagcctgcgggagcagcagctgcaggtgtggttcaagaacagaagagccaagctggcccgggagcggcggctgcagcagcagccccagagggtgcccggccagaggggccgcggggcccgggccgcccccctggtgcctgtggccgccgccagcttccctgggggccctgagttcccccagggccggggctcctggatcagcccccagcccggcccctggggcgtgctgcctgctgctgagcccaagatctacagcctgcccaggacctggggcggcccagaatgtggcacccaggagggcctgaaggctgtgcctgcccctggccctggccccatcccagcccccatccctggccctgcccagatccctggccctgtgcccggccctgcccccaacctgggccccatgagcggccccctgtctgtgtccatccctggccccatcccagcccccatcagctgccccggccccatcccagaccctgtgctgggccgcaccctgatgcctggccctggcagcctgcccaccccagcccctggggccctgtggccccagagcccctatgccagcaacctgagcccagacacccagctgtacccagacttcaccaagctgctgcccctgctggacagatttgaggagagcagcctgagcaccaccaccagccagtacaaggaggaggatggctttgtggacaagaaccacagcgtgcccaggagcctgctggacctgtag

SEQ ID NO: 148366 - DNA, 900 bp, Artificial Sequence
  Description of Artificial Sequence: Synthetic coding sequence
atgatggcctacatgaaccctggcccccactacagcgtgaatgccctggccctgagcggccccagcgtggacctgatgcaccaggccgtgccctaccccagcgcccccaggaagcagaggcgggagaggaccaccttcaccaggagccagctggaggagctggaggccctgtttgccaagacccagtacccagatgtgtatgcccgggaggaggtggccctgaagatcaacctgcctgagagccgggtgcaggtgtggttcaagaacagaagagccaagtgccggcagcagaggcagcagcagaagcagcagcagcagcccccaggcggccaggccaaggcccggcctgccaagaggaaggccggcaccagcccccggcccagcacagatgtgtgcccagaccccctgggcatcagtgacagctacagcccccccctgcccggccccagcggcagccccaccacagctgtggccaccgtgtccatctggagccctgccagcgagagccccctgcctgaggcccagagagctggcctggtggccagcggccccagcctgaccagcgccccctatgccatgacctacgccccagccagcgccttctgcagcagccccagcgcctacggcagccccagcagctacttcagcggcctggacccctacctgagccccatggtgccccagctgggcggccctgccctgagccccctgagcggccccagcgtgggccccagcctggcccagagccccaccagcctgagcggccagagctatggagcctacagccctgtggacagcctggagttcaaggaccccaccggcacctggaagttcacctacaaccccatggaccccctggactacaaggaccagagcgcctggaagttccagatcctgtag

SEQ ID NO: 148367 - DNA, 900 bp, Artificial Sequence; identical to SEQ ID NO: 148366
  Description of Artificial Sequence: Synthetic coding sequence

SEQ ID NO: 148368 - DNA, 900 bp, Artificial Sequence; identical to SEQ ID NO: 148366
  Description of Artificial Sequence: Synthetic coding sequence

SEQ ID NO: 148369 - DNA, 3678 bp, Artificial Sequence
  Description of Artificial Sequence: Synthetic coding sequence
atggctgctgtgctggagagcctgctgcgggaggaggtgtctgtggccgctgtggtgcgctggatcgcccggagcacccagggcagcgaggacaatgctggggaggccgccgccctgagcagcctgcgggccctgaggaaggagtttgtgcccttcctgctgaacttcctgcgggagcagagcagccgggtgctgccccagggcccccccaccccagccaagacccctggggccagcgctgccctgcccggccggcctgggggccccccccggggcagcagaggagcccggagccagctgttccccccaacagaggcccagagcacagctgctgaggcccccctggccaggagaggaggaagaagaagaggccctggccctgcccgggagcggggcggccggggcctggaggagggcgtgtctggagagagcctgcccggggccggcggccgccgcctgcggggcagcggcagccccagccggcccagcctgaccctgagtgacccccccaacctgagcaacctggaggagttcccccctgtgggctctgtgcccccaggccccacagagacccagctgagctgccgccgctgggtgccccggcggctgtggggcgtgagccacagcagcagcgccctgcggagcggggcccctggctgcaggaccaagcccagccgccgcatcaaccccacccctgtgtctgaggagaggagcctgagcaagcccaagacctgcttcaccagcccccccatcagctgtgtgcccagcagcaagcagctgcagcagagccccacccccacctgccccaccccagagctgggcagccccctgcccagcaggacaggcagcctgacagatgagcctgctgaccctgcccgggtgagcagccggcagaggctggagctggtggccctggtgtacagcagctgcatcgccgagaacctggtgcccaacctcttcctggagctgttctttgtgttccagctgctgacagcccggaggatggtgacagccaaggacagcgaccctgagctgagccctgctgtgctggacagcctggagagccccctcttccagagcatccatgactgtgtgttctttgctgtgcaggtgctggagtgccacttccaggtgctgagcaacctggacaagggcaccctgaagctgctggccgagaatgaaaggctgctgtgcttctccccagccctgcagggccgcctgcgggccgcctatgagggctctgtggccaaggtgtccctggtgatgccacccagcacccaggccgtgtccttccagcctgagacagacaacagagccaacttcagcagtgaccgggccttccacaccttcaagaagcagagagatgtgttctatgaggtgctgcgggagtgggaggaccaccacgaggagcccggctgggactttgagaagggcctgggcagccgcatccgggccatgatgggccagctgtctgctgcctgcagccacagccactttgtgcggctcttccagaagcagctgctgcagatgtgccagagccctgggggcgccggcggcaccgtgctgggggaggccccagatgtgctgtccatgctgggcgctgacaagctgggccgcctgtggaggctgcaggagcggctgatggccccccagagcagcggcggcccctgccccccacccaccttccctggctgccagggcttcttccgggacttcatcctgagcgccagcagcttccagttcaaccagcacctgatggacagcctgagcctgaagatccaggagctgaatggcctggccctgccccagcacgagcccaatgatgaagatggagagagtgatgtggactggcagggcgagaggaagcagtttgctgtggtgctgctgagcctgcggctgctggccaagttcctgggctttgtggccttcctgccctaccggggccctgagcccccacccaccggggagctgcaggacagcatcctggccctgcggagccaggtgccccctgtgctggatgtgaggaccctgctgcagaggggcctgcaggccaggagagctgtgctgactgtgccctggctggtggagttcctgagctttgctgaccacgtggtgcccctgctggagtactacagagacatcttcaccctgctgctgcggctgcacaggagcctggtgctgagccaggagagcgagggcaagatgtgcttcctgaacaagctgctgctgctggccgtgctgggctggctgttccagatccccaccgtgcctgaggacctcttcttcctggaggagggccccagctatgcctttgaggtggacacagtggcccctgagcacggcctggacaatgcccctgtggtggaccagcagctgctgtacacctgctgcccctacatcggggagctgaggaagctgctggcctcctgggtgtctggcagcagcggccgcagcggcggcttcatgaggaagatcacccccaccaccaccaccagcctgggcgcccagcccagccagaccagccagggcctgcaggcccagctggcccaggccttcttccacaaccagccccccagcctgcggaggacagtggagtttgtggccgagagaattggcagcaactgtgtgaagcacatcaaggccaccctggtggccgacctggtgcggcaggccgagagcctgctgcaggagcagctggtgacccagggcgaggagggcggggaccctgcccagctgctggagatcctgtgcagccagctgtgcccccatggagcccaggccctggccctgggccgggagttctgccagaggaagagccctggagctgtgcgggccctgctgcctgaggagaccccagctgctgtgctgagcagcgctgagaacattgctgtgggcctggccacagagaaggcctgtgcctggctgagcgccaacatcacagccctgatccggcgggaggtgaaggctgctgtgtccaggaccctgcgggcccagggccctgagcctgctgcccggggggagcggcggggctgcagccgggcctgtgagcaccacgcccccctgcccagccacctgatcagcgagatcaaggatgtgctgagcctggccgtgggcccccgggaccctgatgaaggagtgtccccagagcacctggagcagctgctgggccagctgggccagaccctgcgctgccggcagttcctgtgccccccagctgagcagcacctggccaagtgcagcgtggagctggccagcctgctggtggccgaccagatccccatcctgggccccccagcccagtaccgcctggagcggggccaggcccggcggctgctgcacatgctgctgagcctgtggaaggaggacttccagggccctgtgcccctgcagctgctgctgagccccagaaatgtgggcctgctggccgacacccggccccgggagtgggacctgctgctcttcctgctgcgggagctggtggagaagggcctgatgggccgcatggagattgaggcctgcctgggcagcctgcaccaggcccagtggccaggggactttgctgaggagctggccaccctgagcaacctcttcctggccgagccccacctgcctgagccccagctgcgggcctgtgagctggtgcagcccaacagaggcaccgtgctggcccagagctag

SEQ ID NO: 148370 - DNA, 3684 bp, Artificial Sequence
  Description of Artificial Sequence: Synthetic coding sequence
atggctgctgtgctggagagcctgctgcgggaggaggtgtctgtggccgctgtggtgcgctggatcgcccggagcacccagggcagcgaggacaatgctggggaggccgccgccctgagcagcctgcgggccctgaggaaggagtttgtgcccttcctgctgaacttcctgcgggagcagagcagccgggtgctgccccagggcccccccaccccagccaagacccctggggccagcgctgccctgcccggccggcctgggggccccccccggggcagcagaggagcccggagccagctgttccccccaacagaggcccagagcacagctgctgaggcccccctggccaggagaggaggaagaagaagaggccctggccctgcccgggagcggggcggccggggcctggaggagggcgtgtctggagagagcctgcccggggccggcggccgccgcctgcggggcagcggcagccccagccggcccagcctgaccctgagtgacccccccaacctgagcaacctggaggagttcccccctgtgggctctgtgcccccaggccccaccggcaccaagcccagccgccgcatcaaccccacccctgtgtctgaggagaggagcctgagcaagcccaagacctgcttcaccagcccccccatcagctgtgtgcccagcagccagcccagcgccctggacaccagcccctggggcctgggcctgcccccaggctgccgcagcctgcaggaggagcgggagatgctgaggaaggagaggagcaagcagctgcagcagagccccacccccacctgccccaccccagagctgggcagccccctgcccagcaggacaggcagcctgacagatgagcctgctgaccctgcccgggtgagcagccggcagaggctggagctggtggccctggtgtacagcagctgcatcgccgagaacctggtgcccaacctcttcctggagctgttctttgtgttccagctgctgacagcccggaggatggtgacagccaaggacagcgaccctgagctgagccctgctgtgctggacagcctggagagccccctcttccagagcatccatgactgtgtgttctttgctgtgcaggtgctggagtgccacttccaggtgctgagcaacctggacaagggcaccctgaagctgctggccgagaatgaaaggctgctgtgcttctccccagccctgcagggccgcctgcgggccgcctatgagggctctgtggccaaggtgtccctggtgatgccacccagcacccaggccgtgtccttccagcctgagacagacaacagagccaacttcagcagtgaccgggccttccacaccttcaagaagcagagagatgtgttctatgaggtgctgcgggagtgggaggaccaccacgaggagcccggctgggactttgagaagggcctgggcagccgcatccgggccatgatgggccagctgtctgctgcctgcagccacagccactttgtgcggctcttccagaagcagctgctgcagatgtgccagagccctgggggcgccggcggcaccgtgctgggggaggccccagatgtgctgtccatgctgggcgctgacaagctgggccgcctgtggaggctgcaggagcggctgatggccccccagagcagcggcggcccctgccccccacccaccttccctggctgccagggcttcttccgggacttcatcctgagcgccagcagcttccagttcaaccagcacctgatggacagcctgagcctgaagatccaggagctgaatggcctggccctgccccagcacgagcccaatgatgaagatggagagagtgatgtggactggcagggcgagaggaagcagtttgctgtggtgctgctgagcctgcggctgctggccaagttcctgggctttgtggccttcctgccctaccggggccctgagcccccacccaccggggagctgcaggacagcatcctggccctgcggagccaggtgccccctgtgctggatgtgaggaccctgctgcagaggggcctgcaggccaggagagctgtgctgactgtgccctggctggtggagttcctgagctttgctgaccacgtggtgcccctgctggagtactacagagacatcttcaccctgctgctgcggctgcacaggagcctggtgctgagccaggagagcgagggcaagatgtgcttcctgaacaagctgctgctgctggccgtgctgggctggctgttccagatccccaccgtgcctgaggacctcttcttcctggaggagggccccagctatgcctttgaggtggacacagtggcccctgagcacggcctggacaatgcccctgtggtggaccagcagctgctgtacacctgctgcccctacatcggggagctgaggaagctgctggcctcctgggtgtctggcagcagcggccgcagcggcggcttcatgaggaagatcacccccaccaccaccaccagcctgggcgcccagcccagccagaccagccagggcctgcaggcccagctggcccaggccttcttccacaaccagccccccagcctgcggaggacagtggagtttgtggccgagagaattggcagcaactgtgtgaagcacatcaaggccaccctggtggccgacctggtgcggcaggccgagagcctgctgcaggagcagctggtgacccagggcgaggagggcggggaccctgcccagctgctggagatcctgtgcagccagctgtgcccccatggagcccaggccctggccctgggccgggagttctgccagaggaagagccctggagctgtgcgggccctgctgcctgaggagaccccagctgctgtgctgagcagcgctgagaacattgctgtgggcctggccacagagaaggcctgtgcctggctgagcgccaacatcacagccctgatccggcgggaggtgaaggctgctgtgtccaggaccctgcgggcccagggccctgagcctgctgcccggggggagcggcggggctgcagccgggcctgtgagcaccacgcccccctgcccagccacctgatcagcgagatcaaggatgtgctgagcctggccgtgggcccccgggaccctgatgaaggagtgtccccagagcacctggagcagctgctgggccagctgggccagaccctgcgctgccggcagttcctgtgccccccagctgagcagcacctggccaagtgcagcgtggagctggccagcctgctggtggccgaccagatccccatcctgggccccccagcccagtaccgcctggagcggggccaggcccggcggctgctgcacatgctgctgagcctgtggaaggaggacttccagggccctgtgcccctgcagctgctgctgagccccagaaatgtgggcctgctggccgacacccggccccgggagtgggacctgctgctcttcctgctgcgggagctggtggagaagggcctgatgggccgcatggagattgaggcctgcctgggcagcctgcaccaggcccagtggccaggggactttgctgaggagctggccaccctgagcaacctcttcctggccgagccccacctgcctgagccccagctgcgggcctgtgagctggtgcagcccaacagaggcaccgtgctggcccagagctag

SEQ ID NO: 148371 - DNA, 2697 bp, Artificial Sequence
  Description of Artificial Sequence: Synthetic coding sequence
atggccctgatcatggagcctgtgtccaagtggagccccagccaggtggtggactggatgaagggcctggatgactgcctgcagcagtacatcaagaactttgagcgggagaagatcagcggggaccagctgctgcgcatcacccaccaggagctggaggacctgggcgtgagccgcatcggccaccaggagctgatcctggaggccgtggacctgctgtgtgccctgaactacggcctggagacagagaacctgaagaccctgagccacaagctgaatgccagcgccaagaacctgcagaacttcatcaccggcagaagaagaagtggccactatgatggccgcaccagcaggaagctgcccaatgacttcctgacctctgtggtggacctgattggagctgccaagagcctgctggcctggctggacaggagcccctttgctgctgtgacagactacagcgtgaccagaaataatgtcatccagctgtgcctggagctgaccaccatcgtgcagcaggactgcaccgtgtatgaaacagagaacaagatcctgcacgtgtgcaagaccctgagcggcgtgtgtgaccacatcatcagcctgagcagtgaccccctggtgtcccagagcgcccacctggaggtgatccagctggccaacatcaagcccagcgagggcctgggcatgtacatcaagagcacctatgatggcctgcacgtgatcaccggcaccacagagaacagccctgctgaccgctgcaagaagatccacgccggagatgaggtgatccaggtgaaccaccagacagtggtgggctggcagctgaagaacctggtgaatgccctgcgggaggaccccagcggggtcatcctgaccctgaagaagaggccccagagcatgctgaccagcgccccagccctgctgaagaacatgcgctggaagcccctggccctgcagcccctcatccccaggagccccaccagctctgtggccacccccagcagcaccatcagcacccccaccaagagggacagcagcgccctgcaggacctgtacatccccccacctcctgctgagccctacatccccagagatgagaagggcaacctgccctgtgaggacctgcggggccacatggtgggcaagcctgtgcacaagggcagcgagagccccaacagcttcctggaccaggagtacaggaagcgcttcaacatcgtggaggaggacacagtgctgtactgctatgaatatgagaagggccgcagcagcagccagggcagaagagagagcacccccacctacggcaagctgcggcccatctccatgcctgtggagtacaactgggtgggggactatgaggaccccaacaagatgaagagggacagcagaagagagaacagcctgctgcgctacatgagcaatgagaagatcgcccaggaggagtacatgttccagaggaacagcaagaaggacaccgggaagaagagcaagaagaagggggacaagagcaacagccccacccactacagcctgctgcccagcctgcagatggatgccctgcggcaggacatcatgggcacccctgtgcctgagaccaccctgtaccacaccttccagcagagcagcctgcagcacaagagcaagaagaagaacaagggccccatcgccggcaagagcaagaggcgcatcagctgcaaggacctgggccgcggggactgtgagggctggctgtggaagaagaaggatgccaagagctacttcagccagaagtggaagaagtactggtttgtgctgaaggatgccagcctgtactggtacatcaatgaggaggatgagaaggccgagggcttcatcagcctgcctgagttcaagattgaccgggccagcgagtgcaggaagaagtatgccttcaaggcctgccaccccaagatcaagagcttctactttgctgctgagcacctggatgacatgaaccgctggctgaaccgcatcaacatgctgacagctggctacgccgagcgggagcgcatcaagcaggagcaggactactggagcgagagtgacaaggaggaggccgacacccccagcacccccaagcaggacagccccccaccaccctatgacacctaccccaggcctccttccatgagctgtgccagcccctacgtggaggccaagcacagccggctgagcagcacagagaccagccagagccagagcagccatgaggagttccggcaggaggtgacaggcagcagcgctgtgagccccatcaggaagacagccagccagaggaggtcctggcaggacctgattgagacccccctgaccagcagcggcctgcactacctgcagaccctgcccctggaggacagcgtcttcagtgacagcgctgccatcagccctgagcaccggcggcagagcaccctgcccacccagaagtgccacctgcaggaccactacggcccctaccccctggccgagagcgagaggatgcaggtgctgaatggaaatggaggcaagcccaggagcttcaccctgccccgggacagcggcttcaaccactgctgcctgaatgcccctgtgtctgcctgtgacccccaggatgatgtgcagcccccagaggtggaggaggaggaggaggaggaggaggaggagggggaggccgccggggagaacatcggggagaagagctag

SEQ ID NO: 148372 - DNA, 3105 bp, Artificial Sequence
  Description of Artificial Sequence: Synthetic coding sequence
atggccctgatcatggagcctgtgtccaagtggagccccagccaggtggtggactggatgaagggcctggatgactgcctgcagcagtacatcaagaactttgagcgggagaagatcagcggggaccagctgctgcgcatcacccaccaggagctggaggacctgggcgtgagccgcatcggccaccaggagctgatcctggaggccgtggacctgctgtgtgccctgaactacggcctggagacagagaacctgaagaccctgagccacaagctgaatgccagcgccaagaacctgcagaacttcatcaccggcagaagaagaagtggccactatgatggccgcaccagcaggaagctgcccaatgacttcctgacctctgtggtggacctgattggagctgccaagagcctgctggcctggctggacaggagcccctttgctgctgtgacagactacagcgtgaccagaaataatgtcatccagctgtgcctggagctgaccaccatcgtgcagcaggactgcaccgtgtatgaaacagagaacaagatcctgcacgtgtgcaagaccctgagcggcgtgtgtgaccacatcatcagcctgagcagtgaccccctggtgtcccagagcgcccacctggaggtgatccagctggccaacatcaagcccagcgagggcctgggcatgtacatcaagagcacctatgatggcctgcacgtgatcaccggcaccacagagaacagccctgctgaccgctgcaagaagatccacgccggagatgaggtgatccaggtgaaccaccagacagtggtgggctggcagctgaagaacctggtgaatgccctgcgggaggaccccagcggggtcatcctgaccctgaagaagaggccccagagcatgctgaccagcgccccagccctgctgaagaacatgcgctggaagcccctggccctgcagcccctcatccccaggagccccaccagctctgtggccacccccagcagcaccatcagcacccccaccaagagggacagcagcgccctgcaggacctgtacatccccccacctcctgctgagccctacatccccagagatgagaagggcaacctgccctgtgaggacctgcggggccacatggtgggcaagcctgtgcacaagggcagcgagagccccaacagcttcctggaccaggagtacaggaagcgcttcaacatcgtggaggaggacacagtgctgtactgctatgaatatgagaagggccgcagcagcagccagggcagaagagagagcacccccacctacggcaagctgcggcccatctccatgcctgtggagtacaactgggtgggggactatgaggaccccaacaagatgaagagggacagcagaagagagaacagcctgctgcgctacatgagcaatgagaagatcgcccaggaggagtacatgttccagaggaacagcaagaaggacaccgggaagaagagcaagaagaagggggacaagagcaacagccccacccactacagcctgctgcccagcctgcagatggatgccctgcggcaggacatcatgggcacccctgtgcctgagaccaccctgtaccacaccttccagcagagcagcctgcagcacaagagcaagaagaagaacaagggccccatcgccggcaagagcaagaggcgcatcagctgcaaggacctgggccgcggggactgtgagggctggctgtggaagaagaaggatgccaagagctacttcagccagaagtggaagaagtactggtttgtgctgaaggatgccagcctgtactggtacatcaatgaggaggatgagaaggccgagggcttcatcagcctgcctgagttcaagattgaccgggccagcgagtgcaggaagaagtatgccttcaaggcctgccaccccaagatcaagagcttctactttgctgctgagcacctggatgacatgaaccgctggctgaaccgcatcaacatgctgacagctggctacgccgagcgggagcgcatcaagcaggagcaggactactggagcgagagtgacaaggaggaggccgacacccccagcacccccaagcaggacagccccccaccaccctatgacacctaccccaggcctccttccatgagctgtgccagcccctacgtggaggccaagcacagccggctgagcagcacagagaccagccagagccagagcagccatgaggagttccggcaggaggtgacaggcagcagcgctgtgagccccatcaggaagacagccagccagaggaggtcctggcaggacctgattgagacccccctgaccagcagcggcctgcactacctgcagaccctgcccctggaggacagcgtcttcagtgacagcgctgccatcagccctgagcaccggcggcagagcaccctgcccacccagaagtgccacctgcaggaccactacggcccctaccccctggccgagagcgagaggatgcaggtgctgaatggaaatggaggcaagcccaggagcttcaccctgccccgggacagcggcttcaaccactgctgcctgaatgcccctgtgtctgcctgtgacccccaggatgatgtgcagcccccagaggtggaggaggaggaggaggaggaggaggaggagggggaggccgccggggagaacatcggggagaagtctgagagccgggaggagaagctgggggacagcctgcaggacctgtaccgggccctggagcaggccagcctgagccccctgggggagcaccgcatcagcaccaagatggagtacaagctgtccttcatcaagcgctgcaatgaccctgtgatgaatgagaagctgcaccggctgcgcatcctgaagagcaccctgaaggcccgggagggggaggtggccatcatcgacaaggtgctggacaacccagacctgaccagcaaggagttccagcagtggaagcagatgtacctggacctcttcctggacatctgccagaacaccaccagcaatgaccccctgagcatcagcagcgaggtggatgtgatcaccagcagcctggcccacacccacagctacatcgagacccacgtgtag

SEQ ID NO: 148373 - DNA, 3015 bp, Artificial Sequence
  Description of Artificial Sequence: Synthetic coding sequence
atggccctgatcatggagcctgtgtccaagtggagccccagccaggtggtggactggatgaagggcctggatgactgcctgcagcagtacatcaagaactttgagcgggagaagatcagcggggaccagctgctgcgcatcacccaccaggagctggaggacctgggcgtgagccgcatcggccaccaggagctgatcctggaggccgtggacctgctgtgtgccctgaactacggcctggagacagagaacctgaagaccctgagccacaagctgaatgccagcgccaagaacctgcagaacttcatcaccggcagaagaagaagtggccactatgatggccgcaccagcaggaagctgcccaatgacttcctgacctctgtggtggacctgattggagctgccaagagcctgctggcctggctggacaggagcccctttgctgctgtgacagactacagcgtgaccagaaataatgtcatccagctgtgcctggagctgaccaccatcgtgcagcaggactgcaccgtgtatgaaacagagaacaagatcctgcacgtgtgcaagaccctgagcggcgtgtgtgaccacatcatcagcctgagcagtgaccccctggtgtcccagagcgcccacctggaggtgatccagctggccaacatcaagcccagcgagggcctgggcatgtacatcaagagcacctatgatggcctgcacgtgatcaccggcaccacagagaacagccctgctgaccgctgcaagaagatccacgccggagatgaggtgatccaggtgaaccaccagacagtggtgggctggcagctgaagaacctggtgaatgccctgcgggaggaccccagcggggtcatcctgaccctgaagaagaggccccagagcatgctgaccagcgccccagccctgctgaagaacatgcgctggaagcccctggccctgcagcccctcatccccaggagccccaccagctctgtggccacccccagcagcaccatcagcacccccaccaagagggacagcagcgccctgcaggacctgtacatccccccacctcctgctgagccctacatccccagagatgagaagggcaacctgccctgtgaggacctgcggggccacatggtgggcaagcctgtgcacaagggcagcgagagccccaacagcttcctggaccaggagtacaggaagcgcttcaacatcgtggaggaggacacagtgctgtactgctatgaatatgagaagggccgcagcagcagccagggcagaagagagagcacccccacctatgagaacagcctgctgcgctacatgagcaatgagaagatcgcccaggaggagtacatgttccagaggaacagcaagaaggacaccgggaagaagagcaagaagaagggggacaagagcaacagccccacccactacagcctgctgcccagcctgcagatggatgccctgcggcaggacatcatgggcacccctgtgcctgagaccaccctgtaccacaccttccagcagagcagcctgcagcacaagagcaagaagaagaacaagggccccatcgccggcaagagcaagaggcgcatcagctgcaaggacctgggccgcggggactgtgagggctggctgtggaagaagaaggatgccaagagctacttcagccagaagtggaagaagtactggtttgtgctgaaggatgccagcctgtactggtacatcaatgaggaggatgagaaggccgagggcttcatcagcctgcctgagttcaagattgaccgggccagcgagtgcaggaagaagtatgccttcaaggcctgccaccccaagatcaagagcttctactttgctgctgagcacctggatgacatgaaccgctggctgaaccgcatcaacatgctgacagctggctacgccgagcgggagcgcatcaagcaggagcaggactactggagcgagagtgacaaggaggaggccgacacccccagcacccccaagcaggacagccccccaccaccctatgacacctaccccaggcctccttccatgagctgtgccagcccctacgtggaggccaagcacagccggctgagcagcacagagaccagccagagccagagcagccatgaggagttccggcaggaggtgacaggcagcagcgctgtgagccccatcaggaagacagccagccagaggaggtcctggcaggacctgattgagacccccctgaccagcagcggcctgcactacctgcagaccctgcccctggaggacagcgtcttcagtgacagcgctgccatcagccctgagcaccggcggcagagcaccctgcccacccagaagtgccacctgcaggaccactacggcccctaccccctggccgagagcgagaggatgcaggtgctgaatggaaatggaggcaagcccaggagcttcaccctgccccgggacagcggcttcaaccactgctgcctgaatgcccctgtgtctgcctgtgacccccaggatgatgtgcagcccccagaggtggaggaggaggaggaggaggaggaggaggagggggaggccgccggggagaacatcggggagaagtctgagagccgggaggagaagctgggggacagcctgcaggacctgtaccgggccctggagcaggccagcctgagccccctgggggagcaccgcatcagcaccaagatggagtacaagctgtccttcatcaagcgctgcaatgaccctgtgatgaatgagaagctgcaccggctgcgcatcctgaagagcaccctgaaggcccgggagggggaggtggccatcatcgacaaggtgctggacaacccagacctgaccagcaaggagttccagcagtggaagcagatgtacctggacctcttcctggacatctgccagaacaccaccagcaatgaccccctgagcatcagcagcgaggtggatgtgatcaccagcagcctggcccacacccacagctacatcgagacccacgtgtag

SEQ ID NO: 148374 - DNA, 2550 bp, Artificial Sequence
  Description of Artificial Sequence: Synthetic coding sequence
atggccctgatcatggagcctgtgtccaagtggagccccagccaggtggtggactggatgaagggcctggatgactgcctgcagcagtacatcaagaactttgagcgggagaagatcagcggggaccagctgctgcgcatcacccaccaggagctggaggacctgggcgtgagccgcatcggccaccaggagctgatcctggaggccgtggacctgctgtgtgccctgaactacggcctggagacagagaacctgaagaccctgagccacaagctgaatgccagcgccaagaacctgcagaacttcatcaccggcagaagaagaagtggccactatgatggccgcaccagcaggaagctgcccaatgacttcctgacctctgtggtggacctgattggagctgccaagagcctgctggcctggctggacaggagcccctttgctgctgtgacagactacagcgtgaccagaaataatgtcatccagctgtgcctggagctgaccaccatcgtgcagcaggactgcaccgtgtatgaaacagagaacaagatcctgcacgtgtgcaagaccctgagcggcgtgtgtgaccacatcatcagcctgagcagtgaccccctggtgtcccagagcgcccacctggaggtgatccagctggccaacatcaagcccagcgagggcctgggcatgtacatcaagagcacctatgatggcctgcacgtgatcaccggcaccacagagaacagccctgctgaccgctgcaagaagatccacgccggagatgaggtgatccaggtgaaccaccagacagtgcccctcatccccaggagccccaccagctctgtggccacccccagcagcaccatcagcacccccaccaagagggacagcagcgccctgcaggacctgtacatccccccacctcctgctgagccctacatccccagagatgagaagggcaacctgccctgtgaggacctgcggggccacatggtgggcaagcctgtgcacaagggcagcgagagccccaacagcttcctggaccaggagtacaggaagcgcttcaacatcgtggaggaggacacagtgctgtactgctatgaatatgagaagggccgcagcagcagccagggccggcgggagagcacccccacctacggcaagctgcggcccatctccatgcctgtggagtacaactgggtgggggactatgaggaccccaacaagatgaagagggacagccggcgggagaacagcctgctgcgctacatgagcaatgagaagatcgcccaggaggagtacatgttccagaggaacagcaagaaggacaccgggaagaagagcaagaagaagggggacaagagcaacagccccacccactacagcctgctgcccagcctgcagatggatgccctgcggcaggacatcatgggcacccctgtgcctgagaccaccctgtaccacaccttccagcagagcagcctgcagcacaagagcaagaagaagaacaagggccccatcgccggcaagagcaagaggcgcatcagctgcaaggacctgggccgcggggactgtgagggctggctgtggaagaagaaggatgccaagagctacttcagccagaagtggaagaagtactggtttgtgctgaaggatgccagcctgtactggtacatcaatgaagaagatgagaaggccgagggcttcatcagcctgcctgagttcaagattgaccgggcctctgaatgtaggaagaagtatgccttcaaggcctgccaccccaagatcaagagcttctactttgctgctgagcacctggatgacatgaaccgctggctgaaccgcatcaacatgctgacagctggctatgcagagcgggagcgcatcaagcaggagcaggactactggagcgagagtgacaaggaggaggccgacacccccagcacccccaagcaggacagccccccaccaccctatgacacctacccccggccccccagcatgagctgtgccagcccctacgtggaggccaagcacagccggctgagcagcacagagaccagccagagccagagcagccatgaggagttccggcaggaggtgacaggcagcagcgctgtgagccccatcaggaagacagccagccagaggaggtcctggcaggacctgattgagacccccctgaccagcagcggcctgcactacctgcagaccctgcccctggaggacagcgtcttcagtgacagcgctgccatcagccctgagcaccggcggcagagcaccctgcccacccagaagtgccacctgcaggaccactacggcccctaccccctggccgagagcgagaggatgcaggtgctgaatggaaatggaggcaagcccaggagcttcaccctgccccgggacagcggcttcaaccactgctgcctgaatgcccctgtgtctgcctgtgacccccaggatgatgtgcagcccccagaggtggaggaggaggaggaggaggaggaggaggagggggaggccgctggagaaaatattggagagaagagctag

SEQ ID NO: 148375 - DNA, 414 bp, Artificial Sequence
  Description of Artificial Sequence: Synthetic coding sequence
atggatgacagcgacacccccacctactacctgcagatcgagccccaggacggctgccaccctggggacagcgtggagaggtctgtgacctgcctgcccagcgccagtgatgaaaatgaaaaccagctggatggagatggccacgagcacctgaccagcagtgacagcgccatgggcaagccccaggtgtctgagcaggacagcctgaacaacaatgaaagctgcaccctgagctgtgaggtggccgccggggagaacctgcagaacaccctgtgtgaggccagcagagatgagcaggccttcctgggcaaggacaagaagatccctgggaagaggagccccaggagcaagaagggcacagccaagaagatccccccagacagccgcatcctcttccctgggggcggcctgtag

SEQ ID NO: 148376 - DNA, 1851 bp, Artificial Sequence
  Description of Artificial Sequence: Synthetic coding sequence
atggatgacagcgacacccccacctactacctgcagatcgagccccaggacggctgccaccctggggacagcgtggagaggtctgtgacctgcctgcccagcgccagtgatgaaaatgaaaaccagctggatggagatggccacgagcacctgaccagcagtgacagcgccatgggcaagccccaggtgtctgagcaggacagcctgaacaacaatgaaagctgcaccctgagctgtgaggtggccgccggggagaacctgcagaacaccctgtgtgaggccagcagagatgagcaggccttcctgggcaaggacaagaagatccctgggaagaggagccccaggagcaagaagggcacagccaagaagatccccccaggcctcttcagcggggacatcgcccccctgatgcaggagaaggtgctgtctgctgtgacctatgctgtggatgatgaggaggccgctgaggtgaatgccaatgagcagcctgaggcccccaagctggtgctgcagagcctcttcagcctcatccggggggaggtggagcagctggacagccgggccctgcccctgtgcctgcaccagattgctgagagctacttccaggaggaggactatgagaaggccatgaagttcatccagctggagcggctgtaccacgagcagctgctggccaacctgagcgccatccaggagcagtgggagaccaagtggaagacagtgcagccccacacagtgacagccctgaggaacagcgagaagggcttcaatggagaagattttgagcggctgaccaagatctgtgccacccaccaggaccccctgctgagcaagcacaagattgctgctgtggagaagagccaggagaggaagtgcagcacccagctgctggtgtctgaggaccccaaggagggcggggccaccaccaaggagagcgagagcaagacctgcctgggcacagagagcagcaaggagagccagcacacagtggagcccctgggcagcagcccctgctgccaccagatggatgtgcagacagacagccccagcctgtctgtgacagctgggaaggaccacatggaggagctgctgtgcagcgctgaggccaccctggccctgcacacccagagcagcgagacagctggcagccccagcggccctgacagcagtgaagatgcctgtgaagatgacagccggctgcagctggcccagacagaggcctgccaggatgtggcccgcatcgagggcattgctgaggaccccaaggtgttcctgagcagcaagagcaagacagagcccctcatcagccctggctgtgaccgcatccccccagccctgatcagcgagggcaagtacagccaggcccagaggaaggagctgcggctgcccctgagagatgccagcgaggccctgcccacagaccagctggagaacaatgagctgaatgagctgcagcagcctgacctgacagacagtgatggcaagagcccccaggcccaggccgacagtgatggctctgaaaatgtgctgtgtggcaacaaccagatcagtgacctgggcatcctgctgcctgaggtgtgcatggcccctgaggagaagggggacaaggatgaccagctgaacaaggagacagaggactacctgaacagcctgctggagggctgcctgaaggacacagaggacagcctgtcctatgaggacaaccaggatgatgacagcgacctgctgcaggacctgagccctgaggaggccagctacagcctgcaggagaacctgcccagtgatgagagctgcctgagcctggatgacctggccaagagaattgaaattgctgaggtgaaccagaggtag

SEQ ID NO: 148377 - DNA, 2178 bp, Artificial Sequence
  Description of Artificial Sequence: Synthetic coding sequence
atggatgacagcgacacccccacctactacctgcagatcgagccccaggacggctgccaccctggggacagcgtggagaggtctgtgacctgcctgcccagcgccagtgatgaaaatgaaaaccagctggatggagatggccacgagcacctgaccagcagtgacagcgccatgggcaagccccaggtgtctgagcaggacagcctgaacaacaatgaaagctgcaccctgagctgtgaggtggccgccggggagaacctgcagaacaccctgtgtgaggccagcagagatgagcaggccttcctgggcaaggacaagaagatccctgggaagaggagccccaggagcaagaagggcacagccaagaagatccccccaggcctcttcagcggggacatcgcccccctgatgcaggagaaggtgctgtctgctgtgacctatgctgtggatgatgaggaggccgctgaggtgaatgccaatgagcagcctgaggcccccaagctggtgctgcagagcctcttcagcctcatccggggggaggtggagcagctggacagccgggccctgcccctgtgcctgcaccagattgctgagagctacttccaggaggaggactatgagaaggccatgaagttcatccagctggagcggctgtaccacgagcagctgctggccaacctgagcgccatccaggagcagtgggagaccaagtggaagacagtgcagccccacacagtgacagccctgaggaacagcgagaagggcttcaatggagaagattttgagcggctgaccaagatctgtgccacccaccaggaccccctgctgagcaagcacaagattgctgctgtggagaagagccaggagaggaagtgcagcacccagctgctggtgtctgaggaccccaaggagggcggggccaccaccaaggagagcgagagcaagacctgcctgggcacagagagcagcaaggagagccagcacacagtggagcccctgggcagcagcccctgctgccaccagatggatgtgcagacagacagccccagcctgtctgtgacagctgggaaggaccacatggaggagctgctgtgcagcgctgaggccaccctggccctgcacacccagagcagcgagacagctggcagccccagcggccctgacagcagtgaagatgcctgtgaagatgacagccggctgcagctggcccagacagaggcctgccaggatgtggcccgcatcgagggcattgctgaggaccccaaggtgttcctgagcagcaagagcaagacagagcccctcatcagccctggctgtgaccgcatccccccagccctgatcagcgagggcaagtacagccaggcccagaggaaggagctgcggctgcccctgagagatgccagcgaggccctgcccacagaccagctggagaacaatgagctgaatgagctgcagcagcctgacctgacagacagtgatggcaagagcccccaggcccaggccgacagtgatggctctgaaaatgtgctgtgtggcaacaaccagatcagtgacctgggcatcctgctgcctgaggtgtgcatggcccctgaggagaagggggacaaggatgaccagctgaacaaggagacagaggactacctgaacagcctgctggagggctgcctgaaggacacagaggacagcctgtcctatgaggacaaccaggatgatgacagcgacctgctgcaggacctgagccctgaggaggccagctacagcctgcaggagaacctgcccagtgatgagagctgcctgagcctggatgacctggccaagagaattgaaattgctgaggtggtgcccacagagggcctggtgtccatcctgaagaagagaaatgacacagtgggggaccacccagcccagatgcagcacaagcccagcaagagaagagtgcgcttccaggagattgatgacagcctggaccaggatgaggtgggcggcggcagctgcatcctgctggtgctgctgtgcatcgccaccgtcttcctgtctgtgggcggcacagccctgtactgcacctttggagacatggagagccctgtgtgcacagactttgctgacaacatggacttctactacaccaagctgctgcagggcgtggccgagctgaagcactggatctacctgtcctag

SEQ ID NO: 148378 - DNA, 3057 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgaactgccgggcccgggccagccccttccctgtgtacaagtggaggatgaacaatggagatgtggacctgaccagtgaccgctacagcatggtgggcggcaacctggtgatcaacaacccagacaagcagaaggatgctggcatctactactgcctggccagcaacaactacggcatggtgcgcagcacagaggccaccctgagctttggctacctggaccccttccccccagaggagaggcctgaggtgcgggtgaaggagggcaagggcatggtgctgctgtgtgaccccccctaccacttcccagatgacctgagctaccgctggctgctgaatgagttccctgtgttcatcaccatggacaagagaagatttgtgtcccagaccaatggaaacctgtacatcgccaacgtggaggccagtgacaagggcaactacagctgctttgtgagcagccccagcatcaccaagtctgtgttcagcaagttcatccccctcatccccatccctgagaggaccaccaagccctacccagctgacatcgtggtgcagttcaaggatgtgtatgccctgatgggccagaatgtgaccctggagtgctttgccctgggcaaccctgtgcctgacatccgctggaggaaggtgctggagcccatgcccagcacagctgagatcagcaccagcggggctgtgctgaagatcttcaacatccagctggaggatgagggcatctatgaatgtgaggccgagaacatccggggcaaggacaagcaccaggcccgcatctacgtgcaggccttccctgagtgggtggagcacatcaatgacacagaggtggacatcggcagtgacctgtactggccctgtgtggccaccgggaagcccatccccaccatccgctggctgaagaatggctacgcctaccacaagggggagctgcggctgtatgatgtgacctttgaaaatgccggcatgtaccagtgcatcgccgagaacacctatggagccatctatgccaatgctgagctgaagatcctggccctggcccccacctttgagatgaaccccatgaagaagaagatcctggccgccaagggcggccgggtcatcatcgagtgcaagcccaaggccgcccccaagcccaagttctcctggagcaagggcacagagtggctggtgaacagcagccgcatcctgatctgggaggatggcagcctggagatcaacaacatcaccagaaatgatggcggcatctacacctgctttgctgagaacaacagaggcaaggccaacagcacaggcaccctggtgatcacagaccccacccgcatcatcctggcccccatcaatgctgacatcaccgtgggggagaatgccaccatgcagtgtgccgccagctttgatcctgccctggacctgacctttgtgtggagcttcaacggctacgtgattgacttcaacaaggagaacatccactaccagaggaacttcatgctggacagcaatggagagctgctgatcagaaatgcccagctgaagcacgccggccgctacacctgcacagcccagaccatcgtggacaacagcagcgccagcgctgacctggtggtgcggggccccccaggccccccaggcggcctgagaattgaggacatccgggccacctctgtggccctgacctggagccggggcagtgacaaccacagccccatcagcaagtacaccatccagaccaagaccatcctgagtgatgactggaaggatgccaagacagacccccccatcatcgagggcaacatggaggccgcccgggctgtggacctgatcccctggatggagtatgagttccgggtggtggccaccaacaccctgggccgcggggagcccagcatccccagcaaccgcatcaagacagatggagctgccccaaatgtggcccccagtgatgtgggcggcggcggcggcaggaaccgggagctgaccatcacctgggcccccctgagccgggagtaccactacggcaacaactttggctacatcgtggccttcaagccctttgatggagaggagtggaagaaggtgacagtgaccaacccagacaccggccgctacgtgcacaaggatgagaccatgagccccagcacagccttccaggtgaaggtgaaggccttcaacaacaagggagatggcccctacagcctggtggccgtcatcaacagcgcccaggatgcccccagcgaggcccccacagaggtgggcgtgaaggtgctgagcagcagcgagatctctgtgcactgggagcacgtgctggagaagatcgtggagagctaccagatccgctactgggccgcccatgacaaggaggaggccgccaacagagtgcaggtgaccagccaggagtacagcgcccggctggagaacctgctgcctgacacccagtacttcatcgaggtgggcgcctgcaacagcgctggctgcggccccccaagtgacatgattgaggccttcaccaagaaggccccacccagccagcccccacgcatcatcagctctgtgcgcagcggcagccgctacatcatcacctgggaccacgtggtggccctgagcaatgaaagcacagtgacaggctacaaggtgctgtacagaccagatggccagcatgatggcaagctgtacagcacccacaagcacagcattgaggtgcccatccccagagatggagaatatgtggtggaggtgcgggcccacagtgatggaggagatggagtggtgtcccaggtgaagatcagcggggcccccaccctgagccccagcctgctgggcctgctgctgcctgccttcggcatcctggtgtacctggagttctag

SEQ ID NO: 148379 - DNA, 3024 bp, Artificial Sequence
  Description of Artificial Sequence: Synthetic coding sequence
atgaagatgtggctgctggtgagccacctggtgatcatcagcatcaccacctgcctggccgtgtctgaggaggacaagggcttcggccccatctttgaggagcagcccatcaacaccatctacccagaggagagcctggagggcaaggtgtccctgaactgccgggcccgggccagccccttccctgtgtacaagtggaggatgaacaatggagatgtggacctgaccagtgaccgctacagcatggtgggcggcaacctggtgatcaacaacccagacaagcagaaggatgctggcatctactactgcctggccagcaacaactacggcatggtgcgcagcacagaggccaccctgagctttggctacctggaccccttccccccagaggagaggcctgaggtgcgggtgaaggagggcaagggcatggtgctgctgtgtgaccccccctaccacttcccagatgacctgagctaccgctggctgctgaatgagttccctgtgttcatcaccatggacaagagaagatttgtgtcccagaccaacggcaacctgtacatcgccaacgtggaggccagtgacaagggcaactacagctgctttgtgagcagccccagcatcaccaagagcgtcttcagcaagttcatccccctcatccccatccctgagaggaccaccaagccctacccagctgacatcgtggtgcagttcaaggatgtgtatgccctgatgggccagaatgtgaccctggagtgctttgccctgggcaaccctgtgcctgacatccgctggaggaaggtgctggagcccatgcccagcacagctgagatcagcaccagcggggctgtgctgaagatcttcaacatccagctggaggatgagggcatctatgaatgtgaggccgagaacatccggggcaaggacaagcaccaggcccgcatctacgtgcaggccttccctgagtgggtggagcacatcaatgacacagaggtggacattggaagtgacctgtactggccctgtgtggccaccgggaagcccatccccaccatccgctggctgaagaatggctacgcctaccacaagggggagctgcggctgtatgatgtgacctttgaaaatgccggcatgtaccagtgcatcgccgagaacacctacggggccatctatgccaatgctgagctgaagatcctggccctggcccccacctttgagatgaaccccatgaagaagaagatcctggccgccaagggcggccgggtcatcatcgagtgcaagcccaaggccgcccccaagcccaagttctcctggagcaaaggaacagagtggctggtgaacagcagccgcatcctgatctgggaggatggcagcctggagatcaacaacatcaccagaaatgatggcggcatctacacctgctttgctgagaacaacagaggcaaggccaacagcacaggcaccctggtgatcacagaccccacccgcatcatcctggcccccatcaatgctgacatcaccgtgggagaaaatgccaccatgcagtgtgccgccagctttgatcctgccctggacctgacctttgtgtggagcttcaacggctacgtgattgacttcaacaaggagaacatccactaccagaggaacttcatgctggacagcaatggagagctgctgatcagaaatgcccagctgaagcatgctggccgctacacctgcacagcccagaccatcgtggacaacagcagcgccagcgctgacctggtggtgcggggccccccaggccccccaggcggcctgagaattgaggacatccgggccacctctgtggccctgacctggagccggggcagtgacaaccacagccccatcagcaagtacaccatccagaccaagaccatcctgagtgatgactggaaggatgccaagacagatcctcccatcatcgagggcaacatggaggccgcccgggctgtggacctgatcccctggatggagtatgagttccgggtggtggccaccaacaccctgggccgcggggagcccagcatccccagcaaccgcatcaagacagatggagctgcccccaacgtggcccccagtgatgtgggcggcggcggcggcaggaaccgggagctgaccatcacctgggcccccctgagccgggagtaccactacggcaacaactttggctacatcgtggccttcaagccctttgatggagaggagtggaagaaggtgacagtgaccaacccagacaccggccgctacgtgcacaaggatgagaccatgagccccagcacagccttccaggtgaaggtgaaggccttcaacaacaagggagatggcccctacagcctggtggccgtcatcaacagcgcccaggatgcccccagcgaggcccccacagaggtgggcgtgaaggtgctgagcagcagcgagatctctgtgcactgggagcacgtgctggagaagatcgtggagagctaccagatccgctactgggccgcccatgacaaggaggaggccgccaacagagtgcaggtgaccagccaggagtacagcgcccggctggagaacctgctgcctgacacccagtacttcatcgaggtgggcgcctgcaacagcgctggctgcggcccccccagcgacatgattgaggccttcaccaagaaggccccacccagccagcccccacgcatcatcagctctgtgcgcagcggcagccgctacatcatcacctgggaccacgtggtggccctgagcaatgaaagcacagtgacaggctacaaggtgctgtacagaccagatggccagcatgatggcaagctgtacagcacccacaagcacagcattgaggtgcccatccccagagatggagaatatgtggtggaggtgcgggcccacagtgatggaggagatggagtggtgtcccaggtgaagatcagcggggcccccaccctgagccccagcctgctgggcctgctgctgcctgccttcggcatcctggtgtacctggagttctag

SEQ ID NO: 148380 - DNA, 1884 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgaactgccgggcccgggccagccccttccctgtgtacaagtggaggatgaacaatggagatgtggacctgaccagtgaccgctacagcatggtgggcggcaacctggtgatcaacaacccagacaagcagaaggatgctggcatctactactgcctggccagcaacaactacggcatggtgcgcagcacagaggccaccctgagctttggctacctggaccccttccccccagaggagaggcctgaggtgcgggtgaaggagggcaagggcatggtgctgctgtgtgaccccccctaccacttcccagatgacctgagctaccgctggctgctgaatgagttccctgtgttcatcaccatggacaagagaagatttgtgtcccagaccaatggaaacctgtacatcgccaacgtggaggccagtgacaagggcaactacagctgctttgtgagcagccccagcatcaccaagtctgtgttcagcaagttcatccccctcatccccatccctgagaggaccaccaagccctacccagctgacatcgtggtgcagttcaaggatgtgtatgccctgatgggccagaatgtgaccctggagtgctttgccctgggcaaccctgtgcctgacatccgctggaggaaggtgctggagcccatgcccagcacagctgagatcagcaccagcggggctgtgctgaagatcttcaacatccagctggaggatgagggcatctatgaatgtgaggccgagaacatccggggcaaggacaagcaccaggcccgcatctacgtgcaggccttccctgagtgggtggagcacatcaatgacacagaggtggacatcggcagtgacctgtactggccctgtgtggccaccgggaagcccatccccaccatccgctggctgaagaatggctacgcctaccacaagggggagctgcggctgtatgatgtgacctttgaaaatgccggcatgtaccagtgcatcgccgagaacacctatggagccatctatgccaatgctgagctgaagatcctggccctggcccccacctttgagatgaaccccatgaagaagaagatcctggccgccaagggcggccgggtcatcatcgagtgcaagcccaaggccgcccccaagcccaagttctcctggagcaagggcacagagtggctggtgaacagcagccgcatcctgatctgggaggatggcagcctggagatcaacaacatcaccagaaatgatggcggcatctacacctgctttgctgagaacaacagaggcaaggccaacagcacaggcaccctggtgatcacagaccccacccgcatcatcctggcccccatcaatgctgacatcaccgtgggggagaatgccaccatgcagtgtgccgccagctttgatcctgccctggacctgacctttgtgtggagcttcaacggctacgtgattgacttcaacaaggagaacatccactaccagaggaacttcatgctggacagcaatggagagctgctgatcagaaatgcccagctgaagcacgccggccgctacacctgcacagcccagaccatcgtggacaacagcagcgccagcgctgacctggtggtgcggggcaagaacaggaagggcggggagaagaacatggtggacagcttcctgcctgtgtgtgccagcctgccccccacctggtag

SEQ ID NO: 148381 - DNA, 1884 bp, Artificial Sequence; identical to SEQ ID NO: 148380
  Description of Artificial Sequence: Synthetic coding sequence

SEQ ID NO: 148382 - DNA, 1884 bp, Artificial Sequence; identical to SEQ ID NO: 148380
  Description of Artificial Sequence: Synthetic coding sequence

SEQ ID NO: 148383 - DNA, 258 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgaactgccgggcccgggccagccccttccctgtgtacaagtggaggatgaacaatggagatgtggactag

SEQ ID NO: 148384 - DNA, 3057 bp, Artificial Sequence; identical to SEQ ID NO: 148378
  Description of Artificial Sequence: Synthetic coding sequence

SEQ ID NO: 148385 - DNA, 192 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgtag

SEQ ID NO: 148386 - DNA, 273 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgaactgccgggcccgggccagccccttccctgtgtacaagtggaggatgaacaatggagatgtggacctgaccagtgacagatag

SEQ ID NO: 148387 - DNA, 222 bp, Artificial Sequence
  Description of Artificial Sequence: Synthetic coding sequence
atgaagatgtggctgctggtgagccacctggtgatcatcagcatcaccacctgcctggccgagttcacctggtaccgccgctatggccacggcgtgtctgaagaagataaaggatttggccccatctttgaggagcagcccatcaacaccatctacccagaggagagcctggagggcaaggtgtccctgaactgccgggcccgggccagccccttcccctag

SEQ ID NO: 148388 - DNA, 3123 bp, Artificial Sequence
  Description of Artificial Sequence: Synthetic coding sequence
atgggcacagccaccaggaggaagccccacctgctgctggtggccgctgtggccctggtgagcagcagcgcctggagcagcgccctgggcagccagaccacctttggacctgtgtttgaggaccagcccctgtctgtgctcttccctgaggagagcacagaggagcaggtgctgctggcctgccgggcccgggccagccccccagccacctaccgctggaagatgaatggaacagagatgaagctggagcccggcagccgccaccagctggtgggcggcaacctggtgatcatgaaccccaccaaggcccaggatgctggggtgtaccagtgcctggccagcaaccctgtgggcaccgtggtgtcccgggaggccatcctgcgcttcggcttcctgcaggagttcagcaaggaggagcgggaccctgtgaaggcccacgagggctggggcgtgatgctgccctgcaaccccccagcccactacccaggcctgagctaccgctggctgctgaatgagttccccaacttcatccccacagatggccgccactttgtgtcccagaccactggaaacctgtacatcgcccggaccaatgccagtgacctgggcaactacagctgcctggccaccagccacatggacttcagcaccaagtctgtgttcagcaagtttgcccagctgaacctggccgctgaggacacccggctgtttgcccccagcatcaaggcccgcttccctgctgagacctacgccctggtgggccagcaggtgaccctggagtgctttgccttcggcaaccctgtgccccgcatcaagtggaggaaggtggatggcagcctgagcccccagtggaccacagctgagcccaccctgcagatccccagcgtgtcctttgaagatgagggcacctatgaatgtgaggccgagaacagcaagggccgggacacagtgcagggccgcatcatcgtgcaggcccagcctgagtggctgaaggtgatcagtgacacagaggccgacatcggcagcaacctgcgctggggctgtgccgctgctgggaagccccggcccaccgtgcgctggctgagaaatggagagcccctggccagccagaacagagtggaggtgctggccggggacctgcgcttcagcaagctgagcctggaggacagcggcatgtaccagtgtgtggccgagaacaagcacggcaccatctatgccagcgctgagctggccgtgcaggccctggccccagacttccggctgaaccctgtgagaagactcatcccagctgcccggggcggggagatcctgatcccctgccagccccgggccgcccccaaggctgtggtgctgtggagcaagggcacagagatcctggtgaacagcagccgggtgacagtgaccccagatggcaccctcatcatccggaacatcagcagaagtgatgagggcaagtacacctgctttgctgagaacttcatgggcaaggccaacagcacaggcatcctgtctgtgagagatgccaccaagatcaccctggcccccagcagcgctgacatcaacctgggggacaacctgaccctgcagtgccacgccagccatgaccccaccatggacctgaccttcacctggaccctggatgacttccccatcgactttgacaagccaggcggccactacagaaggaccaacgtgaaggagaccatcggggacctgaccatcctgaatgcccagctgcggcatggaggcaagtacacctgcatggcccagacagtggtggacagcgccagcaaggaggccaccgtgctggtgcggggccccccaggccccccaggaggagtggtggtgcgggacattggagacaccaccatccagctgtcctggagccggggctttgacaaccacagccccatcgccaagtacaccctgcaggcccggaccccacctgctgggaagtggaagcaggtgaggaccaacccagccaacatcgagggcaatgctgagacagcccaggtgctgggcctgaccccctggatggactatgagttccgggtcatcgccagcaacatcctgggcactggagagcccagcggccccagcagcaagatccgcacccgggaggccgcccccagcgtggcccccagcggcctgagcggcggcggcggggcccctggagagctgattgtgaactggacccccatgagccgggagtaccagaatggagatggcttcggctacctgctgtccttccggcggcagggcagcacccactggcagacagcccgggtgcctggagcagatgcccagtactttgtgtacagcaatgaatctgtgcggccctacaccccatttgaggtgaagatccgcagctacaacagaagaggagatggccctgagagcctgacagccctggtgtacagcgctgaggaggagccccgggtggcccccaccaaggtgtgggccaagggcgtgagcagcagcgagatgaatgtgacctgggagcctgtgcagcaggacatgaatggcatcctgctgggctatgagatccgctactggaaggccggggacaaggaggccgctgctgacagagtgaggacagctggcctggacaccagcgcccgggtgtctggcctgcaccccaacaccaagtaccacgtgacagtgcgggcctacaacagagctggcaccggccctgccagccccagcgccaatgccaccaccatgaagcccccaccaagaagacctcctggcaacatctcctggaccttcagcagcagcagcctgagcatcaagtgggaccctgtggtgcccttcagaaatgaatctgctgtgacaggctacaagatgctgtaccagaatgacctgcacctgacccccaccctgcacctgaccgggaagaactggattgagatccctgtgcctgaagatattggacatgccctggtgcagatccgcaccactggacctggaggagatggcatcccagctgaggtgcacatcgtgagaaatggaggcacctccatgatggtggagaacatggctgtgcggcctgccccccaccctggcaccgtcatcagccacagcgtggccatgctgatcctgattggcagcctggagctgtag

SEQ ID NO: 148389 - DNA, 3087 bp, Artificial Sequence
  Description of Artificial Sequence: Synthetic coding sequence
atgatgttcccctggaagcagctgatcctgctgtccttcatcggctgcctgggcggggagctgctgctgcagggccctgtgttcatcaaggagcccagcaacagcatcttccctgtgggcagcgaggacaagaagatcaccctgcactgtgaggcccggggcaaccccagcccccactaccgctggcagctgaatggaagtgacatcgacatgtccatggagcaccgctacaagctgaatggaggcaacctggtggtgatcaaccccaacagaaactgggacaccggcacctaccagtgctttgccaccaacagcctgggcaccatcgtgtcccgggaggccaagctgcagtttgcctacctggagaacttcaagaccaagatgaggagcacagtgtctgtgcgggagggccagggcgtggtgctgctgtgtggccccccaccccacagcggggagctgtcctatgcctggatcttcaatgagtaccccagctttgtggaggaggacagcagaagatttgtgtcccaggagaccggccacctgtacatcagcaaggtggagcccagtgatgtgggcaactacacctgtgtggtgacctccatggtgaccaatgcccgggtgctgggcagccccacccccctggtgctgcggagtgatggagtgatgggagaatatgagcccaagattgaggtgcagtttcctgagaccctgcctgctgccaagggcagcacagtgaagctggagtgctttgccctgggcaaccccatcccccagatcaactggaggagaagtgatggcctgcccttcagcagcaagatcaagctgaggaagttctctggagtgctggagatccccaacttccagcaggaggatgctggcagctatgagtgcatcgccgagaacagccggggcaagaatgtggcccggggccgcctgacctactatgccaagccccactgggtgcagctgatcaaggatgtggagattgctgtggaggacagcctgtactgggagtgccgggccagcggcaagcccaagcccagctaccgctggctgaagaatggagctgccctggtgctggaggagaggacccagattgaaaatggagccctgaccatcagcaacctgtctgtgacagattctggcatgttccagtgcatcgccgagaacaagcacggcctggtgtacagcagcgctgagctgaaggtggtggccagcgccccagacttcagcaagaaccccatgaagaagctggtgcaggtgcaggtgggcagcctggtgtccctggactgcaagccccgggccagcccccgggccctgagctcctggaagaagggagatgtgtctgtgcaggagcacgagcgcatcagcctgctgaatgatggcggcctgaagatcgccaacgtgaccaaggcagatgctggcacctacacctgcatggccgagaaccagtttgggaaggccaacggcaccacccacctggtggtgacagagcccacccgcatcaccctggcccccagcaacatggatgtgtctgtgggggagagcgtcatcctgccctgccaggtgcagcacgaccccctgctggacatcatcttcacctggtacttcaacggggccctggccgacttcaagaaggatggcagccactttgagaaggtgggcggcagcagcagcggggacctgatgatccggaacatccagctgaagcacagcggcaagtatgtgtgcatggtgcagacaggagtggacagcgtgagcagcgctgctgacctgattgtgcggggcagccctggccccccagaaaatgtgaaggtggatgagatcacagacaccacagcccagctgtcctggaaggagggcaaggacaaccacagccctgtgatctcctacagcatccaggcccggacccccttctctgtgggctggcagacagtgaccaccgtgcctgaggtgattgatggcaagacccacacagccaccgtggtggagctgaacccctgggtggagtatgagttccgggtggtggccagcaacaagattggaggaggagagcccagcctgcccagcgagaaggtgaggacagaggaggccgtgcctgaggtgcccccatctgaggtgaatggaggcggcggcagccgctctgagctggtgatcacctgggaccctgtgcctgaggagctgcagaatggagagggcttcggctacgtggtggccttccggcccctgggcgtgaccacctggatccagacagtggtgaccagcccagacacccccaggtatgtgttcagaaatgaaagcatcgtgccctacagcccctatgaggtgaaggtgggcgtgtacaacaacaagggggagggccccttcagccctgtgaccaccgtcttctctgctgaggaggagcccaccgtggcccccagccaggtgtctgccaacagcctgagcagcagcgagattgaggtgtcctggaacaccatcccctggaagctgagcaatggccacctgctgggctatgaggtgcgctactggaatggaggcggcaaggaggagagcagcagcaagatgaaggtggccggaaatgagaccagcgcccggctgcggggcctgaagagcaacctggcctactacacagctgtgcgggcctacaacagcgctggagctggccccttcagcgccaccgtgaatgtgaccaccaagaagaccccacccagccagcccccaggaaatgtggtgtggaatgccacagacaccaaggtgctgctgaactgggagcaggtgaaggccatggagaatgaaagtgaggtgacaggctacaaggtgttctaccgcaccagcagccagaacaacgtgcaggtgctgaacaccaacaagaccagcgctgagctggtgctgcccatcaaggaggactacatcatcgaggtgaaggccaccacagatggaggagatggcaccagcagcgagcagatccgcatcccccgcatcacctccatggatgcccggggcagcaccagcgccatcagcaatgtgcaccccatgagcagctacatgcccatcgtgctcttcctgattgtgtatgtgctgtggtag

SEQ ID NO: 148390 - DNA, 2424 bp, Artificial Sequence
  Description of Artificial Sequence: Synthetic coding sequence
atgggagaatatgagcccaagattgaggtgcagtttcctgagaccgtgcccacagccaagggggccaccgtgaagctggagtgctttgccctgggcaaccctgtgcccaccatcatctggaggagagcagatggcaagcccatcgccaggaaggcccggcggcacaagagcaatggcatcctggagatccccaacttccagcaggaggatgctggcctgtatgaatgtgtggccgagaacagccggggcaagaatgtggcccggggccagctgaccttctacgcccagcccaactggatccagaagatcaatgacatccacgtggccatggaggagaatgtgttctgggagtgcaaggccaacggccggcccaagcccacctacaagtggctgaagaatggagagcccctgctgacccgggaccgcatccagatcgagcagggcaccctgaacatcaccatcgtgaacctgagtgatgctggcatgtaccagtgcctggccgagaacaagcatggagtcatcttcagcaatgctgagctgtctgtgattgctgtgggccctgacttcagcaggaccctgctgaagagggtgaccctggtgaaggtgggcggggaggtggtgattgagtgcaagcccaaggccagccccaagcctgtgtacacctggaagaagggccgggacatcctgaaggaaaatgaaagaatcaccatcagtgaagatggcaacctgcgcatcatcaacgtgaccaagagtgatgctggcagctacacctgcatcgccaccaaccacttcggcacagccagcagcacaggcaacctggtggtgaaggaccccaccagggtgatggtgccccccagctccatggatgtgacagtgggggagagcatcgtgctgccctgccaggtgacccatgaccacagcctggacatcgtgttcacctggagcttcaacggccacctgattgactttgacagagatggagaccactttgagcgggtgggcggccaggacagcgctggggacctgatgatccggaacatccagctgaagcacgccggcaagtatgtgtgcatggtgcagacctctgtggaccggctgtctgctgctgctgacctgattgtgcggggccccccaggccccccagaggccgtgaccattgatgagatcacagacaccacagcccagctgtcctggaggcctggccctgacaaccacagccccatcaccatgtatgtgatccaggcccggacccccttctctgtgggctggcaggccgtgtccacagtgcctgagctgattgatggcaagaccttcaccgccaccgtggtgggcctgaacccctgggtggagtatgagttcagaacagtggccgccaacgtgattggaattggagagcccagccggcccagcgagaagagaagaacagaggaggccctgcctgaggtgaccccagccaacgtgtctgggggcggcggcagcaagtctgagctggtgatcacctgggagaccgtgcctgaggagctgcagaatggccggggcttcggctacgtggtggccttccggccctacggcaagatgatctggatgctgactgtgctggccagcgcagatgccagccgctacgtgttcagaaatgaatctgtgcaccccttcagcccctttgaggtgaaggtgggcgtcttcaacaacaagggggagggccccttcagccccaccaccgtggtgtacagcgctgaggaggagcccaccaagcccccagccagcatctttgcccggagcctgagcgccacagacatcgaggtgttctgggccagccccctggagaagaacagaggccgcatccagggctatgaggtgaagtactggaggcatgaggacaaggaggagaatgccaggaagatcagaacagtgggcaaccagaccagcaccaagatcaccaacctgaagggctctgtgctgtaccacctggccgtgaaggcctacaacagcgctggcaccggccccagcagcgccaccgtgaatgtgaccaccaggaagcccccacccagccagcccccaggcaacatcatctggaacagcagtgacagcaagatcatcctgaactgggaccaggtgaaggccctggacaatgaaagtgaggtgaagggctacaaggtgctgtaccgctggaaccggcagagcagcaccagcgtcatcgagaccaacaagacctctgtggagctgagcctgccctttgatgaggactacatcatcgagatcaagcccttcagtgatggaggagatggcagcagcagcgagcagatccgcatccccaagatcagcaatgcctatgcccggggcagcggggccagcaccagcaatgcctgcaccctgagcgccatcagcaccatcatgatcagcctgacagcccggagcagcctgtag

SEQ ID NO: 148391 - DNA, 2097 bp, Artificial Sequence
  Description of Artificial Sequence: Synthetic coding sequence
atggaggagaatgtgttctgggagtgcaaggccaacggccggcccaagcccacctacaagtggctgaagaatggagagcccctgctgacccgggaccgcatccagatcgagcagggcaccctgaacatcaccatcgtgaacctgagtgatgctggcatgtaccagtgcctggccgagaacaagcacggcgtcatcttcagcaatgctgagctgtctgtgattgctgtgggccctgacttcagcaggaccctgctgaagagggtgaccctggtgaaggtgggcggggaggtggtgattgagtgcaagcccaaggccagccccaagcctgtgtacacctggaagaagggccgggacatcctgaaggaaaatgaaagaatcaccatcagtgaagatggcaacctgcgcatcatcaacgtgaccaagagtgatgctggcagctacacctgcatcgccaccaaccactttggaacagccagcagcactggaaacctggtggtgaaggaccccaccagggtgatggtgccccccagctccatggatgtgacagtgggggagagcatcgtgctgccctgccaggtgacccatgaccacagcctggacatcgtgttcacctggagcttcaacggccacctgattgactttgacagagatggagaccactttgagcgggtgggcggccaggacagcgctggggacctgatgatccggaacatccagctgaagcatgctgggaagtatgtgtgcatggtgcagacctctgtggaccggctgtctgctgctgctgacctgattgtgcggggccccccaggccccccagaggccgtgaccattgatgagatcacagacaccacagcccagctgtcctggaggcctggccctgacaaccacagccccatcaccatgtatgtgatccaggcccggacccccttctctgtgggctggcaggccgtgtccacagtgcctgagctgattgatggcaagaccttcaccgccaccgtggtgggcctgaacccctgggtggagtatgagttcagaacagtggccgccaacgtcatcggcatcggggagcccagccggcccagcgagaagagaagaacagaggaggccctgcctgaggtgaccccagccaacgtgtctgggggcggcggcagcaagtctgagctggtgatcacctgggagaccgtgcctgaggagctgcagaatggccggggcttcggctacgtggtggccttccggccctacggcaagatgatctggatgctgactgtgctggccagcgcagatgccagccgctacgtgttcagaaatgaatctgtgcaccccttcagcccctttgaggtgaaggtgggcgtcttcaacaacaagggggagggccccttcagccccaccaccgtggtgtacagcgctgaggaggagcccaccaagcccccagccagcatctttgcccggagcctgagcgccacagacatcgaggtgttctgggccagccccctggagaagaacagaggccgcatccagggctatgaggtgaagtactggaggcatgaggacaaggaggagaatgccaggaagatcagaacagtgggcaaccagaccagcaccaagatcaccaacctgaagggctctgtgctgtaccacctggccgtgaaggcctacaacagcgctggcaccggccccagcagcgccaccgtgaatgtgaccaccaggaagcccccacccagccagcccccaggcaacatcatctggaacagcagtgacagcaagatcatcctgaactgggaccaggtgaaggccctggacaatgaaagtgaggtgaagggctacaaggtgctgtaccgctggaaccggcagagcagcacctctgtgattgagaccaacaagacctctgtggagctgagcctgccctttgatgaggactacatcatcgagatcaagcccttcagtgatggaggagatggcagcagcagcgagcagatccgcatccccaagatcagcaatgcctatgcccggggcagcggggccagcaccagcaatgcctgcaccctgagcgccatcagcaccatcatgatcagcctgacagcccggagcagcctgtag

SEQ ID NO: 148392 - DNA, 3081 bp, Artificial Sequence
  Description of Artificial Sequence: Synthetic coding sequence
atgaggctgccctgggagctgctggtgctgcagagcttcatcctgtgcctggctgatgacagcaccctgcacggccccatcttcatccaggagcccagccctgtgatgttccccctggacagcgaggagaagaaggtgaagctgaactgtgaggtgaagggcaaccccaagccccacatccgctggaagctgaatggaacagatgtggacaccggcatggacttccgctacagcgtggtggagggcagcctgctgatcaacaaccccaacaagacccaggatgctggcacctaccagtgcacagccaccaacagctttggcaccatcgtgtcccgggaggccaagctgcagtttgcctacctggacaacttcaagaccaggaccaggagcacagtgtctgtgagaagaggccagggcatggtgctgctgtgtggccccccaccccacagcggggagctgtcctatgcctggatcttcaatgagtaccccagctaccaggacaacagaagatttgtgtcccaggagaccggcaacctgtacatcgccaaggtggagaagagtgatgtgggcaactacacctgtgtggtgaccaacacagtgaccaaccacaaggtgctgggcccccccacccccctcatcctgagaaatgatggagtgatgggagaatatgagcccaagattgaggtgcagtttcctgagaccgtgcccacagccaagggggccaccgtgaagctggagtgctttgccctgggcaaccctgtgcccaccatcatctggaggagagcagatggcaagcccatcgccaggaaggcccggcggcacaagagcaatggcatcctggagatccccaacttccagcaggaggatgctggcctgtatgaatgtgtggccgagaacagccggggcaagaatgtggcccggggccagctgaccttctacgcccagcccaactggatccagaagatcaatgacatccacgtggccatggaggagaatgtgttctgggagtgcaaggccaacggccggcccaagcccacctacaagtggctgaagaatggagagcccctgctgacccgggaccgcatccagatcgagcagggcaccctgaacatcaccatcgtgaacctgagtgatgctggcatgtaccagtgcctggccgagaacaagcacggcgtcatcttcagcaatgctgagctgtctgtgattgctgtgggccctgacttcagcaggaccctgctgaagagggtgaccctggtgaaggtgggcggggaggtggtgattgagtgcaagcccaaggccagccccaagcctgtgtacacctggaagaagggccgggacatcctgaaggaaaatgaaagaatcaccatcagtgaagatggcaacctgcgcatcatcaacgtgaccaagagtgatgctggcagctacacctgcatcgccaccaaccactttggaacagccagcagcactggaaacctggtggtgaaggaccccaccagggtgatggtgccccccagctccatggatgtgacagtgggggagagcatcgtgctgccctgccaggtgacccatgaccacagcctggacatcgtgttcacctggagcttcaacggccacctgattgactttgacagagatggagaccactttgagcgggtgggcggccaggacagcgctggggacctgatgatccggaacatccagctgaagcatgctgggaagtatgtgtgcatggtgcagacctctgtggaccggctgtctgctgctgctgacctgattgtgcggggccccccaggccccccagaggccgtgaccattgatgagatcacagacaccacagcccagctgtcctggaggcctggccctgacaaccacagccccatcaccatgtatgtgatccaggcccggacccccttctctgtgggctggcaggccgtgtccacagtgcctgagctgattgatggcaagaccttcaccgccaccgtggtgggcctgaacccctgggtggagtatgagttcagaacagtggccgccaacgtcatcggcatcggggagcccagccggcccagcgagaagagaagaacagaggaggccctgcctgaggtgaccccagccaacgtgtctgggggcggcggcagcaagtctgagctggtgatcacctgggagaccgtgcctgaggagctgcagaatggccggggcttcggctacgtggtggccttccggccctacggcaagatgatctggatgctgactgtgctggccagcgcagatgccagccgctacgtgttcagaaatgaatctgtgcaccccttcagcccctttgaggtgaaggtgggcgtcttcaacaacaagggggagggccccttcagccccaccaccgtggtgtacagcgctgaggaggagcccaccaagcccccagccagcatctttgcccggagcctgagcgccacagacatcgaggtgttctgggccagccccctggagaagaacagaggccgcatccagggctatgaggtgaagtactggaggcatgaggacaaggaggagaatgccaggaagatcagaacagtgggcaaccagaccagcaccaagatcaccaacctgaagggctctgtgctgtaccacctggccgtgaaggcctacaacagcgctggcaccggccccagcagcgccaccgtgaatgtgaccaccaggaagcccccacccagccagcccccaggcaacatcatctggaacagcagtgacagcaagatcatcctgaactgggaccaggtgaaggccctggacaatgaaagtgaggtgaagggctacaaggtgctgtaccgctggaaccggcagagcagcacctctgtgattgagaccaacaagacctctgtggagctgagcctgccctttgatgaggactacatcatcgagatcaagcccttcagtgatggaggagatggcagcagcagcgagcagatccgcatccccaagatcagcaatgcctatgcccggggcagcggggccagcaccagcaatgcctgcaccctgagcgccatcagcaccatcatgatcagcctgacagcccggagcagcctgtag

SEQ ID NO: 148393 - DNA, 3081 bp, Artificial Sequence; identical to SEQ ID NO: 148392
  Description of Artificial Sequence: Synthetic coding sequence

SEQ ID NO: 148394 - DNA, 351 bp, Artificial Sequence
  Description of Artificial Sequence: Synthetic coding sequence
atgaggctgccctgggagctgctggtgctgcagagcttcatcctgtgcctggctgatgacagcaccctgcacggccccatcttcatccaggagcccagccctgtgatgttccccctggacagcgaggagaagaaggtgaagctgaactgtgaggtgaagggcaaccccaagccccacatccgctggaagctgaatggaacagatgtggacaccggcatggacttccgctacagcgtggtggagggcagcctgctgatcaacaaccccaacaagacccaggatgctggcacctaccagtgcacagccaccaacagctttggcaccatcgtgtcccgggaggccaagctgtag

SEQ ID NO: 148395 - DNA, 3081 bp, Artificial Sequence; identical to SEQ ID NO: 148392
  Description of Artificial Sequence: Synthetic coding sequence

SEQ ID NO: 148396 - DNA, 2097 bp, Artificial Sequence; identical to SEQ ID NO: 148391
  Description of Artificial Sequence: Synthetic coding sequence

SEQ ID NO: 148397 - DNA, 165 bp, Artificial Sequence
  Description of Artificial Sequence: Synthetic coding sequence
atgaggctgccctgggagctgctggtgctgcagagcttcatcctgtgcctggctgatgacagcaccctgcacggccccatcttcatccaggagcccagccctgtgatgttccccctggacagcgaggagaagaaggtgaagctgaactgtgaggtgaagggctag

SEQ ID NO: 148398 - DNA, 3303 bp, Artificial Sequence
  Description of Artificial Sequence: Synthetic coding sequence
atggccagctcctggaagctgatgctgttcctgtctgtgaccatgtgcctgtctgagtacagcaagagcctgcccggcctgagcaccagctatgctgccctgctgcgcatcaagaagagcagcagcagcagcctgtttggcagcaagacccggccccgctacagcagccccagcctgggcaccctgagcgccagcagccccagctggctgggcgccgcccagaactactacagccccatcaacctgtaccacagcagtgatgccttcaagcaggatgagagcgtggactatggccctgtgtttgtgcaggagccagatgacatcatcttccccacagacagtgatgagaagaaggtggccctgaactgtgaggtgcggggcaaccctgtgcccagctaccgctggctgagaaatggaacagaaattgacctggagagtgactaccgctacagcctgattgatggcaccttcatcatcagcaaccccagcgaggccaaggacagcggccactaccagtgcctggccaccaacacagtgggcagcatcctgagccgggaggccaccctgcagtttgcctacctgggcaacttcagcggccgcaccaggtctgctgtgtctgtgcgggagggccagggcgtggtgctgatgtgcagccccccaccccacagccctgagatcatctacagctgggtgttcaatgagttccccagctttgtggccgaggacagccgccgcttcatcagccaggagactggaaacctgtacatcagcaaggtgcagaccagtgatgtgggcagctacatctgcctggtgaagaacacagtgaccaatgcccgggtgctgagcccccccacccccctgaccctgagaaatgatggagtgatgggagaatatgagcccaagattgaggtgcacttccccttcaccgtgacagctgccaagggcaccaccgtgaagatggagtgctttgccctgggcaaccctgtgcccaccatcacctggatgaaggtgaatggctacatccccagcaaggcccggctgaggaagagccaggccgtgctggagatccccaacgtgcagctggatgatgctggcatctatgagtgcagagctgagaacagccggggcaagaacagcttccggggccagctgcaggtgtacacctacccccactgggtggagaagctgaatgacacccagctggacagcggcagccccctgcgctgggagtgcaaggccaccgggaagccccggcccacctaccgctggctgaagaatggagtgcccctgagcccccagagccgggtggagatggtgaatggagtgctgatgatccacaacgtgaaccagagtgatgctggcatgtaccagtgcctggccgagaacaagtacggggccatctatgccagcgctgagctgaagatcctggccagcgcccccacctttgccctgaaccagctgaagaagaccatcatcgtgaccaaggaccaggaggtggtgattgagtgcaagccccagggcagccccaagcccaccatctcctggaagaagggggacagagctgtgcgggagaacaagagaattgccatcctgcctgatggcagcctgcgcatcctgaatgccagcaagagtgatgagggcaagtatgtgtgccgcggggagaatgtgtttggatctgctgagatcatcgccagcctgtctgtgaaggagcccacccgcatcgagctgacccccaagaggacagagctgactgtgggggagagcatcgtgctgaactgcaaggccatccatgatgccagcctggatgtgaccttctactggaccctgaagggccagcccatcgactttgaggaggagggcggccactttgagagcatccgggcccaggccagcagcgctgacctgatgatccggaacatcctgctgatgcatgctggccgctatggctgccgggtgcagaccacagctgacagcgtgtctgatgaagctgagctgctggtgcggggccccccaggccccccaggcatcgtcatcgtggaggagatcacagagagcacagccaccctgtcctggagccctgctgctgacaaccacagccccatcagcagctacaacctgcaggcccggagccccttcagcctgggctggcagacagtgaagacagtgcctgagatcatcactggagacatggagagcgccatggctgtggacctgaacccctgggtggagtatgagttccgggtggtggccaccaaccccatcggcaccggggaccccagcacccccagcaggatgatccgcaccaatgaagctgtgcccaagacagcccccaccaacgtgtctggccgcagcggcagaagacatgagctggtgattgcctgggagcctgtgtctgaggagttccagaatggagagggcttcggctacatcgtggccttccggcccaacggcacccggggctggaaggagaagatggtgaccagcagcgaggccagcaagttcatctacagagatgagagcgtgccccccctgaccccatttgaggtgaaggtgggcgtgtacaacaacaagggagatggccccttcagccagatcgtggtgatctgcagcgctgagggggagcccagcgctgcccccacagatgtgaaggccacctctgtgtctgtgtctgagatcctggtggcctggaagcacatcaaggagagcctgggccggccccagggctttgaggtgggctactggaaggacatggagcaggaggacacagctgagaccgtgaagaccagaggaaatgaaagctttgtgatcctgaccggcctggagggcaacaccctgtaccacttcaccgtgcgggcctacaacggggccggctacggcccccccagcagcgaggtgtctgccaccaccaagaagagcccccccagccaggcccccagcaacctgcgctgggagcagcagggcagccaggtgtccctgggctgggagcccgtcatccccctggccaatgaaagtgaggtggtgggctacaaggtgttctaccggcaggagggccacagcaacagccaggtgattgagacccagaagctgcaggccgtggtgcccctgcctgatgctggggtgtacatcatcgaggtgcgggcctacagcgagggcggagatggaacagccagcagccagatccgggtgcccagctacagcggcggcaagatcaccagcgcccagagcaccctgcacagcctgagcaccagcagcagctctgtgaccctgctgctggccctgatgatccccagcacctcctggtag

SEQ ID NO: 148399 - DNA, 3081 bp, Artificial Sequence
  Description of Artificial Sequence: Synthetic coding sequence
atggccagctcctggaagctgatgctgttcctgtctgtgaccatgtgcctgtctgagagcgtggactatggccctgtgtttgtgcaggagccagatgacatcatcttccccacagacagtgatgagaagaaggtggccctgaactgtgaggtgcggggcaaccctgtgcccagctaccgctggctgagaaatggaacagaaattgacctggagagtgactaccgctacagcctgattgatggcaccttcatcatcagcaaccccagcgaggccaaggacagcggccactaccagtgcctggccaccaacacagtgggcagcatcctgagccgggaggccaccctgcagtttgcctacctgggcaacttcagcggccgcaccaggtctgctgtgtctgtgcgggagggccagggcgtggtgctgatgtgcagccccccaccccacagccctgagatcatctacagctgggtgttcaatgagttccccagctttgtggccgaggacagccgccgcttcatcagccaggagactggaaacctgtacatcagcaaggtgcagaccagtgatgtgggcagctacatctgcctggtgaagaacacagtgaccaatgcccgggtgctgagcccccccacccccctgaccctgagaaatgatggagtgatgggagaatatgagcccaagattgaggtgcacttccccttcaccgtgacagctgccaagggcaccaccgtgaagatggagtgctttgccctgggcaaccctgtgcccaccatcacctggatgaaggtgaatggctacatccccagcaaggcccggctgaggaagagccaggccgtgctggagatccccaacgtgcagctggatgatgctggcatctatgagtgcagagctgagaacagccggggcaagaacagcttccggggccagctgcaggtgtacacctacccccactgggtggagaagctgaatgacacccagctggacagcggcagccccctgcgctgggagtgcaaggccaccgggaagccccggcccacctaccgctggctgaagaatggagtgcccctgagcccccagagccgggtggagatggtgaatggagtgctgatgatccacaacgtgaaccagagtgatgctggcatgtaccagtgcctggccgagaacaagtacggggccatctatgccagcgctgagctgaagatcctggccagcgcccccacctttgccctgaaccagctgaagaagaccatcatcgtgaccaaggaccaggaggtggtgattgagtgcaagccccagggcagccccaagcccaccatctcctggaagaagggggacagagctgtgcgggagaacaagagaattgccatcctgcctgatggcagcctgcgcatcctgaatgccagcaagagtgatgagggcaagtatgtgtgccgcggggagaatgtgtttggatctgctgagatcatcgccagcctgtctgtgaaggagcccacccgcatcgagctgacccccaagaggacagagctgactgtgggggagagcatcgtgctgaactgcaaggccatccatgatgccagcctggatgtgaccttctactggaccctgaagggccagcccatcgactttgaggaggagggcggccactttgagagcatccgggcccaggccagcagcgctgacctgatgatccggaacatcctgctgatgcatgctggccgctatggctgccgggtgcagaccacagctgacagcgtgtctgatgaagctgagctgctggtgcggggccccccaggccccccaggcatcgtcatcgtggaggagatcacagagagcacagccaccctgtcctggagccctgctgctgacaaccacagccccatcagcagctacaacctgcaggcccggagccccttcagcctgggctggcagacagtgaagacagtgcctgagatcatcactggagacatggagagcgccatggctgtggacctgaacccctgggtggagtatgagttccgggtggtggccaccaaccccatcggcaccggggaccccagcacccccagcaggatgatccgcaccaatgaagctgtgcccaagacagcccccaccaacgtgtctggccgcagcggcagaagacatgagctggtgattgcctgggagcctgtgtctgaggagttccagaatggagagggcttcggctacatcgtggccttccggcccaacggcacccggggctggaaggagaagatggtgaccagcagcgaggccagcaagttcatctacagagatgagagcgtgccccccctgaccccatttgaggtgaaggtgggcgtgtacaacaacaagggagatggccccttcagccagatcgtggtgatctgcagcgctgagggggagcccagcgctgcccccacagatgtgaaggccacctctgtgtctgtgtctgagatcctggtggcctggaagcacatcaaggagagcctgggccggccccagggctttgaggtgggctactggaaggacatggagcaggaggacacagctgagaccgtgaagaccagaggaaatgaaagctttgtgatcctgaccggcctggagggcaacaccctgtaccacttcaccgtgcgggcctacaacggggccggctacggcccccccagcagcgaggtgtctgccaccaccaagaagagcccccccagccaggcccccagcaacctgcgctgggagcagcagggcagccaggtgtccctgggctgggagcccgtcatccccctggccaatgaaagtgaggtggtgggctacaaggtgttctaccggcaggagggccacagcaacagccaggtgattgagacccagaagctgcaggccgtggtgcccctgcctgatgctggggtgtacatcatcgaggtgcgggcctacagcgagggcggagatggaacagccagcagccagatccgggtgcccagctacagcggcggcaagatcaccagcgcccagagcaccctgcacagcctgagcaccagcagcagctctgtgaccctgctgctggccctgatgatccccagcacctcctggtag

SEQ ID NO: 148400 - DNA, 3303 bp, Artificial Sequence; identical to SEQ ID NO: 148398
  Description of Artificial Sequence: Synthetic coding sequence

SEQ ID NO: 148401 - DNA, 3303 bp, Artificial Sequence; identical to SEQ ID NO: 148398
  Description of Artificial Sequence: Synthetic coding sequence

SEQ ID NO: 148402 - DNA, 2736 bp, Artificial Sequence
  Description of Artificial Sequence: Synthetic coding sequence
atggccagctcctggaagctgatgctgttcctgtctgtgaccatgtgcctgtctgagtacagcaagagcctgcccggcctgagcaccagctatgctgccctgctgcgcatcaagaagagcagcagcagcagcctgtttggcagcaagacccggccccgctacagcagccccagcctgggcaccctgagcgccagcagccccagctggctgggcgccgcccagaactactacagccccatcaacctgtaccacagcagtgatgccttcaagcaggatgagagcgtggactatggccctgtgtttgtgcaggagccagatgacatcatcttccccacagacagtgatgagaagaaggtggccctgaactgtgaggtgcggggcaaccctgtgcccagctaccgctggctgagaaatggaacagaaattgacctggagagtgactaccgctacagcctgattgatggcaccttcatcatcagcaaccccagcgaggccaaggacagcggccactaccagtgcctggccaccaacacagtgggcagcatcctgagccgggaggccaccctgcagtttgcctacctgggcaacttcagcggccgcaccaggtctgctgtgtctgtgcgggagggccagggcgtggtgctgatgtgcagccccccaccccacagccctgagatcatctacagctgggtgttcaatgagttccccagctttgtggccgaggacagccgccgcttcatcagccaggagactggaaacctgtacatcagcaaggtgcagaccagtgatgtgggcagctacatctgcctggtgaagaacacagtgaccaatgcccgggtgctgagcccccccacccccctgaccctgagaaatgatggagtgatgggagaatatgagcccaagattgaggtgcacttccccttcaccgtgacagctgccaagggcaccaccgtgaagatggagtgctttgccctgggcaaccctgtgcccaccatcacctggatgaaggtgaatggctacatccccagcaaggcccggctgaggaagagccaggccgtgctggagatccccaacgtgcagctggatgatgctggcatctatgagtgcagagctgagaacagccggggcaagaacagcttccggggccagctgcaggtgtacacctacccccactgggtggagaagctgaatgacacccagctggacagcggcagccccctgcgctgggagtgcaaggccaccgggaagccccggcccacctaccgctggctgaagaatggagtgcccctgagcccccagagccgggtggagatggtgaatggagtgctgatgatccacaacgtgaaccagagtgatgctggcatgtaccagtgcctggccgagaacaagtacggggccatctatgccagcgctgagctgaagatcctggccagcgcccccacctttgccctgaaccagctgaagaagaccatcatcgtgaccaaggaccaggaggtggtgattgagtgcaagccccagggcagccccaagcccaccatctcctggaagaagggggacagagctgtgcgggagaacaagagaattgccatcctgcctgatggcagcctgcgcatcctgaatgccagcaagagtgatgagggcaagtatgtgtgccgcggggagaatgtgtttggatctgctgagatcatcgccagcctgtctgtgaaggagcccacccgcatcgagctgacccccaagaggacagagctgactgtgggggagagcatcgtgctgaactgcaaggccatccatgatgccagcctggatgtgaccttctactggaccctgaagggccagcccatcgactttgaggaggagggcggccactttgagagcatccgggcccaggccagcagcgctgacctgatgatccggaacatcctgctgatgcatgctggccgctatggctgccgggtgcagaccacagctgacagcgtgtctgatgaagctgagctgctggtgcggggccccccaggccccccaggcatcgtcatcgtggaggagatcacagagagcacagccaccctgtcctggagccctgctgctgacaaccacagccccatcagcagctacaacctgcaggcccggagccccttcagcctgggctggcagacagtgaagacagtgcctgagatcatcactggagacatggagagcgccatggctgtggacctgaacccctgggtggagtatgagttccgggtggtggccaccaaccccatcggcaccggggaccccagcacccccagcaggatgatccgcaccaatgaagctgtgcccaagacagcccccaccaacgtgtctggccgcagcggcagaagacatgagctggtgattgcctgggagcctgtgtctgaggagttccagaatggagagggcttcggctacatcgtggccttccggcccaacggcacccggggctggaaggagaagatggtgaccagcagcgaggccagcaagttcatctacagagatgagagcgtgccccccctgaccccatttgaggtgaaggtgggcgtgtacaacaacaagggagatggccccttcagccagatcgtggtgatctgcagcgctgagggggagcccagcgctgcccccacagatgtgaaggccacctctgtgtctgtgtctgagatcctggtggcctggaagcacatcaaggagagcctgggccggccccagggctttgaggtgtag

SEQ ID NO: 148403 - DNA, 3087 bp, Artificial Sequence
  Description of Artificial Sequence: Synthetic coding sequence
atgaggctgctgtggaagctggtgatcctgctgcccctcatcaacagcagcgctggagatggcctgctgagccggcccatcttcacccaggagccccatgatgtgatcttccccctggacctgagcaagtctgaggtgatcctgaactgtgccgccaacggctaccccagcccccactaccgctggaagcagaatggaacagacatcgacttcaccatgagctaccactaccgcctggatggcggcagcctggccatcaacagcccccacacagaccaggacatcggcatgtaccagtgcctggccaccaacctgctgggcaccatcctgagcaggaaggccaagctgcagtttgcctacatcgaggactttgagaccaagaccaggagcacagtgtctgtgcgggagggccagggcgtggtgctgctgtgtggccccccaccccactttggagacctgtcctatgcctggaccttcaatgacaaccccctgtatgtgcaggaggacaacagaagatttgtgtcccaggagaccggcaacctgtacatcgccaaggtggagcccagtgatgtgggcaactacacctgcttcatcaccaacaaggaggcccagaggtctgtgcagggcccccccacccccctggtgcagaggacagatggagtgatgggagaatatgagcccaagattgaggtgcgcttccctgagaccatccaggccgccaaggacagctctgtgaagctggagtgctttgccctgggcaaccctgtgcctgacatctcctggaggcggctggatggcagccccctgcccgggaaggtgaagtacagcaagagccaggccatcctggagatccccaacttccagcaggaggatgagggcttctatgagtgcatcgccagcaacctgcggggcaggaacctggccaagggccagctgatcttctacgcccctcctgagtgggagcagaagatccagaacacccacctgagcatctatgacaacctgctgtgggagtgcaaggccagcggcaagcccaacccctggtacacctggctgaagaatggagagcggctgaaccctgaggagcgcatccagattgaaaatggcaccctcatcatcaccatgctgaatgtgtctgattctggagtgtaccagtgtgccgctgagaacaagtaccagatcatctatgccaatgctgagctgcgggtgctggccagcgccccagacttcagcaagagccctgtgaagaagaagagctttgtgcaggtgggcggggacatcgtgattggctgcaagcccaatgccttccccagggctgccatctcctggaagaggggcacagagaccctgcggcagagcaagaggatcttcctgctggaggatggcagcctgaagatctacaacatcaccaggagtgatgctggcagctacacctgcatcgccaccaaccagtttggaacagccaagaacacaggcagcctgattgtgaaggagaggacagtcatcaccgtgccccccagcaagatggatgtgacagtgggggagagcatcgtgctgccctgccaggtgtcccatgaccccagcattgaggtggtgtttgtgtggttcttcaatggagatgtgattgacctgaagaagggcgtggcccactttgagcgcatcggcggggagagcgtgggggacctgatgatccggaacatccagctgcaccacagcggcaagtacctgtgcaccgtgcagaccaccctggagagcctgtctgctgtggccgacatcatcgtgcggggccccccaggccccccagaagatgtgcaggtggaggacatcagcagcaccaccagccagctgtcctggagggctggccctgacaacaacagccccatccagatcttcaccatccagaccaggacccccttctctgtgggctggcaggccgtggccaccgtgcctgagatcctgaatggcaagacctacaatgccaccgtggtgggcctgagcccctgggtggagtatgagttccgggtggtggccggcaacagcattggaattggagagcccagcgagcccagcgagctgctgcggaccaaggcctctgtgcctgtggtggcccctgtgaacatccacggcggcggcggcagccgctctgagctggtgatcacctgggagagcatccctgaggagctgcagaatggagagggcttcggctacatcatcatgttccggcctgtgggcagcaccacctggagcaaggagaaggtgtcctctgtggagagcagcagatttgtgtacagaaatgaaagcatcatccccctgagcccctttgaggtgaaggtgggcgtgtacaacaatgaaggagagggcagcctgagcacagtgaccatcgtgtacagcggagaagatgagccccagctggccccccggggcaccagcctgcagagcttcagcgccagcgagatggaggtgtcctggaatgccatcgcctggaacagaaacacaggccgggtgctgggctatgaggtgctgtactggacagatgacagcaaggagagcatgattggcaagatccgggtgtctggaaatgtgaccaccaagaacatcaccggcctgaaggccaacaccatctactttgcctctgtgcgggcctacaacacagctggcaccggccccagcagcccccctgtgaatgtgaccaccaagaagagcccccccagccagcccccagccaacatcgcctggaagctgaccaacagcaagctgtgcctgaactgggagcacgtgaagaccatggagaatgaaagtgaggtgctgggctacaagatcctgtaccggcagaaccggcagagcaagacccacatcctggagaccaacaacaccagcgctgagctgctggtgccctttgaggaggactacctgattgagatcagaacagtgtctgatggaggagatggcagcagcagcgaggagatccgcatccccaagatgagcagcctgagcagccggggcatccagttcctggagcccagcacccacttcctgagcatcgtcatcgtcatcttccactgctttgccatccagcccctcatctag

SEQ ID NO: 148404 - DNA, 3087 bp, Artificial Sequence; identical to SEQ ID NO: 148403
  Description of Artificial Sequence: Synthetic coding sequence

SEQ ID NO: 148405 - DNA, 2871 bp, Artificial Sequence
  Description of Artificial Sequence: Synthetic coding sequence
atgagctaccactaccgcctggatggcggcagcctggccatcaacagcccccacacagaccaggacatcggcatgtaccagtgcctggccaccaacctgctgggcaccatcctgagcaggaaggccaagctgcagtttgcctacatcgaggactttgagaccaagaccaggagcacagtgtctgtgcgggagggccagggcgtggtgctgctgtgtggccccccaccccactttggagacctgtcctatgcctggaccttcaatgacaaccccctgtatgtgcaggaggacaacagaagatttgtgtcccaggagaccggcaacctgtacatcgccaaggtggagcccagtgatgtgggcaactacacctgcttcatcaccaacaaggaggcccagaggtctgtgcagggcccccccacccccctggtgcagaggacagatggagtgatgggagaatatgagcccaagattgaggtgcgcttccctgagaccatccaggccgccaaggacagctctgtgaagctggagtgctttgccctgggcaaccctgtgcctgacatctcctggaggcggctggatggcagccccctgcccgggaaggtgaagtacagcaagagccaggccatcctggagatccccaacttccagcaggaggatgagggcttctatgagtgcatcgccagcaacctgcggggcaggaacctggccaagggccagctgatcttctacgcccctcctgagtgggagcagaagatccagaacacccacctgagcatctatgacaacctgctgtgggagtgcaaggccagcggcaagcccaacccctggtacacctggctgaagaatggagagcggctgaaccctgaggagcgcatccagattgaaaatggcaccctcatcatcaccatgctgaatgtgtctgattctggagtgtaccagtgtgccgctgagaacaagtaccagatcatctatgccaatgctgagctgcgggtgctggccagcgccccagacttcagcaagagccctgtgaagaagaagagctttgtgcaggtgggcggggacatcgtgattggctgcaagcccaatgccttccccagggctgccatctcctggaagaggggcacagagaccctgcggcagagcaagaggatcttcctgctggaggatggcagcctgaagatctacaacatcaccaggagtgatgctggcagctacacctgcatcgccaccaaccagtttggaacagccaagaacacaggcagcctgattgtgaaggagaggacagtcatcaccgtgccccccagcaagatggatgtgacagtgggggagagcatcgtgctgccctgccaggtgtcccatgaccccagcattgaggtggtgtttgtgtggttcttcaatggagatgtgattgacctgaagaagggcgtggcccactttgagcgcatcggcggggagagcgtgggggacctgatgatccggaacatccagctgcaccacagcggcaagtacctgtgcaccgtgcagaccaccctggagagcctgtctgctgtggccgacatcatcgtgcggggccccccaggccccccagaagatgtgcaggtggaggacatcagcagcaccaccagccagctgtcctggagggctggccctgacaacaacagccccatccagatcttcaccatccagaccaggacccccttctctgtgggctggcaggccgtggccaccgtgcctgagatcctgaatggcaagacctacaatgccaccgtggtgggcctgagcccctgggtggagtatgagttccgggtggtggccggcaacagcattggaattggagagcccagcgagcccagcgagctgctgcggaccaaggcctctgtgcctgtggtggcccctgtgaacatccacggcggcggcggcagccgctctgagctggtgatcacctgggagagcatccctgaggagctgcagaatggagagggcttcggctacatcatcatgttccggcctgtgggcagcaccacctggagcaaggagaaggtgtcctctgtggagagcagcagatttgtgtacagaaatgaaagcatcatccccctgagcccctttgaggtgaaggtgggcgtgtacaacaatgaaggagagggcagcctgagcacagtgaccatcgtgtacagcggagaagatgagccccagctggccccccggggcaccagcctgcagagcttcagcgccagcgagatggaggtgtcctggaatgccatcgcctggaacagaaacacaggccgggtgctgggctatgaggtgctgtactggacagatgacagcaaggagagcatgattggcaagatccgggtgtctggaaatgtgaccaccaagaacatcaccggcctgaaggccaacaccatctactttgcctctgtgcgggcctacaacacagctggcaccggccccagcagcccccctgtgaatgtgaccaccaagaagagcccccccagccagcccccagccaacatcgcctggaagctgaccaacagcaagctgtgcctgaactgggagcacgtgaagaccatggagaatgaaagtgaggtgctgggctacaagatcctgtaccggcagaaccggcagagcaagacccacatcctggagaccaacaacaccagcgctgagctgctggtgccctttgaggaggactacctgattgagatcagaacagtgtctgatggaggagatggcagcagcagcgaggagatccgcatccccaagatgagcagcctgagcagccggggcatccagttcctggagcccagcacccacttcctgagcatcgtcatcgtcatcttccactgctttgccatccagcccctcatctag

SEQ ID NO: 148406 - DNA, 3996 bp, Artificial Sequence
  Description of Artificial Sequence: Synthetic coding sequence
atgcaggccgcccccagggctggctgtggggccgccctgctgctgtggatcgtgagcagctgcctgtgccgggcctggacagcccccagcaccagccagaagtgtgatgagcccctggtgtctggcctgccccacgtggccttcagcagcagcagcagcatcagcggcagctacagccctggctacgccaagatcaacaagagaggaggagctgggggctggagccccagcgacagcgaccactaccagtggctgcaggtggactttggaaacaggaagcagatcagcgccatcgccacccagggccgctacagcagcagtgactgggtgacccagtacaggatgctgtacagcgacaccggcaggaactggaagccctaccaccaggacggcaacatctgggccttccctggcaacatcaacagtgatggagtggtgagacatgagctgcagcaccccatcatcgcccgctacgtgagaattgtgcccctggactggaatggagagggccgcatcggcctgcgcatcgaggtgtatggctgcagctactgggcagatgtgatcaactttgatggccacgtggtgctgccctaccgcttcaggaacaagaagatgaagaccctgaaggatgtgattgccctgaacttcaagaccagcgagagcgagggcgtcatcctgcatggagagggccagcagggcgactacatcaccctggagctgaagaaggccaagctggtgctgagcctgaacctgggcagcaaccagctgggccccatctacggccacacctctgtgatgacaggcagcctgctggatgaccaccactggcacagcgtggtgattgagcggcagggccgcagcatcaacctgaccctggaccgctccatgcagcacttccgcaccaacggggagtttgactacctggacctggactatgagatcaccttcggcggcatccccttcagcggcaagcccagcagcagcagcaggaagaacttcaagggctgcatggagagcatcaactacaatggagtgaacatcacagacctggcccggaggaagaagctggagcccagcaatgtgggcaacctgtccttcagctgtgtggagccctacacagtgcctgtgttcttcaatgccaccagctacctggaggtgcccggccgcctgaaccaggacctcttctctgtgtccttccagttccgcacctggaaccccaacggcctgctggtgttcagccactttgctgacaacctgggcaatgtggagattgacctgacagagagcaaggtgggcgtgcacatcaacatcacccagaccaagatgagccagattgacatcagcagcggcagcggcctgaatgatggccagtggcatgaggtgcgcttcctggccaaggaaaattttgccatcctgaccattgatggagatgaggccagcgctgtgaggaccaacagccccctgcaggtgaagacaggagagaagtacttcttcggcggcttcctgaaccagatgaacaacagcagccacagcgtgctgcagcccagcttccagggctgcatgcagctgatccaggtggatgaccagctggtgaacctgtatgaggtggcccagaggaagccaggcagctttgccaacgtgtccattgacatgtgtgccatcatcgacagatgtgtgcccaaccactgtgaacatggaggcaagtgcagccagacctgggacagcttcaagtgcacctgtgatgaaacaggctacagcggggccacctgccacaacagcatctatgagcccagctgtgaggcctacaagcacctgggccagaccagcaactactactggattgatcctgatggcagcggccccctgggccccctgaaggtgtactgcaacatgacagaggacaaggtgtggaccatcgtgtcccatgacctgcagatgcagacccctgtggtgggctacaaccctgagaagtacagcgtgacccagctggtgtacagcgcctccatggaccagatcagcgccatcacagacagcgctgagtactgtgagcagtatgtgtcctacttctgcaagatgagccggctgctgaacaccccagatggcagcccctacacctggtgggtgggcaaggccaatgagaagcactactactggggcggcagcggccctggcatccagaagtgtgcctgtggcatcgagaggaactgcacagaccccaagtactactgcaactgtgatgctgactacaagcagtggaggaaggatgctggcttcctgagctacaaggaccacctgcctgtgtcccaggtggtggtgggggacacagaccggcagggcagcgaggccaagctgtctgtgggccccctgcgctgccagggcgacaggaactactggaatgctgccagcttccccaaccccagcagctacctgcacttcagcaccttccagggcgagaccagcgctgacatctccttctacttcaagaccctgaccccctggggcgtcttcctggagaacatgggcaaggaggacttcatcaagctggagctgaagagcgccacagaggtgtccttctcctttgatgtgggcaatggacctgtggagatcgtggtgcgcagccccacccccctgaatgatgaccagtggcaccgggtgacagctgagagaaatgtgaagcaggccagcctgcaggtggaccggctgccccagcagatcaggaaggcccccacagagggccacacccggctggagctgtacagccagctgtttgtgggcggggccggcggccagcagggcttcctgggctgcatccgcagcctgaggatgaatggagtgaccctggacctggaggagcgggccaaggtgaccagcggcttcatcagcggctgcagcggccactgcaccagctatggcaccaactgtgaaaatggaggcaagtgcctggagcgctaccacggctacagctgtgactgcagcaacacagcctatgatggcaccttctgcaacaaggatgtgggcgccttctttgaggagggcatgtggctgcgctacaacttccaggccccagccaccaatgcccgggacagcagcagccgggtggacaatgccccagaccagcagaacagccacccagacctggcccaggaggagatccgcttctccttcagcaccaccaaggccccctgcatcctgctgtacatcagcagcttcaccacagacttcctggccgtgctggtgaagcccaccggcagcctgcagatccgctacaacctgggcggcacccgggagccctacaacattgatgtggaccacaggaacatggccaacggccagccccacagcgtgaacatcaccaggcatgagaagaccatcttcctgaagctggaccactaccccagcgtgtcctaccacctgcccagcagcagtgacaccctcttcaacagccccaagagcctcttcctgggcaaggtgattgagaccgggaagattgaccaggagatccacaagtacaacaccccaggcttcaccggctgcctgagccgggtgcagttcaaccagatcgcccccctgaaggccgccctgcggcagaccaatgccagcgcccacgtgcacatccagggcgagctggtggagagcaactgtggggccagccccctgaccctgagccccatgagcagcgccacagacccctggcacctggaccacctggacagcgccagcgctgacttcccctacaaccctggccagggccaggccatcagaaatggagtgaacagaaattctgccatcatcggcggcgtgattgctgtggtgatcttcaccatcctgtgcaccctggtgttcctgatccgctacatgttccgccacaagggcacctaccacaccaatgaggccaagggagctgagagcgctgagagcgcagatgctgccatcatgaacaatgaccccaacttcacagagaccattgatgagagcaagaaggagtggctgatctag

SEQ ID NO: 148407 - DNA, 1173 bp, Artificial Sequence
  Description of Artificial Sequence: Synthetic coding sequence
atgaatggagtgaccctggacctggaggagcgggccaaggtgaccagcggcttcatcagcggctgcagcggccactgcaccagctatggcaccaactgtgaaaatggaggcaagtgcctggagcgctaccacggctacagctgtgactgcagcaacacagcctatgatggcaccttctgcaacaaggatgtgggcgccttctttgaggagggcatgtggctgcgctacaacttccaggccccagccaccaatgcccgggacagcagcagccgggtggacaatgccccagaccagcagaacagccacccagacctggcccaggaggagatccgcttctccttcagcaccaccaaggccccctgcatcctgctgtacatcagcagcttcaccacagacttcctggccgtgctggtgaagcccaccggcagcctgcagatccgctacaacctgggcggcacccgggagccctacaacattgatgtggaccacaggaacatggccaacggccagccccacagcgtgaacatcaccaggcatgagaagaccatcttcctgaagctggaccactaccccagcgtgtcctaccacctgcccagcagcagtgacaccctcttcaacagccccaagagcctcttcctgggcaaggtgattgaaacaggcaagattgaccaggagatccacaagtacaacaccccaggcttcaccggctgcctgagccgggtgcagttcaaccagatcgcccccctgaaggccgccctgcggcagaccaatgccagcgcccacgtgcacatccagggcgagctggtggagagcaactgtggggccagccccctgaccctgagccccatgagcagcgccacagacccctggcacctggaccacctggacagcgccagcgctgacttcccctacaaccctggccagggccaggccatcagaaatggagtgaacagaaacagcgccatcattggaggagtgattgctgtggtgatcttcaccatcctgtgcaccctggtgttcctgatccgctacatgttccgccacaagggcacctaccacaccaatgaggccaagggagctgagagcgctgagagcgcagatgctgccatcatgaacaatgaccccaacttcacagagaccattgatgagagcaagaaggagtggctgatctag

SEQ ID NO: 148408 - DNA, 1353 bp, Artificial Sequence
  Description of Artificial Sequence: Synthetic coding sequence
atgtctgacatggaggatgacttcatgtgtgatgatgaggaggactatgacctggagtacagcgaggacagcaacagcgagcccaacgtggacctggagaaccagtactacaacagcaaggccctgaaggaggatgaccccaaggccgccctgagcagcttccagaaggtgctggagctggagggggagaagggggagtggggcttcaaggccctgaagcagatgatcaagatcaacttcaagctgaccaacttccctgagatgatgaaccgctacaagcagctgctgacctacatccgctctgctgtgaccaggaactacagcgagaagagcatcaacagcatcctggactacatcagcaccagcaagcagaacagcgacttcctgtgccagatggacctgctgcaggagttctatgagaccaccctggaggccctgaaggatgccaagaatgaccggctgtggttcaagaccaacaccaagctgggcaagctgtacctggagcgggaggagtatggcaagctgcagaagatcctgcggcagctgcaccagagctgccagacagatgatggagaagatgacctgaagaagggcacccagctgctggagatctatgccctggagatccagatgtacacagcccagaagaacaacaagaagctgaaggccctgtatgagcagagcctgcacatcaagagcgccatcccccaccccctcatcatgggcgtcatccgggagtgtggcggcaagatgcacctgcgggagggggagtttgagaaggcccacacagacttctttgaggccttcaagaactatgatgaaagtggcagccccaggaggaccacctgcctgaagtacctggtgctggccaacatgctgatgaagagcggcatcaacccctttgacagccaggaggccaagccctacaagaatgaccctgagatcctggccatgaccaacctggtgtctgcctaccagaacaatgacatcacagaatttgagaagatcctgaagaccaaccacagcaacatcatggatgaccccttcatccgggagcacatcgaggagctgctgaggaacatccgcacccaggtgctgatcaagctgatcaagccctacacccgcatccacatccccttcatcagcaaggagctgaacattgatgtggctgatgtggagagcctgctggtgcagtgcatcctggacaacaccatccacggcagaattgaccaggtgaaccagctgctggagctggaccaccagaagaggggcggggcccgctacacagccctggacaagtggaccaaccagctgaacagcctgaaccaggccgtggtgtccaagctggcctag

SEQ ID NO: 148409 - DNA, 1332 bp, Artificial Sequence
  Description of Artificial Sequence: Synthetic coding sequence
atgtctgacatggaggatgacttcatgtgtgatgatgaggaggactatgacctggagtacagcgaggacagcaacagcgagcccaacgtggacctggagaaccagtactacaacagcaaggccctgaaggaggatgaccccaaggccgccctgagcagcttccagaaggtgctggagctggagggggagaagggggagtggggcttcaaggccctgaagcagatgatcaagatcaacttcaagctgaccaacttccctgagatgatgaaccgctacaagcagctgctgacctacatccgctctgctgtgaccaggaactacagcgagaagagcatcaacagcatcctggactacatcagcaccagcaagcagatggacctgctgcaggagttctatgagaccaccctggaggccctgaaggatgccaagaatgaccggctgtggttcaagaccaacaccaagctgggcaagctgtacctggagcgggaggagtatggcaagctgcagaagatcctgcggcagctgcaccagagctgccagacagatgatggagaagatgacctgaagaagggcacccagctgctggagatctatgccctggagatccagatgtacacagcccagaagaacaacaagaagctgaaggccctgtatgagcagagcctgcacatcaagagcgccatcccccaccccctcatcatgggcgtcatcagagaatgtggcggcaagatgcacctgcgggagggggagtttgagaaggcccacacagacttctttgaggccttcaagaactatgatgagagcggcagccccaggaggaccacctgcctgaagtacctggtgctggccaacatgctgatgaagagcggcatcaacccctttgacagccaggaggccaagccctacaagaatgaccctgagatcctggccatgaccaacctggtgtctgcctaccagaacaatgacatcacagaatttgagaagatcctgaagaccaaccacagcaacatcatggatgaccccttcatccgggagcacatcgaggagctgctgaggaacatccgcacccaggtgctgatcaagctgatcaagccctacacccgcatccacatccccttcatcagcaaggagctgaacattgatgtggctgatgtggagagcctgctggtgcagtgcatcctggacaacaccatccacggcagaattgaccaggtgaaccagctgctggagctggaccaccagaagagaggaggagcccgctacacagccctggacaagtggaccaaccagctgaacagcctgaaccaggccgtggtgtccaagctggcctag

SEQ ID NO: 148410 - DNA, 1272 bp, Artificial Sequence
  Description of Artificial Sequence: Synthetic coding sequence
atggccagcgccctggagcagtttgtgaacagcgtgcggcagctgagcgcccagggccagatgacccagctgtgtgagctgatcaacaagtctggagagctgctggccaagaacctgagccacctggacacagtgctgggcgccctggatgtgcaggagcacagcctgggcgtgctggccgtgctgtttgtgaagttctccatgcccagcgtgcctgactttgagaccctcttcagccaggtgcagctgttcatcagcacctgcaatggagagcacatccgctatgccacagacacctttgctggcctgtgccaccagctgaccaatgccctggtggagaggaagcagcccctgcggggcatcggcatcctgaagcaggccatcgacaagatgcagatgaacaccaaccagctgaccagcatccatgctgacctgtgccagctgtgcctgctggccaagtgcttcaagccagccctgccctacctggatgtggacatgatggacatctgcaaggaaaatggagcctatgatgccaagcacttcctgtgctactactactatggaggcatgatctacacaggcctgaagaactttgagcgggccctgtacttctatgagcaggccatcaccaccccagccatggctgtgagccacatcatgctggagagctacaagaagtacatcctggtgtccctcatcctgctgggcaaggtgcagcagctgcccaagtacaccagccagatcgtgggccgcttcatcaagcccctgagcaatgcctaccacgagctggcccaggtgtacagcaccaacaaccccagcgagctgaggaacctggtgaacaagcacagcgagaccttcacccgggacaacaacatgggcctggtgaagcagtgcctgagcagcctgtacaagaagaacatccagaggctgaccaagaccttcctgaccctgagcctgcaggacatggccagccgggtgcagctgagcggcccccaggaggccgagaagtatgtgctgcacatgattgaagatggagagatctttgccagcatcaaccagaaggatggcatggtgtccttccatgacaaccctgagaagtacaacaacccagccatgctgcacaacatcgaccaggagatgctgaagtgcatcgagctggatgagcggctgaaggccatggaccaggagatcaccgtgaacccccagtttgtgcagaagtccatgggcagccaggaggatgattctggcaacaagcccagcagctacagctag

SEQ ID NO: 148411 - DNA, 960 bp, Artificial Sequence
  Description of Artificial Sequence: Synthetic coding sequence
atggccagcgccctggagcagtttgtgaacagcgtgcggcagctgagcgcccagggccagatgacccagctgtgtgagctgatcaacaagtctggagagctgctggccaagaacctgagccacctggacacagtgctgggcgccctggatgtgcaggagcacagcctgggcgtgctggccgtgctgtttgtgaagttctccatgcccagcgtgcctgactttgagaccctcttcagccaggtgcagctgttcatcagcacctgcaatggagagcacatccgctatgccacagacacctttgctggcctgtgccaccagctgaccaatgccctggtggagaggaagcagcccctgcggggcatcggcatcctgaagcaggccatcgacaagatgcagatgaacaccaaccagctgaccagcatccatgctgacctgtgccagctgtgcctgctggccaagtgcttcaagccagccctgccctacctggatgtggacatgatggacatctgcaaggaaaatggagcctatgatgccaagcacttcctgtgctactactactatggaggcatgatctacacaggcctgaagaactttgagcgggccctgtacttctatgagcaggccatcaccaccccagccatggctgtgagccacatcatgctggagagctacaagaagtacatcctggtgtccctcatcctgctgggcaaggtgcagcagctgcccaagtacaccagccagatcgtgggccgcttcatcaagaggcagagcctggccatgctggcccggctggtgctgaacagctggccccaggccgtgctgctgcggctgcccccccgggtgctgggcctgcagcccctgagcaatgcctaccacgagctggcccaggtgtacagcaccaacaaccccagcgagctgaggaacctggtgaacaagcacagcgagaccttcaccaggtag

SEQ ID NO: 148412 - DNA, 834 bp, Artificial Sequence
  Description of Artificial Sequence: Synthetic coding sequence
gccagccccttctgggtgtcctggctgtatggcagccccctgcctgccccacccctgcccggcggggcccggagcggcacctgtgcccccatcctggtgctgcagaatgctgctgaggccctggcccggcagatgacccagctgtgtgagctgatcaacaagtctggagagctgctggccaagaacctgagccacctggacacagtgctgggcgccctggatgtgcaggagcacagcctgggcgtgctggccgtgctgtttgtgaagttctccatgcccagcgtgcctgactttgagaccctcttcagccaggtgcagctgttcatcagcacctgcaatggagagcacatccgctatgccacagacacctttgctggcctgtgccaccagctgaccaatgccctggtggagaggaagcagcccctgcggggcatcggcatcctgaagcaggccatcgacaagatgcagatgaacaccaaccagctgaccagcatccatgctgacctgtgccagctgtgcctgctggccaagtgcttcaagccagccctgccctacctggatgtggacatgatggacatctgcaaggaaaatggagcctatgatgccaagcacttcctgtgctactactactatggaggcatgatctacacaggcctgaagaactttgagcgggccctgtacttctatgagcaggccatcaccaccccagccatggctgtgagccacatcatgctggagagctacaagaagtacatcctggtgtccctcatcctgctgggcaaggtgcagcagctgcccaagtacaccagccagatcgtgggccgcttcatctag

SEQ ID NO: 148413 - DNA, 1212 bp, Artificial Sequence
  Description of Artificial Sequence: Synthetic coding sequence
atgacccagctgtgtgagctgatcaacaagtctggagagctgctggccaagaacctgagccacctggacacagtgctgggcgccctggatgtgcaggagcacagcctgggcgtgctggccgtgctgtttgtgaagttctccatgcccagcgtgcctgactttgagaccctcttcagccaggtgcagctgttcatcagcacctgcaatggagagcacatccgctatgccacagacacctttgctggcctgtgccaccagctgaccaatgccctggtggagaggaagcagcccctgcggggcatcggcatcctgaagcaggccatcgacaagatgcagatgaacaccaaccagctgaccagcatccatgctgacctgtgccagctgtgcctgctggccaagtgcttcaagccagccctgccctacctggatgtggacatgatggacatctgcaaggaaaatggagcctatgatgccaagcacttcctgtgctactactactatggaggcatgatctacacaggcctgaagaactttgagcgggccctgtacttctatgagcaggccatcaccaccccagccatggctgtgagccacatcatgctggagagctacaagaagtacatcctggtgtccctcatcctgctgggcaaggtgcagcagctgcccaagtacaccagccagatcgtgggccgcttcatcaagcccctgagcaatgcctaccacgagctggcccaggtgtacagcaccaacaaccccagcgagctgaggaacctggtgaacaagcacagcgagaccttcacccgggacaacaacatgggcctggtgaagcagtgcctgagcagcctgtacaagaagaacatccagaggctgaccaagaccttcctgaccctgagcctgcaggacatggccagccgggtgcagctgagcggcccccaggaggccgagaagtatgtgctgcacatgattgaagatggagagatctttgccagcatcaaccagaaggatggcatggtgtccttccatgacaaccctgagaagtacaacaacccagccatgctgcacaacatcgaccaggagatgctgaagtgcatcgagctggatgagcggctgaaggccatggaccaggagatcaccgtgaacccccagtttgtgcagaagtccatgggcagccaggaggatgattctggcaacaagcccagcagctacagctag

SEQ ID NO: 148414 - DNA, 1614 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtatgacatcgacaacaagaccatcgagctgagtgatgatgacttcctgggagaatgtgaatgtaccctgggccagatcgtgagcagcaagaagctgacccggcccctggtgatgaagacaggccggcctgctgggaagggcagcatcaccatctctgctgaggagatcaaggacaacagagtggtgctgtttgagatggaggccaggaagctggacaacaaggacctgtttgggaagagtgacccctacctggagttccacaagcagaccagtgatggcaactggctgatggtgcacaggacagaggtggtgaagaacaacctgaaccctgtgtggaggcccttcaagatcagcctgaacagcctgtgctatggagacatggacaagaccatcaaggtggagtgctatgactatgacaatgatggcagccatgacctgattggcaccttccagaccaccatgaccaagctgaaggaggccagccgcagcagccctgtggagtttgagtgcatcaatgagaagaagaggcagaagaagaagagctacaagaacagcggggtcatctctgtgaagcagtgtgagatcaccgtggagtgcaccttcctggactacatcatgggcggctgccagctgaacttcaccgtgggcgtggacttcaccggcagcaatggagaccccaggagcccagacagcctgcactacatcagccccaatggagtgaatgagtacctgacagccctgtggagcgtgggcctggtgatccaggactatgatgctgacaagatgtttcctgcctttggatttggagcccagatccccccccagtggcaggtgtcccatgagttccccatgaacttcaaccccagcaacccctactgcaatggcatccagggcatcgtggaggcctaccgcagctgcctgccccagatcaagctgtatggccccaccaacttcagccccatcatcaaccacgtggccaggtttgctgctgctgccacccagcagcagacagccagccagtactttgtgctgctgatcatcacagatggagtcatcacagacctggatgagacccggcaggccatcgtgaatgccagccggctgcccatgagcatcatcatcgtgggcgtgggcggcgctgacttcagcgccatggagttcctggatggagatggcggcagcctgcggagccccctgggggaggtggccatccgggacatcgtgcagtttgtgcccttccggcagttccagaatgcccccaaggaggccctggcccagtgtgtgctggccgagatcccccagcaggtggtgggctacttcaacacctacaagctgctgccccccaagaacccagccaccaagcagcagaagcagtag

SEQ ID NO: 148415 - DNA, 420 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtatgacatcgacaacaagaccatcgagctgagtgatgatgacttcctgggagaatgtgaatgtaccctgggccagatcgtgagcagcaagaagctgacccggcccctggtgatgaagacaggccggcctgctgggaagggcagcatcaccatctctgctgaggagatcaaggacaacagatag

SEQ ID NO: 148416 - DNA, 30 bp, Artificial Sequence
  Description of Artificial Sequence: Synthetic coding sequence
atggccgcccagtgtgtgaccaaggtgtag

SEQ ID NO: 148417 - DNA, 1614 bp, Artificial Sequence; identical to SEQ ID NO: 148414
  Description of Artificial Sequence: Synthetic coding sequence

SEQ ID NO: 148418 - DNA, 240 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtag

SEQ ID NO: 148419 - DNA, 408 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtatgacatcgacaacaagaccatcgagctgagtgatgatgacttcctgggagaatgtgaatgtaccctgggccagatcgtgagcagcaagaagctgacccggcccctggtgatgaagacaggccggcctgctgggaagggcagcatcaccatctctgctgaggagatctag

SEQ ID NO: 148420 - DNA, 705 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtatgacatcgacaacaagaccatcgagctgagtgatgatgacttcctgggagaatgtgaatgtaccctgggccagatcgtgagcagcaagaagctgacccggcccctggtgatgaagacaggccggcctgctgggaagggcagcatcaccatctctgctgaggagatcaaggacaacagagtggtgctgtttgagatggaggccaggaagctggacaacaaggacctgtttgggaagagtgacccctacctggagttccacaagcagaccagtgatggcaactggctgatggtgcacaggacagaggtggtgaagaacaacctgaaccctgtgtggaggcccttcaagatcagcctgaacagcctgtgctatggagacatggacaagaccatcaaggtggagtgctatgactatgacaatgatggcagccatgacctgattggcaccttccagaccaccatgacctag

SEQ ID NO: 148421 - DNA, 462 bp, Artificial Sequence
  Description of Artificial Sequence: Synthetic coding sequence
atggccgcccagtgtgtgaccaaggtggccctgaatgtgtcctgtgccaacctgctggacaaggacatcggcagcaagagtgaccccctgtgtgtgctcttcctgaacaccagcggccagcagtggtatgaggtggagaggacagagcgcatcaagaactgcctgaacccccagttcagcaagaccttcatcatcgactactactttgaggtggtgcagaagctgaagtttggagtgtatgacatcgacaacaagaccatcgagctgagtgatgatgacttcctgggagaatgtgaatgtaccctgggccagatcgtgagcagcaagaagctgacccggcccctggtgatgaagacaggccggcctgctgggaagggcagcatcaccatctctgctgaggagatcaaggacaacagagtggtgctgtttgagatggaggccaggaagctggacaacaagtag

SEQ ID NO: 148422 - DNA, 1782 bp, Artificial Sequence
  Description of Artificial Sequence: Synthetic coding sequence
atggagcagcctgaggacatggccagcctgtctgaatttgacagcctggccggcagcatcccagccaccaaggtggagatcaccgtgtcctgcaggaacctgctggacaaggacatgttcagcaagagtgaccccctgtgtgtgatgtacacccagggcatggagaacaagcagtggagggagtttggccgcacagaggtgattgacaacaccctgaacccagactttgtgaggaagttcatcgtggactacttctttgaggagaagcagaacctgcgctttgacctgtatgatgtggacagcaagagcccagacctgagcaagcatgacttcctgggccaggccttctgcaccctgggggagatcgtgggcagccctggcagccggctggagaagcccctgaccatcggggccttcagcctgaacagcaggacaggcaagcccatgcctgctgtgtccaatggaggagtgcctgggaagaagtgtggcaccatcatcctgtctgctgaggagctgagcaactgcagagatgtggccaccatgcagttctgtgccaacaagctggacaagaaggacttcttcggcaagagtgaccccttcctggtgttctaccgcagcaatgaagatggcaccttcaccatctgccacaagacagaggtgatgaagaacaccctgaaccctgtgtggcagaccttcagcatccctgtgcgggccctgtgcaatggagactatgacaggaccatcaaggtggaggtgtatgactgggacagagatggcagccatgacttcatcggggagttcaccaccagctaccgggagctggcccggggccagagccagttcaacatctatgaggtggtgaaccccaagaagaagatgaagaagaagaagtatgtgaacagcggcaccgtgaccctgctgagctttgctgtggagagcgagtgcaccttcctggactacatcaagggcggcacccagatcaacttcaccgtggccatcgacttcaccgccagcaatggaaaccccagccagagcaccagcctgcactacatgagcccctaccagctgaatgcctatgccctggccctgacagctgtgggggagatcatccagcactatgacagcgacaagatgtttcctgccctgggctttggagccaagctgcccccagatggccgggtgtcccatgagttccccctgaatggaaaccaggagaaccccagctgctgcggcattgatggcatcctggaggcctaccacaggagcctgaggacagtgcagctgtatggccccaccaactttgcccctgtggtgacccacgtggccagaaatgctgctgctgtgcaggacggcagccagtacagcgtgctgctgatcatcacagatggagtcatcagtgacatggcccagaccaaggaggccatcgtgaatgctgccaagctgcccatgagcatcatcatcgtgggcgtgggccaggccgagtttgatgccatggtggagctggatggagatgatgtgcgcatcagcagccggggcaagctggccgagcgggacatcgtgcagtttgtgcccttccgggactatgtggacagaacaggcaaccacgtgctgtccatggcccggctggccagagatgtgctggccgagatcccagaccagctggtgtcctacatgaaggcccagggcatccggcccaggcctcctcctgctgcccccacccacagccccagccagagccctgcccggaccccaccagccagccccctgcacacccacatctag

SEQ ID NO: 148423 - DNA, 906 bp, Artificial Sequence
  Description of Artificial Sequence: Synthetic coding sequence
atgaagaagaagaagtatgtgaacagcggcaccgtgaccctgctgagctttgctgtggagagcgagtgcaccttcctggactacatcaagggcggcacccagatcaacttcaccgtggccatcgacttcaccgccagcaatggaaaccccagccagagcaccagcctgcactacatgagcccctaccagctgaatgcctatgccctggccctgacagctgtgggggagatcatccagcactatgacagcgacaagatgtttcctgccctgggctttggagccaagctgcccccagatggccgggtgtcccatgagttccccctgaatggaaaccaggagaaccccagctgctgcggcattgatggcatcctggaggcctaccacaggagcctgaggacagtgcagctgtatggccccaccaactttgcccctgtggtgacccacgtggccagaaatgctgctgctgtgcaggacggcagccagtacagcgtgctgctgatcatcacagatggagtcatcagtgacatggcccagaccaaggaggccatcgtgaatgctgccaagctgcccatgagcatcatcatcgtgggcgtgggccaggccgagtttgatgccatggtggagctggatggagatgatgtgcgcatcagcagccggggcaagctggccgagcgggacatcgtgcagtttgtgcccttccgggactatgtggacagaacaggcaaccacgtgctgtccatggcccggctggccagagatgtgctggccgagatcccagaccagctggtgtcctacatgaaggcccagggcatccggcccaggcctcctcctgctgcccccacccacagccccagccagagccctgcccggaccccaccagccagccccctgcacacccacatctag

SEQ ID NO: 148424 - DNA, 1515 bp, Artificial Sequence
  Description of Artificial Sequence: Synthetic coding sequence
atggtgctggccgacctgggcaggaagatcaccagcgccctgcggagcctgagcaatgccaccatcatcaatgaggaggtgctgaatgccatgctgaaggaggtgtgcacagccctgctggaggctgatgtgaacatcaagctggtgaagcagctgcgggagaatgtgaagagcgccatcgacctggaggagatggccagcggcctgaacaagaggaagatgatccagcacgctgtgttcaaggagctggtgaagctggtggaccccggggtgaaggcctggacccccaccaagggcaagcagaatgtcatcatgtttgtgggcctgcagggcagcggcaagaccaccacctgcagcaagctggcctactactaccagaggaagggctggaagacctgcctgatctgtgccgacaccttccgggccggggcctttgaccagctgaagcagaatgccaccaaggcccgcatccccttctacggcagctacacagagatggaccccgtcatcatcgccagcgagggcgtggagaagttcaagaatgaaaattttgagatcatcatcgtggacaccagcggccgccacaagcaggaggacagcctgtttgaggagatgctgcaggtggccaatgccatccagcctgacaacatcgtgtatgtgatggatgccagcatcggccaggcctgtgaggcccaggccaaggccttcaaggacaaggtggatgtggccagcgtcatcgtgaccaagctggatggccacgccaagggcggcggggccctgtctgctgtggccgccaccaagagccccatcatcttcatcggcactggagagcacattgatgactttgagcccttcaagacccagcccttcatcagcaagctgctgggcatgggagacatcgagggcctgattgacaaggtgaatgagctgaagctggatgacaatgaggccctgattgagaagctgaagcacggccagttcaccctgcgggacatgtatgagcagttccagaacatcatgaagatgggccccttcagccagatcctgggcatgatccctggctttggaacagacttcatgagcaaaggaaatgagcaggagagcatggcccggctgaagaagctgatgaccatcatggacagcatgaatgaccaggagctggacagcacagatggagccaaggtgttcagcaagcagcccggccgcatccagagggtggcccggggcagcggcgtgtccaccagagatgtgcaggagctgctgacccagtacaccaagtttgcccagatggtgaagaagatgggcggcatcaagggcctcttcaagggcggggacatgagcaagaatgtgtcccagagccagatggccaagctgaaccagcagatggccaagatgatggacccccgggtgctgcaccacatgggcggcatggccggcctgcagagcatgatgaggcagttccagcagggcgccgccggcaacatgaagggcatgatgggcttcaacaacatgtag

SEQ ID NO: 148425 - DNA, 1674 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagaatgtaccctgggccagatcgtgtcccagaccaaggtgaccaagcccctgctgctgaagaatggcaagacagctgggaagagcaccatcaccatcgtggccgaggaggtgtctggcaccaatgactatgtgcagctgaccttccgggcctacaagctggacaacaaggacctcttcagcaagagtgaccccttcatggagatctacaagaccaatgaagaccagagcgaccagctggtgtggaggacagaggtggtgaagaacaacctgaaccccagctgggagcccttccggctgagcctgcacagcctgtgcagctgtgatgtgcaccggcccctgaagttcctggtgtatgactatgacagcagcggcaagcatgacttcatcggggagttcaccagcaccttccaggagatgcaggagggcacagccaaccctggccaggagatgcagtgggactgcatcaaccccaagtacagagacaagaagaagaactacaagagcagcggcaccgtggtgctggcccagtgcaccgtggagaaggtgcacaccttcctggactacatcatgggcggctgccagatctccttcaccgtggccatcgacttcaccgccagcaatggagaccccaggagcagccagagcctgcactgcctgagcccccggcagcccaaccactacctgcaggccctgcgggctgtgggcggcatctgccaggactatgacagcgacaagcgcttccctgccttcggctttggagcccgcatcccccccaactttgaggtgtcccatgactttgccatcaactttgatcctgaaaatccagaatgtgaggagatctctggagtcatcgccagctaccgccgctgcctgccccagatccagctgtatggccccaccaacgtggcccccatcatcaacagagtggccgagcccgcccagcgggagcagagcacaggccaggccaccaagtacagcgtgctgctggtgctgacagatggagtggtgtctgacatggccgagaccaggacagccatcgtgcgggccagccggctgcccatgagcatcatcatcgtgggcgtgggcaatgctgacttcagtgacatgaggctgctggatggagatgatggccccctgcgctgcccccggggcgtgcctgctgcccgggacatcgtgcagtttgtgcccttccgggacttcaaggatgctgcccccagcgccctggccaagtgtgtgctggccgaggtgccccggcaggtggtggagtactatgccagccagggcatcagccctggggccccccggccctgcaccctggccaccacccccagccccagcccctag

SEQ ID NO: 148426 - DNA, 1839 bp, Artificial Sequence
  Description of Artificial Sequence: Synthetic coding sequence
atggccttcaaggagcacggcaagatcaccagctgctgcatccctggccccatcaacagcagcagagctggagctggagctggggccagcggctggagcagcaaaggagtgcgggcccgggcccgggagcctgagcggggggccccagaccgggagcccagcgacatgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagagtgcaccctgggccagatcgtgtcccagaccaaggtgaccaagcccctgctgctgaagaatggcaagacagctgggaagagcaccatcaccatcgtggccgaggaggtgtctggcaccaatgactatgtgcagctgaccttccgggcctacaagctggacaacaaggacctcttcagcaagagtgaccccttcatggagatctacaagaccaatgaagaccagagcgaccagctggtgtggaggacagaggtggtgaagaacaacctgaaccccagctgggagcccttccggctgagcctgcacagcctgtgcagctgtgatgtgcaccggcccctgaagttcctggtgtatgactatgacagcagcggcaagcatgacttcatcggggagttcaccagcaccttccaggagatgcaggagggcacagccaaccctggccaggagatgcagtgggactgcatcaaccccaagtacagagacaagaagaagaactacaagagcagcggcaccgtggtgctggcccagtgcaccgtggagaaggtgcacaccttcctggactacatcatgggcggctgccagatctccttcaccgtggccatcgacttcaccgccagcaatggagaccccaggagcagccagagcctgcactgcctgagcccccggcagcccaaccactacctgcaggccctgcgggctgtgggcggcatctgccaggactatgacagcgacaagcgcttccctgcctttggatttggagcccgcatcccccccaactttgaggtgtcccatgactttgccatcaactttgatcctgagaacccagaatgtgaggagatcagcggcgtgattgccagctaccgccgctgcctgccccagatccagctgtatggccccaccaacgtggcccccatcatcaacagagtggccgagcccgcccagcgggagcagagcacaggccaggccaccaagtacagcgtgctgctggtgctgacagatggagtggtgtctgacatggccgagaccaggacagccatcgtgcgggccagccggctgcccatgagcatcatcatcgtgggcgtgggcaatgctgacttcagtgacatgaggctgctggatggagatgatggccccctgcgctgcccccggggcgtgcctgctgcccgggacatcgtgcagtttgtgcccttccgggacttcaaggatgctgcccccagcgccctggccaagtgtgtgctggccgaggtgccccggcaggtggtggagtactatgccagccagggcatcagccctggggccccccggccctgcaccctggccaccacccccagccccagcccctag

SEQ ID NO: 148427 - DNA, 159 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgaatag

SEQ ID NO: 148428 - DNA, 396 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagaatgtaccctgggccagatcgtgtcccagaccaaggtgaccaagcccctgctgctgaagaactag

SEQ ID NO: 148429 - DNA, 681 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagaatgtaccctgggccagatcgtgtcccagaccaaggtgaccaagcccctgctgctgaagaatggcaagacagctgggaagagcaccatcaccatcgtggccgaggaggtgtctggcaccaatgactatgtgcagctgaccttccgggcctacaagctggacaacaaggacctcttcagcaagagtgaccccttcatggagatctacaagaccaatgaagaccagagcgaccagctggtgtggaggacagaggtggtgaagaacaacctgaaccccagctgggagcccttccggctgagcctgcacagcctgtgcagctgtgatgtgcaccggcccctgaagttcctgtag

SEQ ID NO: 148430 - DNA, 318 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacacctag

SEQ ID NO: 148431 - DNA, 426 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagaatgtaccctgggccagatcgtgtcccagaccaaggtgaccaagcccctgctgctgaagaatggcaagacagctgggaagagcaccatcacctag

SEQ ID NO: 148432 - DNA, 450 bp, Artificial Sequence
  Description of Artificial Sequence: Synthetic coding sequence
atgtctgaccctgagatgggctgggtgcctgagccccccaccatgaccctgggcgccagccgggtggagctgcgggtgtcctgccacggcctgctggaccgggacaccctgaccaagccccacccctgtgtgctgctgaagctgtacagtgatgagcagtgggtggaggtggagaggacagaggtgctgcggagctgcagcagccctgtgttcagccgggtgctggccctggagtacttctttgaggagaagcagcccctgcagttccacgtgtttgatgctgaagatggagccaccagccccagaaatgacaccttcctgggcagcacagaatgtaccctgggccagatcgtgtcccagaccaaggtgaccaagcccctgctgctgaagaatggcaagacagctgggaagagcaccatcaccatcgtggccgaggaggtgtctggatag

SEQ ID NO: 148433 - DNA, 1902 bp, Artificial Sequence
  Description of Artificial Sequence: Synthetic coding sequence
atgtctgctggcagcgagagaggagctgctgccaccccaggcggcctgcctgccccctgtgccagcaaggtggagctgcggctgagctgccgccacctgctggaccgggaccccctgaccaagagtgaccccagcgtggccctgctgcagcaggcccagggccagtgggtgcaggtgggccgcacagaggtggtgcgcagcagcctgcaccctgtgttcagcaaggtgttcaccgtggactactactttgaggaggtgcagaggctgcgctttgaggtgtatgacacccacggccccagcggcttcagctgccaggaggatgacttcctgggcggcatggagtgcaccctgggccagcctgcccagaagtggctgctgcaggtggtgatgagggtgtctgtggatgtgctgggccctgctggccactgtgccaagcacttcctgtgctgcacagagagcagccacctggccaggacaggccccagcttcctgctgcgctatgatgacctgtgcctgccctgggccacagctggagctgtgcgctggtggacctgccggggcggccacacccagggctggcagatcgtggcccagaagaaggtgacccggcccctgctgctgaagtttggaagaaatgccggcaagagcaccatcaccgtgattgctgaggacatcagcggcaacaacggctacgtggagctgtccttccgggccaggaagctggatgacaaggacctcttcagcaagagtgaccccttcctggagctgtacagagtgaatgatgaccagggcctgcagctggtgtacagaacagaggtggtgaagaacaacctgaaccctgtgtgggaggccttcaaggtgtccctgagcagcctgtgcagctgtgaggagacccggcccctgaagtgcctggtgtgggactatgacagccggggcaagcatgacttcatcggggagttcagcaccacctttgaggagatgcagaaggcctttgaggagggccaggcccagtgggactgtgtgaaccccaagtacaagcagaagagaagaagctacaagaacagcggcgtggtggtgctggccgacctgaagttccaccgggtgtacagcttcctggactacatcatgggcggctgccagatccacttcaccgtggccatcgacttcaccgccagcaatggagaccccaggaacagctgcagcctgcactacatcaacccctaccagcccaatgagtacctgaaggccctggtgtctgtgggggagatctgccaggactatgacagcgacaagcgcttcagcgccctgggctttggagcccgcatcccccccaagtatgaggtgtcccatgactttgccatcaacttcaacccagaagatgatgaatgtgagggcatccagggcgtggtggaggcctaccagaactgcctgccccgggtgcagctgtatggccccaccaacgtggcccccatcatcagcaaggtggcccgggtggccgctgctgaggagagcacaggcaaggccagccagtactacatcctgctgatcctgacagatggagtggtgacagacatggctgacacccgggaggccatcgtgcgggccagccggctgcccatgagcatcatcatcgtgggcgtgggcaatgctgacttcacagacatgcaggtgctggatggagatgatggagtgctgcggagccccagaggagagcccgccctgcgggacatcgtgcagtttgtgcccttccgggagctgaagaatgccagccctgctgccctggccaagtgtgtgctggccgaggtgcccaagcaggtggtggagtactacagccaccggggcctgccccccaggagcctgggcgtgcctgctggggaggccagccctggctgcaccccctag

SEQ ID NO: 148434 - DNA, 1677 bp, Artificial Sequence
  Description of Artificial Sequence: Synthetic coding sequence
atgtctgctggcagcgagagaggagctgctgccaccccaggcggcctgcctgccccctgtgccagcaaggtggagctgcggctgagctgccgccacctgctggaccgggaccccctgaccaagagtgaccccagcgtggccctgctgcagcaggcccagggccagtgggtgcaggtgggccgcacagaggtggtgcgcagcagcctgcaccctgtgttcagcaaggtgttcaccgtggactactactttgaggaggtgcagaggctgcgctttgaggtgtatgacacccacggccccagcggcttcagctgccaggaggatgacttcctgggcggcatggagtgcaccctgggccagatcgtggcccagaagaaggtgacccggcccctgctgctgaagtttggaagaaatgctgggaagagcaccatcaccgtgattgctgaggacatcagcggcaacaacggctacgtggagctgtccttccgggccaggaagctggatgacaaggacctcttcagcaagagtgaccccttcctggagctgtacagagtgaatgatgaccagggcctgcagctggtgtacagaacagaggtggtgaagaacaacctgaaccctgtgtgggaggccttcaaggtgtccctgagcagcctgtgcagctgtgaggagacccggcccctgaagtgcctggtgtgggactatgacagccggggcaagcatgacttcatcggggagttcagcaccacctttgaggagatgcagaaggcctttgaggagggccaggcccagtgggactgtgtgaaccccaagtacaagcagaagaggaggagctacaagaacagcggcgtggtggtgctggccgacctgaagttccaccgggtgtacagcttcctggactacatcatgggcggctgccagatccacttcaccgtggccatcgacttcaccgccagcaatggagaccccaggaacagctgcagcctgcactacatcaacccctaccagcccaatgagtacctgaaggccctggtgtctgtgggggagatctgccaggactatgacagcgacaagcgcttcagcgccctgggctttggagcccgcatcccccccaagtatgaggtgtcccatgactttgccatcaacttcaacccagaagatgatgaatgtgagggcatccagggcgtggtggaggcctaccagaactgcctgccccgggtgcagctgtatggccccaccaacgtggcccccatcatcagcaaggtggcccgggtggccgctgctgaggagagcacaggcaaggccagccagtactacatcctgctgatcctgacagatggagtggtgacagacatggctgacacccgggaggccatcgtgcgggccagccggctgcccatgagcatcatcatcgtgggcgtgggcaatgctgacttcacagacatgcaggtgctggatggagatgatggagtgctgcggagccccagaggagagcccgccctgcgggacatcgtgcagtttgtgcccttccgggagctgaagaatgccagccctgctgccctggccaagtgtgtgctggccgaggtgcccaagcaggtggtggagtactacagccaccggggcctgcccccaagaagcctgggcgtgcctgctggggaggccagccctggctgcaccccctag

SEQ ID NO: 148435 - DNA, 825 bp, Artificial Sequence
  Description of Artificial Sequence: Synthetic coding sequence
atggccagtgacagcggcaaccagggcaccctgtgcaccctggagtttgctgtgcagatgacctgccagagctgtgtggatgctgtgaggaagagcctgcagggcgtggccggcgtgcaggatgtggaggtgcacctggaggaccagatggtgctggtgcacaccaccctgcccagccaggaggtgcaggccctgctggagggcaccggccggcaggccgtgctgaagggcatgggcagcggccagctgcagaacctgggcgctgctgtggccatcctgggcggccctggcaccgtgcagggcgtggtgcgcttcctgcagctgaccccagagcgctgcctgattgagggcaccattgatggcctggagcccggcctgcacggcctgcacgtgcaccagtacggggacctgaccaacaactgcaacagctgtggcaaccacttcaacccagatggagccagccatggaggcccccaggacagcgacagacacagaggagacctgggcaatgtgcgggcagatgctgatggccgggccatcttcaggatggaggatgagcagctgaaggtgtgggatgtgattggccgcagcctcatcattgatgaaggagaagatgacctgggccggggcggccaccccctgagcaagatcaccggcaacagcggggagcggctggcctgtggcatcatcgcccggtctgctggcctcttccagaaccccaagcagatctgcagctgtgatggcctgaccatctgggaggagcggggccggcccatcgccggcaagggcaggaaggagagcgcccagcccccagcccacctgtag

SEQ ID NO: 148436 - DNA, 1365 bp, Artificial Sequence
  Description of Artificial Sequence: Synthetic coding sequence
atggccctgcagctgggccgcctgagcagcggcccctgctggctggtggcccggggcggctgcggcggcccccgggcctggagccagtgtggcggcggcggcctgcgggcctggagccagaggtctgctgctggccgggtgtgccggcccccaggccctgctggaacagagcagagccggggcctgggccacggcagcaccagccggggcggcccctgggtgggcaccggcctggccgccgccctggccggcctggtgggcctggccacagctgcctttggacatgtgcagagagctgagatgctgcccaagaccagcggcacccgggccaccagcctgggccggcctgaggaggaggaggatgagctggcccaccgctgcagcagcttcatggcccctcctgtgacagacctgggggagctgcggcggcggcctggggacatgaagaccaagatggagctgctgatcctggagacccaggcccaggtgtgccaggccctggcccaggtggatggaggagccaacttctctgtggaccgctgggagaggaaggagggcggcggcggcatcagctgtgtgctgcaggacggctgtgtgtttgagaaggccggcgtgtccatctctgtggtgcacggcaacctgtctgaggaggccgccaagcagatgaggagccggggcaaggtgctgaagaccaaggatggcaagctgcccttctgtgccatgggcgtgtcctctgtcatccaccccaagaacccccacgcccccaccatccacttcaactaccgctactttgaggtggaggaggctgatggcaacaagcagtggtggtttggaggcggctgtgacctgacccccacctacctgaaccaggaggatgctgtgcacttccacaggaccctgaaggaggcctgtgaccagcacggccctgacctgtaccccaagttcaagaagtggtgtgatgactacttcttcatcgcccacagaggagagcggcggggcatcggcggcatcttctttgatgacctggacagccccagcaaggaggaggtgttccgctttgtgcagagctgtgcccgggctgtggtgcccagctacatccccctggtgaagaagcactgtgatgacagcttcaccccccaggagaagctgtggcagcagctgcggcggggccgctacgtggagttcaacctgctgtatgaccggggcaccaagtttggcctcttcaccccaggcagccgcatcgagagcatcctgatgagcctgcccctgacagcccgctgggagtacatgcacagccccagcgagaacagcaaggaggccgagatcctggaggtgctgcggcacccccgggactgggtgaggtag

SEQ ID NO: 148437 - DNA, 1026 bp, Artificial Sequence
  Description of Artificial Sequence: Synthetic coding sequence
atgggcgtggccaccaccctgcagccccccaccaccagcaagaccctgcagaagcagcacctggaggccgtgggcgcctaccagtatgtgctgaccttcctgttcatgggccccttcttcagcctgctggtgtttgtgctgctcttcaccagcctgtggcccttcagcgtcttctacctggtgtggctgtatgtggactgggacacccccaaccagggcggcagaagaagtgagtggatccggaacagagccatctggaggcagctgcgggactactaccctgtgaagctggtgaagacagctgagctgcccccagacagaaattatgtgctgggcgcccacccccacggcatcatgtgcaccggcttcctgtgcaacttcagcacagagagcaatggcttcagccagctgtttcctggcctgcggccctggctggccgtgctggccggcctcttctacctgcctgtgtacagagactacatcatgagctttggcctgtgccctgtgtcccggcagagcctggacttcatcctgagccagccccagctgggccaggccgtggtgatcatggtgggcggggcccacgaggccctgtacagcgtgcctggagagcactgcctgaccctgcagaagaggaaaggatttgtgcggctggccctgcggcacggggccagcctggtgcctgtgtacagctttggagaaaatgacatcttccggctgaaggcctttgccaccggctcctggcagcactggtgccagctgaccttcaagaagctgatgggcttcagcccctgcatcttctggggccggggcctcttcagcgccacctcctggggcctgctgccctttgctgtgcccatcaccaccgtggtgggccggcccatccctgtgccccagaggctgcaccccacagaggaggaggtgaaccactaccacgccctgtacatgacagccctggagcagctgtttgaggagcacaaggagagctgtggggtgcctgccagcacctgcctgaccttcatctag

SEQ ID NO: 148438 - DNA, 930 bp, Artificial Sequence
  Description of Artificial Sequence: Synthetic coding sequence
atggccagcaagtcctggctgaacttcctgaccttcctgtgtggcagcgccatcggcttcctgctgtgcagccagctgttcagcatcctgctgggggagaaggtggacacccagcccaacgtgctgcacaatgacccccacgcccggcacagtgatgacaatggccagaaccacctggagggccagatgaacttcaatgctgacagcagccagcacaaggatgaaaatacagacattgctgaaaatctctaccagaaggtgcgcatcctgtgctgggtgatgacaggcccccagaacctggagaagaaggccaagcacgtgaaggccacctgggcccagcgctgcaacaaggtgctcttcatgagcagcgaggagaacaaggacttccctgctgtgggcctgaagaccaaggagggccgggaccagctgtactggaagaccatcaaggccttccagtatgtgcatgagcactacctggaggatgctgactggttcctgaaggcagatgatgacacctacgtgatcctggacaacctgcgctggctgctgagcaaatatgaccctgaggagcccatctacttcggccgccgcttcaagccctacgtgaagcagggctacatgtctgggggcgccggctacgtgctgagcaaggaggccctgaagagatttgtggatgccttcaagacagacaagtgcacccacagcagcagcattgaggacctggccctgggccgctgcatggagatcatgaatgtggaggccggggacagccgggacaccatcggcaaggagaccttccacccctttgtgcctgagcaccacctgatcaagggctacctgcccaggaccttctggtactggaactacaactactacccacctgtggaggtgtccctggagatcctgctgctgtgccagtacctggactag

SEQ ID NO: 148439 - DNA, 303 bp, Artificial Sequence
  Description of Artificial Sequence: Synthetic coding sequence
atggccagcaagtcctggctgaacttcctgaccttcctgtgtggcagcgccatcggcttcctgctgtgcagccagctgttcagcatcctgctgggggagaaggtggacacccagcccaacgtgctgcacaatgacccccacgcccggcacagtgatgacaatggccagaaccacctggagggccagatgaacttcaatgctgacagcagccagcacaaggatgaaaatacagacattgctgaaaatctctaccagaaggtgcgcatcctgtgctgggtgatgacaggcccccagaacctgtag

SEQ ID NO: 148440 - DNA, 396 bp, Artificial Sequence
  Description of Artificial Sequence: Synthetic coding sequence
atggccagcaagtcctggctgaacttcctgaccttcctgtgtggcagcgccatcggcttcctgctgtgcagccagctgttcagcatcctgctgggggagaaggtggacacccagcccaacgtgctgcacaatgacccccacgcccggcacagtgatgacaatggccagaaccacctggagggccagatgaacttcaatgctgacagcagccagcacaaggatgaaaatacagacattgctgaaaatctctaccagaaggtgcgcatcctgtgctgggtgatgacaggcccccagaacctggagaagaaggccaagcacgtgaaggccacctgggcccagcgctgcaacaaggtgctcttcatgagcagcgaggagaacaaggacttccctgcctag

SEQ ID NO: 148441 - DNA, 1092 bp, Artificial Sequence
  Description of Artificial Sequence: Synthetic coding sequence
atggccagcaagtcctggctgaacttcctgaccttcctgtgtggcagcgccatcggcttcctgctgtgcagccagctgttcagcatcctgctgggggagaaggtggacacccagcccaacgtgctgcacaatgacccccacgcccggcacagtgatgacaatggccagaaccacctggagggccagatgaacttcaatgctgacagcagccagcacaaggatgaaaatacagacattgctgaaaatctctaccagaaggtgcgcatcctgtgctgggtgatgacaggcccccagaacctggagaagaaggccaagcacgtgaaggccacctgggcccagcgctgcaacaaggtgctcttcatgagcagcgaggagaacaaggacttccctgctgtgggcctgaagaccaaggagggccgggaccagctgtactggaagaccatcaaggccttccagtatgtgcatgagcactacctggaggatgctgactggttcctgaaggcagatgatgacacctacgtgatcctggacaacctgcgctggctgctgagcaaatatgaccctgaggagcccatctacttcggccgccgcttcaagccctacgtgaagcagggctacatgtctgggggcgccggctacgtgctgagcaaggaggccctgaagagatttgtggatgccttcaagacagacaagtgcacccacagcagcagcattgaggacctggccctgggccgctgcatggagatcatgaatgtggaggccggggacagccgggacaccatcggcaaggagaccttccacccctttgtgcctgagcaccacctgatcaagggctacctgcccaggaccttctggtactggaactacaactactacccacctgtggagggccctggctgctgcagcgacctggccgtgtccttccactacgtggacagcaccaccatgtatgagctggagtacctggtgtaccacctgcggccctacggctacctgtaccgctaccagcccaccctgcctgagcgcatcctgaaggagatcagccaggccaacaagaatgaagacaccaaggtgaagctgggcaacccctag

SEQ ID NO: 148442 - DNA, 549 bp, Artificial Sequence
  Description of Artificial Sequence: Synthetic coding sequence
atgccccgggtggtgcctgaccagaggagcaagtttgaaaatgaggagttcttcaggaagctgagccgggagtgtgagatcaagtacacaggcttccgggaccggccccatgaggagcggcaggcccgcttccagaatgcctgcagagatggccgctcagaaattgcctttgtggccaccggcaccaacctgagcctgcagttcttccctgcctcctggcagggcgagcagaggcagacccccagccgggagtatgtggacctggagcgggaggccggcaaggtgtacctgaaggcccccatgatcctgaatggagtgtgtgtgatctggaagggctggattgacctgcagaggctggatggcatgggctgcctggagtttgatgaggagcgggcccagcaggaggatgccctggcccagcaggcctttgaggaggcccggcggaggacccgggagtttgaggaccgggacaggagccaccgggaggagatggaggtgcgggtgtcccagctgctggccgtgacaggcaagaagaccacccggccctag

SEQ ID NO: 148443 - DNA, 564 bp, Artificial Sequence
  Description of Artificial Sequence: Synthetic coding sequence
atgccccgggtggtgcctgaccagaggagcaagtttgaaaatgaggagttcttcaggaagctgagccgggagtgtgagatcaagtacacaggcttccgggaccggccccatgaggagcggcaggcccgcttccagaatgcctgcagagatggccgctcagaaattgcctttgtggccaccggcaccaacctgagcctgcagttcttccctgcctcctggcagggcgagcagaggcagacccccagccgggagtatgtggacctggagcgggaggccggcaaggtgtacctgaaggcccccatgatcctgaatggagtgtgtgtgatctggaagggctggattgacctgcagaggctggatggcatgggctgcctggagtttgatgaggagcgggcccagcaggaggatgccctggcccagcaggcctttgaggaggcccggcggaggacccgggagtttgaggaccgggacaggagccaccgggaggagatggaggcccggcggcagcaggaccccagccctggcagcaacctgggcggcggagatgacctgaagctgaggtag

SEQ ID NO: 148444 - DNA, 1788 bp, Artificial Sequence
  Description of Artificial Sequence: Synthetic coding sequence
atggtgggcgtgcctggagctgctgccttccagctgggccctgagaagagggtgcctgccatgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgaatggagcccccagccccccccagcgcttcagcaatggacctgccagcagcaccagcagcgccctgaccaaccagcagctgcctgccacctgtggggcccggcagctgagcaagctgaagcgcttcctgaccaccctgcagcagtttggaaatgacatcagccctgagatcggggagaaggtgaggaccctggtgctggccctggtgaacagcacagtgaccatcgaggagttccactgcaagctgcaggaggccaccaacttccccctgcggcccttcgtcatccccttcctgaaggccaacctgcccctgctgcagcgggagctgctgcactgtgcccgggccgccaagcagacccccagccagtacctggcccagcacgagcacctgctgctgaacaccagcatcgccagccctgctgacagcagcgagctgctgatggaggtgcatggaaatggcaagaggcccagccctgagcggcgggaggagaacagctttgaccgggacaccatcgcccctgagcccccagccaagagggtgtgcaccatcagccctgcccccaggcacagccctgccctgactgtgcccctgatgaaccctgggggccagttccaccccaccccaccacccctgcagcactacaccctggaggacatcgccaccagccacctgtaccgggagcccaacaagatgctggagcaccgggaggtgcgggacagacaccacagcctgggcctgaatggaggctaccaggatgagctggtggaccaccggctgacagagcgggagtgggcagatgagtggaagcacctggaccacgccctgaactgcatcatggagatggtggagaagaccaggaggtccatggctgtgctgcggcgctgccaggagagtgaccgggaggagctgaactactggaagaggcgctacaatgaaaatacagagctgaggaagacaggaacagagctggtgtcccggcagcacagccctggcagcgctgacagcctgagcaatgacagccagcgggagttcaacagcaggcctggcaccggctacgtgcctgtggagttctggaagaagacagaggaggccgtgaacaaggtgaagatccaggccatgtctgaggtgcagaaggctgtggccgaggccgagcagaaggcctttgaagtcatcgccacagagcgggccaggatggagcagaccatcgcagatgtgaagaggcaggccgcagaagatgccttcctggtgatcaatgagcaggaggagagcacagagaactgctggaactgtggcaggaaggccagcgagacctgcagcggctgcaacatcgcccgctactgcggcagcttctgccagcacaaggactgggagcggcaccaccggctgtgtggccagaacctgcacggccagagcccccacggccagggccggcccctgctgcctgtgggccggggcagcagcgcccggtctgctgactgcagcgtgcccagccctgccctggacaagaccagcgccaccaccagccgcagcagcaccccagcctctgtgacagccatcgacaccaacggcctgtag

SEQ ID NO: 148445 - DNA, 1815 bp, Artificial Sequence
  Description of Artificial Sequence: Synthetic coding sequence
atggccaaggagagcggcatcagcctgaaggagatccaggtgctggcccggcagtggaaggtgggccctgagaagagggtgcctgccatgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgaatggagcccccagccccccccagcgcttcagcaatggacctgccagcagcaccagcagcgccctgaccaaccagcagctgcctgccacctgtggggcccggcagctgagcaagctgaagcgcttcctgaccaccctgcagcagtttggaaatgacatcagccctgagattggagagaaggtgaggaccctggtgctggccctggtgaacagcacagtgaccatcgaggagttccactgcaagctgcaggaggccaccaacttccccctgcggccctttgtgatccccttcctgaaggccaacctgcccctgctgcagcgggagctgctgcactgtgcccgggccgccaagcagacccccagccagtacctggcccagcacgagcacctgctgctgaacaccagcatcgccagccctgctgacagcagcgagctgctgatggaggtgcacggcaatggcaagaggcccagccctgagcggcgggaggagaacagctttgaccgggacaccatcgcccctgagcccccagccaagagggtgtgcaccatcagccctgcccccaggcacagccctgccctgactgtgcccctgatgaaccctgggggccagttccaccccaccccaccacccctgcagcactacaccctggaggacatcgccaccagccacctgtaccgggagcccaacaagatgctggagcaccgggaggtgcgggacagacaccacagcctgggcctgaatggaggctaccaggatgagctggtggaccaccggctgacagagcgggagtgggcagatgagtggaagcacctggaccacgccctgaactgcatcatggagatggtggagaagacccggcgctccatggctgtgctgcggcgctgccaggagagtgaccgggaggagctgaactactggaagaggcgctacaatgaaaatacagagctgaggaagacaggaacagagctggtgtcccggcagcacagccctggcagcgctgacagcctgagcaatgacagccagcgggagttcaacagccggcccggcaccggctacgtgcctgtggagttctggaagaagacagaggaggccgtgaacaaggtgaagatccaggccatgtctgaggtgcagaaggctgtggccgaggccgagcagaaggcctttgaggtgattgccacagagcgggccaggatggagcagaccatcgcagatgtgaagaggcaggccgcagaagatgccttcctggtgatcaatgagcaggaggagagcacagagaactgctggaactgtggcaggaaggccagcgagacctgcagcggctgcaacatcgcccgctactgcggcagcttctgccagcacaaggactgggagcggcaccaccggctgtgtggccagaacctgcacggccagagcccccacggccagggccggcccctgctgcctgtgggccggggcagcagcgcccggtctgctgactgcagcgtgcccagccctgccctggacaagaccagcgccaccaccagccgcagcagcaccccagcctctgtgacagccatcgacaccaacggcctgtag

SEQ ID NO: 148446 - DNA, 1815 bp, Artificial Sequence; identical to SEQ ID NO: 148445
  Description of Artificial Sequence: Synthetic coding sequence

SEQ ID NO: 148447 - DNA, 792 bp, Artificial Sequence
  Description of Artificial Sequence: Synthetic coding sequence
atgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgaatggagcccccagccccccccagcgcttcagcaatggacctgccagcagcaccagcagcgccctgaccaaccagcagctgcctgccacctgtggggcccggcagctgagcaagctgaagcgcttcctgaccaccctgcagcagtttggaaatgacatcagccctgagatcggggagaaggtgaggaccctggtgctggccctggtgaacagcacagtgaccatcgaggagttccactgcaagctgcaggaggccaccaacttccccctgcggcccttcgtcatccccttcctgaaggccaacctgcccctgctgcagcgggagctgctgcactgtgcccgggccgccaagcagacccccagccagtacctggcccagcacgagcacctgctgctgaacaccagcatcgccagccctgctgacagcagcgagctgctgatggaggtgcatggaaatggcaagaggcccagccctgagagctgcatcatccacctgaagtccatgggcgtggccagcagacatgagtacttcagcggcaccctgcagatgcctgcccaccctgtgaggaacagcaccctggagaacctgtgggtggactgcagccgcagcctgcggagcacagtgctgcccttcccctag

SEQ ID NO: 148448 - DNA, 1728 bp, Artificial Sequence
  Description of Artificial Sequence: Synthetic coding sequence
atgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgaatggagcccccagccccccccagcgcttcagcaatggacctgccagcagcaccagcagcgccctgaccaaccagcagctgcctgccacctgtggggcccggcagctgagcaagctgaagcgcttcctgaccaccctgcagcagtttggaaatgacatcagccctgagatcggggagaaggtgaggaccctggtgctggccctggtgaacagcacagtgaccatcgaggagttccactgcaagctgcaggaggccaccaacttccccctgcggcccttcgtcatccccttcctgaaggccaacctgcccctgctgcagcgggagctgctgcactgtgcccgggccgccaagcagacccccagccagtacctggcccagcacgagcacctgctgctgaacaccagcatcgccagccctgctgacagcagcgagctgctgatggaggtgcatggaaatggcaagaggcccagccctgagcggcgggaggagaacagctttgaccgggacaccatcgcccctgagcccccagccaagagggtgtgcaccatcagccctgcccccaggcacagccctgccctgactgtgcccctgatgaaccctgggggccagttccaccccaccccaccacccctgcagcactacaccctggaggacatcgccaccagccacctgtaccgggagcccaacaagatgctggagcaccgggaggtgcgggacagacaccacagcctgggcctgaatggaggctaccaggatgagctggtggaccaccggctgacagagcgggagtgggcagatgagtggaagcacctggaccacgccctgaactgcatcatggagatggtggagaagaccaggaggtccatggctgtgctgcggcgctgccaggagagtgaccgggaggagctgaactactggaagaggcgctacaatgaaaatacagagctgaggaagacaggaacagagctggtgtcccggcagcacagccctggcagcgctgacagcctgagcaatgacagccagcgggagttcaacagcaggcctggcaccggctacgtgcctgtggagttctggaagaagacagaggaggccgtgaacaaggtgaagatccaggccatgtctgaggtgcagaaggctgtggccgaggccgagcagaaggcctttgaagtcatcgccacagagcgggccaggatggagcagaccatcgcagatgtgaagaggcaggccgcagaagatgccttcctggtgatcaatgagcaggaggagagcacagagaactgctggaactgtggcaggaaggccagcgagacctgcagcggctgcaacatcgcccgctactgcggcagcttctgccagcacaaggactgggagcggcaccaccggctgtgtggccagaacctgcacggccagagcccccacggccagggccggcccctgctgcctgtgggccggggcagcagcgcccggtctgctgactgcagcgtgcccagccctgccctggacaagaccagcgccaccaccagccgcagcagcaccccagcctctgtgacagccatcgacaccaacggcctgtag

SEQ ID NO: 148449 - DNA, 1137 bp, Artificial Sequence
  Description of Artificial Sequence: Synthetic coding sequence
atggaggtgcacggcaatggcaagaggcccagccctgagcggcgggaggagaacagctttgaccgggacaccatcgcccctgagcccccagccaagagggtgtgcaccatcagccctgcccccaggcacagccctgccctgactgtgcccctgatgaaccctgggggccagttccaccccaccccaccacccctgcagcactacaccctggaggacatcgccaccagccacctgtaccgggagcccaacaagatgctggagcaccgggaggtgcgggacagacaccacagcctgggcctgaatggaggctaccaggatgagctggtggaccaccggctgacagagcgggagtgggcagatgagtggaagcacctggaccacgccctgaactgcatcatggagatggtggagaagacccggcgctccatggctgtgctgcggcgctgccaggagagtgaccgggaggagctgaactactggaagaggcgctacaatgaaaatacagagctgaggaagacaggaacagagctggtgtcccggcagcacagccctggcagcgctgacagcctgagcaatgacagccagcgggagttcaacagccggcccggcaccggctacgtgcctgtggagttctggaagaagacagaggaggccgtgaacaaggtgaagatccaggccatgtctgaggtgcagaaggctgtggccgaggccgagcagaaggcctttgaggtgattgccacagagcgggccaggatggagcagaccatcgcagatgtgaagaggcaggccgcagaagatgccttcctggtgatcaatgagcaggaggagagcacagagaactgctggaactgtggcaggaaggccagcgagacctgcagcggctgcaacatcgcccgctactgcggcagcttctgccagcacaaggactgggagcggcaccaccggctgtgtggccagaacctgcacggccagagcccccacggccagggccggcccctgctgcctgtgggccggggcagcagcgcccggtctgctgactgcagcgtgcccagccctgccctggacaagaccagcgccaccaccagccgcagcagcaccccagcctctgtgacagccatcgacaccaacggcctgtag

SEQ ID NO: 148450 - DNA, 546 bp, Artificial Sequence
  Description of Artificial Sequence: Synthetic coding sequence
atggtgggcgtgcctggagctgctgccttccagctgggccctgagaagagggtgcctgccatgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgaatggagcccccagccccccccagcgcttcagcaatggacctgccagcagcaccagcagcgccctgaccaaccagcagctgcctgccacctgtggggcccggcagctgagcaagctgaagcgcttcctgaccaccctgcagcagtttggaaatgacatcagccctgagatcggggagaaggtgaggaccctggtgctggccctggtgaacagcacagtgaccatcgaggagttccactgcaagctgcaggaggccaccaacttccccctgcggcccttcgtcatccccttcctgaaggccaacctgcccctgctgcagcgggagctgctgtag

SEQ ID NO: 148451 - DNA, 243 bp, Artificial Sequence
  Description of Artificial Sequence: Synthetic coding sequence
atggccaaggagagcggcatcagcctgaaggagatccaggtgctggcccggcagtggaaggtgggccctgagaagagggtgcctgccatgcctggcagccctgtggaggtgaagatccagagccgcagcagcccccccaccatgccacccctgccccccatcaaccctgggggccccaggcctgtgtccttcacccccacagccctgagcaatggcatcaaccacagcccccccaccctgtag

SEQ ID NO: 148452 - DNA, 459 bp, Artificial Sequence
  Description of Artificial Sequence: Synthetic coding sequence
atgtctgaggtgcagaaggctgtggccgaggccgagcagaaggcctttgaggtgattgccacagagcgggccaggatggagcagaccatcgcagatgtgaagaggcaggccgcagaagatgccttcctggtgatcaatgagcaggaggagagcacagagaactgctggaactgtggcaggaaggccagcgagacctgcagcggctgcaacatcgcccgctactgcggcagcttctgccagcacaaggactgggagcggcaccaccggctgtgtggccagaacctgcacggccagagcccccacggccagggccggcccctgctgcctgtgggccggggcagcagcgcccggtctgctgactgcagcgtgcccagccctgccctggacaagaccagcgccaccaccagccgcagcagcaccccagcctctgtgacagccatcgacaccaacggcctgtag

SEQ ID NO: 148453 - DNA, 1962 bp, Artificial Sequence
  Description of Artificial Sequence: Synthetic coding sequence
atgcctgccagccggctgcgggaccgggccgccagcagcgccagcggcagcacctgtggctccatgagccagacccaccctgtgctggagagcggcctgctggccagcgctggctgcagcgccccccggggccccaggaaaggaggccctgcccctgtggacaggaaggccaaggccagcgccatgccagacagccctgctgaggtgaagacccagcccaggagcaccccacccagcatgcctcctcctcctcctgctgccagccagggcgccacccggccccccagcttcaccccccacacccaccgggaggatggccctgccaccctgccccacggccgcttccacggctgcctgaagtggagcatggtgtgcctgctgatgaatggcagcagccacagccccacagccatcaatggagccccctgcacccccaacggcttcagcaatggacctgccaccagcagcacagccagcctgagcacccagcacctgcccccagcctgtggggcccggcagctgagcaagctgaagcgcttcctgaccaccctgcagcagtttggaagtgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaccccagcccagtacctggcccagcacgagcagctgctgctggatgccagcgccagcagccccatcgacagcagcgagctgctgctggaggtgaatgaaaatggcaagaggaggaccccagacaggaccaaggaaaatggaagtgaccgggaccccctgcaccctgagcacctgagcaagaggccctgcaccctgaacccagcccagcgctacagccccagcaatggaccaccccagcccaccccaccaccccactaccgcctggaggacatcgccatggcccaccacttcagagatgcctaccgccacccagacccccgggagctgcgggagcggcaccggcccctggtggtgcccggcagccggcaggaggaggtgattgaccacaagctgacagagcgggagtgggccgaggagtggaagcacctgaacaacctgctgaactgcatcatggacatggtggagaagacccggcgcagcctgactgtgctgcggcgctgccaggaggccgaccgggaggagctgaaccactgggcccggcgctacagtgatgctgaggacaccaagaagggccctgccccagctgctgcccggcccaggagcagcagcgctggccctgagggcccccagctggatgtgccccgggagttcctgcccaggaccctgaccggctacgtgcctgaggacatctggaggaaggccgaggaggccgtgaatgaggtgaagaggcaggccatgtctgagctgcagaaggctgtgtctgatgctgagaggaaggcccacgagctgatcaccacagagcgggccaagatggagcgggccctggccgaggccaagaggcaggcctctgaagatgccctgaccgtcatcaaccagcaggaggacagcagcgagagctgctggaactgtggcaggaaggccagcgagacctgcagcggctgcaatgctgcccgctactgcggcagcttctgccagcaccgggactgggagaagcaccaccacgtgtgtggccagagcctgcagggccccacagctgtggtggccgaccctgtgcccggccccccagaggccgcccacagcctgggccccagcctgcctgtgggcgccgccagccccagcgaggccggcagcgctggccccagcaggcctggcagccccagccccccaggccccctggacacagtgcccaggtag

SEQ ID NO: 148454 - DNA, 1704 bp, Artificial Sequence
  Description of Artificial Sequence: Synthetic coding sequence
atgccagacagccctgctgaggtgaagacccagcccaggagcaccccacccagcatgcctcctcctcctcctgctgccagccagggcgccaccaggcctccttccttcaccccccacaccctgatgaatggcagcagccacagccccacagccatcaatggagccccctgcacccccaacggcttcagcaatggacctgccaccagcagcacagccagcctgagcacccagcacctgcccccagcctgtggggcccggcagctgagcaagctgaagcgcttcctgaccaccctgcagcagtttggaagtgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaccccagcccagtacctggcccagcacgagcagctgctgctggatgccagcgccagcagccccatcgacagcagcgagctgctgctggaggtgaatgaaaatggcaagaggaggaccccagacaggaccaaggaaaatggaagtgaccgggaccccctgcaccctgagcacctgagcaagaggccctgcaccctgaacccagcccagcgctacagccccagcaatggaccaccccagcccaccccaccaccccactaccgcctggaggacatcgccatggcccaccacttcagagatgcctaccgccacccagacccccgggagctgcgggagcggcaccggcccctggtggtgcccggcagccggcaggaggaggtgattgaccacaagctgacagagcgggagtgggccgaggagtggaagcacctgaacaacctgctgaactgcatcatggacatggtggagaagacccggcgcagcctgactgtgctgcggcgctgccaggaggccgaccgggaggagctgaaccactgggcccggcgctacagtgatgctgaggacaccaagaagggccctgccccagctgctgcccggcccaggagcagcagcgctggccctgagggcccccagctggatgtgccccgggagttcctgcccaggaccctgaccggctacgtgcctgaggacatctggaggaaggccgaggaggccgtgaatgaggtgaagaggcaggccatgtctgagctgcagaaggctgtgtctgatgctgagaggaaggcccacgagctgatcaccacagagcgggccaagatggagcgggccctggccgaggccaagaggcaggcctctgaagatgccctgaccgtcatcaaccagcaggaggacagcagcgagagctgctggaactgtggcaggaaggccagcgagacctgcagcggctgcaatgctgcccgctactgcggcagcttctgccagcaccgggactgggagaagcaccaccacgtgtgtggccagagcctgcagggccccacagctgtggtggccgaccctgtgcccggccccccagaggccgcccacagcctgggccccagcctgcctgtgggcgccgccagccccagcgaggccggcagcgctggccccagcaggcctggcagccccagccccccaggccccctggacacagtgcccaggtag

SEQ ID NO: 148455 - DNA, 1704 bp, Artificial Sequence; identical to SEQ ID NO: 148454
  Description of Artificial Sequence: Synthetic coding sequence

SEQ ID NO: 148456 - DNA, 1848 bp, Artificial Sequence
  Description of Artificial Sequence: Synthetic coding sequence
atgcctgccagccggctgcgggaccgggccgccagcagcgccagcggcagcacctgtggctccatgagccagacccaccctgtgctggagagcggcctgctggccagcgctggctgcagcgccccccggggccccaggaaaggaggccctgcccctgtggacaggaaggccaaggccagcgccatgccagacagccctgctgaggtgaagacccagcccaggagcaccccacccagcatgcctcctcctcctcctgctgccagccagggcgccacccggccccccagcttcaccccccacaccctgatgaatggcagcagccacagccccacagccatcaacggggccccctgcaccccaaatggcttcagcaatggacctgccaccagcagcacagccagcctgagcacccagcacctgcccccagcctgtggggcccggcagctgagcaagctgaagcgcttcctgaccaccctgcagcagtttggaagtgacatcagccctgagatcggggagcgggtgaggaccctggtgctgggcctggtgaacagcaccctgaccatcgaggagttccacagcaagctgcaggaggccaccaacttccccctgcggcccttcgtcatccccttcctgaaggccaacctgcccctgctgcagcgggagctgctgcactgtgcccggctggccaagcagaccccagcccagtacctggcccagcacgagcagctgctgctggatgccagcgccagcagccccatcgacagcagcgagctgctgctggaggtgaatgaaaatggcaagaggaggaccccagacaggaccaaggaaaatggaagtgaccgggaccccctgcaccctgagcgctacagccccagcaatggaccaccccagcccaccccaccaccccactaccgcctggaggacatcgccatggcccaccacttcagagatgcctaccgccacccagacccccgggagctgcgggagcggcaccggcccctggtggtgcccggcagccggcaggaggaggtgattgaccacaagctgacagagcgggagtgggccgaggagtggaagcacctgaacaacctgctgaactgcatcatggacatggtggagaagacccggcgcagcctgactgtgctgcggcgctgccaggaggccgaccgggaggagctgaaccactgggcccggcgctacagtgatgctgaggacaccaagaagggccctgccccagctgctgcccggcccaggagcagcagcgctggccctgagggcccccagctggatgtgccccgggagttcctgcccaggaccctgaccggctacgtgcctgaggacatctggaggaaggccgaggaggccgtgaatgaggtgaagaggcaggccatgtctgagctgcagaaggctgtgtctgatgctgagaggaaggcccacgagctgatcaccacagagcgggccaagatggagcgggccctggccgaggccaagaggcaggcctctgaagatgccctgaccgtcatcaaccagcaggaggacagcagcgagagctgctggaactgtggcaggaaggccagcgagacctgcagcggctgcaatgctgcccgctactgcggcagcttctgccagcaccgggactgggagaagcaccaccacgtgtgtggccagagcctgcagggccccacagctgtggtggccgaccctgtgcccggccccccagaggccgcccacagcctgggccccagcctgcctgtgggcgccgccagccccagcgaggccggcagcgctggccccagcaggcctggcagccccagccccccaggccccctggacacagtgcccaggtag

SEQ ID NO: 148457 - DNA, 1734 bp, Artificial Sequence
  Description of Artificial Sequence: Synthetic coding sequence
atgcctgccagccggctgcgggaccgggccgccagcagcgccagcggcagcacctgtggctccatgagccagacccaccctgtgctggagagcggcctgctggccagcgctggctgcagcgccccccggggccccaggaaaggaggccctgtgatgaatggcagcagccacagccccacagccatcaatggagccccctgcacccccaacggcttcagcaatggacctgccaccagcagcacagccagcctgagcacccagcacctgcccccagcctgtggggcccggcagctgagcaagctgaagcgcttcctgaccaccctgcagcagtttggaagtgacatcagccctgagattggagagcgggtgaggaccctggtgctgggcctggtgaacagcaccctgaccatcgaggagttccacagcaagctgcaggaggccaccaacttccccctgcggccctttgtgatccccttcctgaaggccaacctgcccctgctgcagcgggagctgctgcactgtgcccggctggccaagcagaccccagcccagtacctggcccagcacgagcagctgctgctggatgccagcgccagcagccccatcgacagcagcgagctgctgctggaggtgaatgaaaatggcaagaggaggaccccagacaggaccaaggaaaatggaagtgaccgggaccccctgcaccctgagcacctgagcaagaggccctgcaccctgaacccagcccagcgctacagccccagcaatggaccaccccagcccaccccaccaccccactaccgcctggaggacatcgccatggcccaccacttcagagatgcctaccgccacccagacccccgggagctgcgggagcggcaccggcccctggtggtgcccggcagccggcaggaggaggtgattgaccacaagctgacagagcgggagtgggccgaggagtggaagcacctgaacaacctgctgaactgcatcatggacatggtggagaagacccggcgcagcctgactgtgctgcggcgctgccaggaggccgaccgggaggagctgaaccactgggcccggcgctacagtgatgctgaggacaccaagaagggccctgccccagctgctgcccggcccaggagcagcagcgctggccctgagggcccccagctggatgtgccccgggagttcctgcccaggaccctgaccggctacgtgcctgaggacatctggaggaaggccgaggaggccgtgaatgaggtgaagaggcaggccatgtctgagctgcagaaggctgtgtctgatgctgagaggaaggcccacgagctgatcaccacagagcgggccaagatggagcgggccctggccgaggccaagaggcaggcctctgaagatgccctgaccgtcatcaaccagcaggaggacagcagcgagagctgctggaactgtggcaggaaggccagcgagacctgcagcggctgcaatgctgcccgctactgcggcagcttctgccagcaccgggactgggagaagcaccaccacgtgtgtggccagagcctgcagggccccacagctgtggtggccgaccctgtgcccggccccccagaggccgcccacagcctgggccccagcctgcctgtgggcgccgccagccccagcgaggccggcagcgctggccccagcaggcctggcagccccagccccccaggccccctggacacagtgcccaggtag

SEQ ID NO: 148458 - DNA, 558 bp, Artificial Sequence
  Description of Artificial Sequence: Synthetic coding sequence
atggccgcccagaaggaccagcagaaggatgctgaggccgagggcctgagcggcaccaccctgctgcccaagctgatccccagcggggccggccgggagtggctggagcggcggcgggccaccatccggccctggagcacctttgtggaccagcagcgcttcagccggcccaggaacctgggggagctgtgccagaggctggtgagaaatgtggagtactaccagagcaactacgtgtttgtgttcctgggcctcatcctgtactgtgtggtgaccagccccatgctgctggtggccctggccgtgttcttcggggcctgctacatcctgtacctgcggaccctggagagcaagctggtgctgtttggccgggaggtgtccccagcccaccagtatgccctggccggcggcatctccttccccttcttctggctggccggggccggcagcgctgtgttctgggtgctgggcgccaccctggtggtgattggcagccatgctgccttccaccagatcgaggccgtggatggagaggagctgcagatggagcctgtgtag

SEQ ID NO: 148459 - DNA, 3147 bp, Artificial Sequence
  Description of Artificial Sequence: Synthetic coding sequence
atgaaccgcttccgggtgtccaagttccgccacacagaggcccggcccccccggcgggagagctggatcagtgacatccgggccggcacagcccccagctgcaggaaccacatcaagagcagctgcagcctgattgccttcaacagcgacaggcctggggtgctgggcatcgtgcccctgcagggccagggcgaggacaagagaagagtggcccacctgggctgccacagcgacctggtgacagacctggacttcagcccctttgatgacttcctgctggccactggatctgctgacagaacagtgaagctgtggaggctgcccggccctggccaggccctgcccagcgcccctggggtggtgctgggccctgaggacctgcctgtggaggtgctgcagttccaccccaccagtgatggcatcctggtgtctgctgctggcaccaccgtgaaggtgtgggatgctgccaagcagcagcccctgacagagctggccgcccatggagacctggtgcagagcgctgtgtggagcagagatggagccctggtgggcacagcctgcaaggacaagcagctgcgcatctttgaccccaggaccaagccccgggccagccagagcacccaggcccacgagaacagccgggacagccggctggcctggatgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgacagcggcctgctggtgctggccggcaagggggagcggcagctgtactgctatgaggtggtgccccagcagcctgccctgagccctgtgacccagtgtgtgctggagagcgtgctgcggggggccgccctggtgccccggcaggccctggccgtgatgagctgtgaggtgctgcgggtgctgcagctgagtgacacagccatcgtgcccatcggctaccacgtgcccaggaaggctgtggagttccacgaggacctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagctgaggaagccaggccgcctgcctgacacagccctgcccaccctgcagaatggagctgctgtgacagacctggcctgggacccctttgacccccaccggctggccgtggccggagaagatgcccgcatccggctgtggagggtgcctgctgagggcctggaggaggtgctgaccaccccagagaccgtgctgaccggccacacagagaagatctgcagcctgcgcttccaccccctggccgccaacgtgctggccagcagcagctatgacctgactgtgcgcatctgggacctgcaggccggggctgaccggctgaagctgcagggccaccaggaccagatcttcagcctggcctggagcccagatggccagcagctggccaccgtgtgcaaggatggccgggtgcgggtgtaccggcccaggagcggccctgagcccctgcaggagggccctggccccaagggcggccgcggggccagaattgtgtgggtgtgtgatggccgctgcctgctggtgtctggctttgacagccagagcgagcggcagctgctgctgtatgaggccgaggccctggccggcggccccctggccgtgctgggcctggatgtggcccccagcaccctgctgcccagctatgaccctgacaccggcctggtgctgctgaccgggaagggggacaccagggtcttcctgtatgagctgctgcctgagagccccttcttcctggagtgcaacagcttcaccagcccagacccccacaagggcctggtgctgctgcccaagacagaatgtgatgtgcgggaggtggagctgatgcgctgcctgcggctgcggcagagcagcctggagcctgtggccttccggctgccccgggtgaggaaggagttcttccaggatgatgtgtttcctgacacagctgtgatctgggagcctgtgctgtctgctgaggcctggctgcagggcgccaacggccagccctggctgctgagcctgcagcccccagacatgagccctgtgtcccaggccccccgggaggccccagcccggcgggcccccagcagcgcccagtacctggaggagaagagtgaccagcagaagaaggaggagctgctgaatgccatggtggccaagctgggcaaccgggaggaccccctgccccaggacagctttgagggcgtggatgaagatgagtgggccaagtacctggcccagatcatcgtgatgggcgtgcaggtggtgggccgggcctttgcccgggccctgcggcaggagtttgctgccagcagagctgctgctgatgcccggggccgggccggccacaggtctgctgctgccagcaacctgagcggcctgagcctgcaggaggcccagcagatcctgaatgtgtccaagctgagccctgaggaggtgcagaagaactatgagcacctgttcaaggtgaatgacaagtctgtgggcggcagcttctacctgcagagcaaggtggtgcgggccaaggagcggctggatgaggagctgaagatccaggcccaggaggaccgggagaagggccagatgccccacacctag

SEQ ID NO: 148460 - DNA, 2778 bp, Artificial Sequence
  Description of Artificial Sequence: Synthetic coding sequence
atgaaccgcttccgggtgtccaagttccgccacacagaggcccggcccccccggcgggagagctggatcagtgacatccgggccggcacagcccccagctgcaggaaccacatcaagagcagctgcagcctgattgccttcaacagcgacaggcctggggtgctgggcatcgtgcccctgcagggccagggcgaggacaagagaagagtggcccacctgggctgccacagcgacctggtgacagacctggacttcagcccctttgatgacttcctgctggccactggatctgctgacagaacagtgaagctgtggaggctgcccggccctggccaggccctgcccagcgcccctggggtggtgctgggccctgaggacctgcctgtggaggtgctgcagttccaccccaccagtgatggcatcctggtgtctgctgctggcaccaccgtgaaggtgtgggatgctgccaagcagcagcccctgacagagctggccgcccatggagacctggtgcagagcgctgtgtggagcagagatggagccctggtgggcacagcctgcaaggacaagcagctgcgcatctttgaccccaggaccaagccccgggccagccagagcacccaggcccacgagaacagccgggacagccggctggcctggatgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgacagcggcctgctggtgctggccggcaagggggagcggcagctgtactgctatgaggtggtgccccagcagcctgccctgagccctgtgacccagtgtgtgctggagagcgtgctgcggggggccgccctggtgccccggcaggccctggccgtgatgagctgtgaggtgctgcgggtgctgcagctgagtgacacagccatcgtgcccatcggctaccacgtgcccaggaaggctgtggagttccacgaggacctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagctgaggaagccaggccgcctgcctgacacagccctgcccaccctgcagaatggagctgctgtgacagacctggcctgggacccctttgacccccaccggctggccgtggccggagaagatgcccgcatccggctgtggagggtgcctgctgagggcctggaggaggtgctgaccaccccagagaccgtgctgaccggccacacagagaagatctgcagcctgcgcttccaccccctggccgccaacgtgctggccagcagcagctatgacctgactgtgcgcatctgggacctgcaggccggggctgaccggctgaagctgcagggccaccaggaccagatcttcagcctggcctggagcccagatggccagcagctggccaccgtgtgcaaggatggccgggtgcgggtgtaccggcccaggagcggccctgagcccctgcaggagggccctggccccaagggcggccgcggggccagaattgtgtgggtgtgtgatggccgctgcctgctggtgtctggctttgacagccagagcgagcggcagctgctgctgtatgaggccgaggccctggccggcggccccctggccgtgctgggcctggatgtggcccccagcaccctgctgcccagctatgaccctgacaccggcctggtgctgctgaccgggaagggggacaccagggtcttcctgtatgagctgctgcctgagagccccttcttcctggagtgcaacagcttcaccagcccagacccccacaagggcctggtgctgctgcccaagacagaatgtgatgtgcgggaggtggagctgatgcgctgcctgcggctgcggcagagcagcctggagcctgtggccttccggctgccccgggtgaggaaggagttcttccaggatgatgtgtttcctgacacagctgtgatctgggagcctgtgctgtctgctgaggcctggctgcagggcgccaacggccagccctggctgctgagcctgcagcccccagacatgagccctgtgtcccaggccccccgggaggccccagcccggcgggcccccagcagcgcccagtacctggaggagaagagtgaccagcagaagaaggaggagctgctgaatgccatggtggccaagctgggcaaccgggaggaccccctgccccaggacagctttgagggcgtggatgaagatgagtgggactag

SEQ ID NO: 148461 - DNA, 1104 bp, Artificial Sequence
  Description of Artificial Sequence: Synthetic coding sequence
atgaaccgcttccgggtgtccaagttccgccacacagaggcccggcccccccggcgggaggacaagcagctgcgcatctttgaccccaggaccaagccccgggccagccagagcacccaggcccacgagaacagccgggacagccggctggcctggatgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgacagcggcctgctggtgctggccggcaagggggagcggcagctgtactgctatgaggtggtgccccagcagcctgccctgagccctgtgacccagtgtgtgctggagagcgtgctgcggggggccgccctggtgccccggcaggccctggccgtgatgagctgtgaggtgctgcgggtgctgcagctgagtgacacagccatcgtgcccatcggctaccacgtgcccaggaaggctgtggagttccacgaggacctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagatgagggagaagaggcaccgggaggtgtag

SEQ ID NO: 148462 - DNA, 2523 bp, Artificial Sequence
  Description of Artificial Sequence: Synthetic coding sequence
atgaaccgcttccgggtgtccaagttccgccacacagaggcccggcccccccggcgggagagctggatcagtgacatccgggccggcacagcccccagctgcaggaaccacatcaagagcagctgcagcctgattgccttcaacagcgacaggcctggggtgctgggcatcgtgcccctgcagggccagggcgaggacaagagaagagtggcccacctgggctgccacagcgagctggccgcccacggggacctggtgcagagcgctgtgtggagcagagatggagccctggtgggcacagcctgcaaggacaagcagctgcgcatctttgaccccaggaccaagccccgggccagccagagcacccaggcccacgagaacagccgggacagccggctggcctggatgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgattctggcctgctggtgctggccgggaaaggagagcggcagctgtactgctatgaggtggtgccccagcagcctgccctgagccctgtgacccagtgtgtgctggagagcgtgctgcggggagctgccctggtgccccggcaggccctggccgtgatgagctgtgaggtgctgcgggtgctgcagctgagtgacacagccatcgtgcccatcggctaccacgtgcccaggaaggctgtggagttccatgaagatctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagctgaggaagccaggccgcctgcctgacacagccctgcccaccctgcagaatggagctgctgtgacagacctggcctgggacccctttgacccccaccggctggccgtggccggggaggatgcccgcatccggctgtggagggtgcctgctgagggcctggaggaggtgctgaccaccccagagaccgtgctgaccggccacacagagaagatctgcagcctgcgcttccaccccctggccgccaacgtgctggccagcagcagctatgacctgactgtgcgcatctgggacctgcaggccggggctgaccggctgaagctgcagggccaccaggaccagatcttcagcctggcctggagcccagatggccagcagctggccaccgtgtgcaaggatggccgggtgcgggtgtaccggcccaggagcggccctgagcccctgcaggagggccctggccccaagggcggccgcggggcccgcatcgtgtgggtgtgtgatggccgctgcctgctggtgtctggctttgacagccagagcgagcggcagctgctgctgtatgaagctgaggccctggccggcggccccctggccgtgctgggcctggatgtggcccccagcaccctgctgcccagctatgaccctgacaccggcctggtgctgctgactggaaaaggagacaccagggtcttcctgtatgagctgctgcctgagagccccttcttcctggagtgcaacagcttcaccagcccagacccccacaagggcctggtgctgctgcccaagacagaatgtgatgtgcgggaggtggagctgatgcgctgcctgcggctgcggcagagcagcctggagcctgtggccttccggctgccccgggtgaggaaggagttcttccaggatgatgtgtttcctgacacagctgtgatctgggagcctgtgctgtctgctgaggcctggctgcagggcgccaacggccagccctggctgctgagcctgcagcccccagacatgagccctgtgtcccaggccccccgggaggccccagcccggcgggcccccagcagcgcccagtacctggaggagaagagtgaccagcagaagaaggaggagctgctgaatgccatggtggccaagctgggcaaccgggaggaccccctgccccaggacagctttgaaggagtggatgaagatgagtgggactag

SEQ ID NO: 148463 - DNA, 2118 bp, Artificial Sequence
  Description of Artificial Sequence: Synthetic coding sequence
atgggcacctgggagcacctggtgtccacaggcttcaaccagatgagggagcgggaggtgaagctgtgggacacccgcttcttcagcagcgccctggccagcctgaccctggacaccagcctgggctgcctggtgcccctgctggaccctgacagcggcctgctggtgctggccggcaagggggagcggcagctgtactgctatgaggtggtgccccagcagcctgccctgagccctgtgacccagtgtgtgctggagagcgtgctgcggggggccgccctggtgccccggcaggccctggccgtgatgagctgtgaggtgctgcgggtgctgcagctgagtgacacagccatcgtgcccatcggctaccacgtgcccaggaaggctgtggagttccacgaggacctcttcccagacacagctggctgtgtgcctgccacagacccccacagctggtgggccggggacaaccagcaggtgcagaaggtgtccctgaacccagcctgccggccccaccccagcttcaccagctgcctggtgcccccagctgagcccctgcctgacacagcccagcctgctgtgatggagacccctgtgggagatgctgatgccagcgagggcttcagcagcccccccagcagcctgaccagccccagcacccccagcagcctgggccccagcctgagcagcaccagcggcatcggcaccagccccagcctgcggagcctgcagagcctgctgggccccagcagcaagttcagacatgcccagggcaccgtgctgcaccgggacagccacatcaccaacctgaagggcctgaacctgaccaccccaggagagagtgatggcttctgtgccaacaagctgcgggtggccgtgcccctgctgagcagcggcggccaggtggccgtgctggagctgaggaagccaggccgcctgcctgacacagccctgcccaccctgcagaatggagctgctgtgacagacctggcctgggacccctttgacccccaccggctggccgtggccggagaagatgcccgcatccggctgtggagggtgcctgctgagggcctggaggaggtgctgaccaccccagagaccgtgctgaccggccacacagagaagatctgcagcctgcgcttccaccccctggccgccaacgtgctggccagcagcagctatgacctgactgtgcgcatctgggacctgcaggccggggctgaccggctgaagctgcagggccaccaggaccagatcttcagcctggcctggagcccagatggccagcagctggccaccgtgtgcaaggatggccgggtgcgggtgtaccggcccaggagcggccctgagcccctgcaggagggccctggccccaagggcggccgcggggccagaattgtgtgggtgtgtgatggccgctgcctgctggtgtctggctttgacagccagagcgagcggcagctgctgctgtatgaggccgaggccctggccggcggccccctggccgtgctgggcctggatgtggcccccagcaccctgctgcccagctatgaccctgacaccggcctggtgctgctgaccgggaagggggacaccagggtcttcctgtatgagctgctgcctgagagccccttcttcctggagtgcaacagcttcaccagcccagacccccacaagggcctggtgctgctgcccaagacagaatgtgatgtgcgggaggtggagctgatgcgctgcctgcggctgcggcagagcagcctggagcctgtggccttccggctgccccgggtgaggaaggagttcttccaggatgatgtgtttcctgacacagctgtgatctgggagcctgtgctgtctgctgaggcctggctgcagggcgccaacggccagccctggctgctgagcctgcagcccccagacatgagccctgtgtcccaggccccccgggaggccccagcccggcgggcccccagcagcgcccagtacctggaggagaagagtgaccagcagaagaaggaggagctgctgaatgccatggtggccaagctgggcaaccgggaggaccccctgccccaggacagctttgagggcgtggatgaagatgagtgggactag

SEQ ID NO: 148464 - DNA, 1386 bp, Artificial Sequence; identical to SEQ ID NO: 142513
  Description of Artificial Sequence: Synthetic coding sequence

SEQ ID NO: 148465 - DNA, 1443 bp, Artificial Sequence
  Description of Artificial Sequence: Synthetic coding sequence
atgacagtgaccaagatgtcctggaggccccagtaccgcagcagcaagttcagaaatgtgtatggcaaggtggccaaccgggagcactgctttgatggcatccccatcaccaagaatgtgcatgacaaccacttctgtgctgtgaacacccgcttcctggccatcgtgacagaatctgctgggggcggcagcttcctggtgatccccctggagcagacaggccgcatcgagcccaactaccccaaggtgtgtggccaccagggcaatgtgctggacatcaagtggaaccccttcatcgacaacatcatcgccagctgcagcgaggacacctctgtgcgcatctgggagatccctgagggcggcctgaagaggaacatgacagaggccctgctggagctgcacggccacagccggcgggtgggcctggtggagtggcaccccaccaccaacaacatcctcttctctgctggctatgactacaaggtgctgatctggaacctggatgtgggggagcctgtgaagatgattgactgccacacagatgtgatcctgtgcatgtccttcaacacagatggcagcctgctgaccaccacctgcaaggacaagaagctgcgggtgattgagcccaggagcggccgggtgctgcaggaggccaactgcaagaaccaccgggtgaacagagtggtgttcctgggcaacatgaagaggctgctgaccaccggggtgagccgctggaacacccggcagatcgccctgtgggaccaggaggacctgtccatgcccctgattgaggaggagattgatggcctgagcggcctgctcttccccttctatgatgctgacacccacatgctgtacctggccgggaaaggagatggcaacatccgctactatgagatcagcacagagaagccctacctgagctacctgatggagttccgcagccctgccccccagaagggcctgggcgtgatgcccaagcacggcctggatgtgtctgcctgtgaggtgttccgcttctacaagctggtgaccctgaagggcctcatcgagcccatctccatgattgtgcccaggagaagtgacagctaccaggaggacatctaccccatgaccccaggcacagagcccgccctgaccccagatgagtggctgggcggcatcaacagagatcctgtgctgatgagcctgaaggagggctacaagaagagcagcaagatggtgttcaaggcccccatcaaggagaagaagtctgtggtggtgaatggcatcgacctgctggagaatgtgccccccaggacagaaaatgagctgctgaggatgttcttccggcagcaggatgagatccggcggctgaaggaggagctggcccagaaggacatccgcatccggcagctgcagctggagctgaagaacctgaggaacagccccaagaactgctag

SEQ ID NO: 148466 - DNA, 1269 bp, Artificial Sequence
  Description of Artificial Sequence: Synthetic coding sequence
atgctggacctggaggtggtgcctgagaggagcctgggcaatgagcagtgggagttcaccctgggcatgcccctggcccaggccgtggccatcctgcagaagcactgccgcatcatcaagaatgtgcaggtgctgtacagcgagcagagccccctgagccatgacctgatcctgaacctgacccaggacggcatcaagctgatgtttgatgccttcaaccagaggctgaaggtgattgaggtgtgtgacctgaccaaggtgaagctgaagtactgcggcgtgcacttcaacagccaggccatcgcccccaccatcgagcagattgaccagagctttggagccacccaccctggggtgtacaacagcgctgagcagctgttccacctgaacttccggggcctgtccttctccttccagctggacagctggacagaggcccccaagtatgagcccaactttgcccacggcctggccagcctgcagatcccccacggggccaccgtgaagaggatgtacatctacagcggcaacagcctgcaggacaccaaggcccccatgatgcccctgagctgcttcctgggcaatgtgtatgcagagagcgtggatgtgctgagagatggcaccggccctgctggcctgcggctgcggctgctggccgccggctgcggccctggcctgctggctgatgccaagatgagggtgtttgagaggtctgtgtactttggagacagctgccaggatgtgctgtccatgctgggcagcccccacaaggtgttctacaagtctgaggacaagatgaagatccacagccccagcccccacaagcaggtgcccagcaagtgcaatgactacttcttcaactacttcaccctgggcgtggacatcctgtttgatgccaacacccacaaggtgaagaagtttgtgctgcacaccaactacccaggccactacaacttcaacatctaccaccgctgtgagttcaagatccccctggccatcaagaaggaaaatgctgatggccagacagagacctgcaccacctacagcaagtgggacaacatccaggagctgctgggccaccctgtggagaagcctgtggtgctgcacaggagcagcagccccaacaacaccaaccccttcggcagcaccttctgcttcggcctgcagaggatgatctttgaggtgatgcagaacaaccacatcgcctctgtgaccctgtatggccccccccggcccggcagccacctgaggacagctgagctgccctag

SEQ ID NO: 148467 - DNA, 1470 bp, Artificial Sequence
  Description of Artificial Sequence: Synthetic coding sequence
atgtccttcaggaaggtggtgcggcagagcaagttccgccacgtgtttggccagcctgtgaagaatgaccagtgctatgaggacatccgggtgtcccgggtgacctgggacagcaccttctgtgctgtgaaccccaagttcctggccgtgattgtggaggccagcggcggcggggccttcctggtgctgcccctgagcaagacaggaagaattgacaaggcctaccccaccgtgtgtggccacacaggccctgtgctggacatcgactggtgcccccacaatgatgaagtcatcgccagcggcagcgaggactgcaccgtgatggtgtggcagatcccagaaaatggcctgaccagccccctgacagagcctgtggtggtgctggagggccacaccaagagggtgggcatcatcgcctggcaccccacagccagaaatgtgctgctgtctgctggctgtgacaacgtggtgctgatctggaatgtgggcacagctgaggagctgtaccgcctggacagcctgcacccagacctgatctacaacgtgtcctggaaccacaacggcagcctcttctgcagcgcctgcaaggacaagtctgtgcgcatcatcgacccccggcggggcaccctggtggccgagcgggagaaggcccacgagggcgcccggcccatgagggccatcttcctggctgatggcaaggtgttcaccaccggcttcagcaggatgtctgagcggcagctggccctgtgggaccctgagaacctggaggagcccatggccctgcaggagctggacagcagcaatggagccctgctgcccttctatgaccctgacacctctgtggtgtatgtgtgtgggaaaggagacagcagcatccgctactttgagatcacagaggagcccccctacatccacttcctgaacaccttcaccagcaaggagccccagaggggcatgggctccatgcccaagaggggcctggaggtgtccaaatgtgagatcgcccgcttctacaagctgcacgagaggaaatgtgagcccatcgtgatgacagtgcccaggaagagtgacctcttccaggatgacctgtacccagacacagctggccctgaggccgccctggaggccgaggagtgggtgtctggaagagatgctgaccccatcctgatcagcctgcgggaggcctacgtgcccagcaagcagagggacctgaagatcagcagaagaaatgtgctgagtgacagcaggcctgccatggcccctggcagcagccacctgggcgccccagccagcaccaccacagctgctgatgccaccccatctggcagcctggcccgggccggggaggccggcaagctggaggaggtgatgcaggagctgcgggccctgcgggccctggtgaaggagcagggcgaccgcatctgccgcctggaggagcagctgggccgcatggagaatggagatgcctag

SEQ ID NO: 148468 - DNA, 864 bp, Artificial Sequence
  Description of Artificial Sequence: Synthetic coding sequence
tgcttcctgctgccccggggccgggaccctgagcccccagaggccggggccgccgccccctgtgcccctggggccccagacatgtccttcaggaaggtggtgcggcagagcaagttcagacatgtgtttggccagcctgtgaagaatgaccagtgctatgaggacatccgggtgtcccgggtgacctgggacagcaccttctgtgctgtgaaccccaagttcctggccgtcatcgtggaggccagcggcggcggggccttcctggtgctgcccctgagcaagacaggaagaattgacaaggcctaccccaccgtgtgtggccacactggacctgtgctggacatcgactggtgcccccacaatgatgaggtgattgccagcggcagcgaggactgcaccgtgatggtgtggcagatcccagaaaatggcctgaccagccccctgacagagcctgtggtggtgctggagggccacaccaagagggtgggcatcatcgcctggcaccccacagccagaaatgtgctgctgtctgctggctgtgacaacgtggtgctgatctggaatgtgggcacagctgaggagctgtaccgcctggacagcctgcacccagacctgatctacaacgtgtcctggaaccacaacggcagcctcttctgcagcgcctgcaaggacaagtctgtgcgcatcatcgacccccggcggggcaccctggtggccgagcgggagaaggcccatgaaggagcccggcccatgagggccatcttcctggctgatggcaaggtgttcaccaccggcttcagcaggatgtctgagcggcagctggccctgtgggaccccggggtgcggcgcttctgcctggcctag

SEQ ID NO: 148469 - DNA, 1470 bp, Artificial Sequence; identical to SEQ ID NO: 148467
  Description of Artificial Sequence: Synthetic coding sequence

SEQ ID NO: 148470 - DNA, 870 bp, Artificial Sequence
  Description of Artificial Sequence: Synthetic coding sequence
atgtccttcaggaaggtggtgcggcagagcaagttccgccacgtgtttggccagcctgtgaagaatgaccagtgctatgaggacatccgggtgtcccgggtgacctgggacagcaccttctgtgctgtgaaccccaagttcctggccgtgattgtggaggccagcggcggcggggccttcctggtgctgcccctgagcaagacaggaagaattgacaaggcctaccccaccgtgtgtggccacacaggccctgtgctggacatcgactggtgcccccacaatgatgaagtcatcgccagcggcagcgaggactgcaccgtgatggtgtggcagatcccagaaaatggcctgaccagccccctgacagagcctgtggtggtgctggagggccacaccaagagggtgggcatcatcgcctggcaccccacagccagaaatgtgctgctgtctgctggctgtgacaacgtggtgctgatctggaatgtgggcacagctgaggagctgtaccgcctggacagcctgcacccagacctgatctacaacgtgtcctggaaccacaacggcagcctcttctgcagcgcctgcaaggacaagtctgtgcgcatcatcgacccccggcggggcaccctggtggccgagcgggagaaggcccacgagggcgcccggcccatgagggccatcttcctggctgatggcaaggtgttcaccaccggcttcagcaggatgtctgagcggcagctggccctgtgggaccctgtgtctggccagcctgagggcgccaacctgcggctgggcccccaccctggccctggccggcagggcagcccctggggcggcctgtggttcctggccagcctgcccggcacctag

SEQ ID NO: 148471 - DNA, 552 bp, Artificial Sequence
  Description of Artificial Sequence: Synthetic coding sequence
atgtccttcaggaaggtggtgcggcagagcaagttccgccacgtgtttggccagcctgtgaagaatgaccagtgctatgaggacatccgggtgtcccgggtgacctgggacagcaccttctgtgctgtgaaccccaagttcctggccgtgattgtggaggccagcggcggcggggccttcctggtgctgcccctgagcaagacaggaagaattgacaaggcctaccccaccgtgtgtggccacacaggccctgtgctggacatcgactggtgcccccacaatgatgaagtcatcgccagcggcagcgaggactgcaccgtgatggtgtggcagatcccagaaaatggcctgaccagccccctgacagagcctgtggtggtgctggagggccacaccaagagggtgggcatcatcgcctggcaccccacagccagaaatgtgctgctgtctgctggcctgcaccggccccccttctgtgcccccccaccccacggccccctgcacaccagccagcagcccctgcagggcccccatgacaagtgggagagctag

SEQ ID NO: 148472 - DNA, 1425 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcaccggggaggccctgatcaacctggatgacatgcacagcgacatgatctacaacgtgtcctggaacagaaatggcagcctcatctgcacagccagcaaggacaagaaggtgcgggtgattgaccccaggaagcaggagatcgtggccgagaaggagaaggcccacgagggcgcccggcccatgagggccatcttcctggctgatggaaatgtgttcaccaccggcttcagcaggatgtctgagcggcagctggccctgtggaaccccaagaacatgcaggagcccatcgccctgcacgagatggacaccagcaatggagtgctgctgcccttctatgaccctgacaccagcatcatctacctgtgtgggaaaggagacagcagcatccgctactttgagatcacagatgagagcccctacgtgcactacctgaacaccttcagcagcaaggagccccagaggggcatgggctacatgcccaagaggggcctggatgtgaacaagtgtgagatcgcccgcttcttcaagctgcacgagaggaaatgtgagcccatcatcatgacagtgcccaggaagagtgacctcttccaggatgacctgtacccagacacagctggccctgaggccgccctggaggccgaggagtggtttgagggcaagaatgctgaccccatcctgatcagcctgaagcacggctacatccctgggaagaacagagacctgaaggtggtgaagaagaacatcctggacagcaagcccacagccaacaagaagtgtgacctgatcagcatccccaagaagaccacagacacagcctctgtgcagaatgaggccaagctggatgagatcctgaaggagatcaagagcatcaaggacaccatctgcaaccaggatgagcgcatcagcaagctggagcagcagatggccaagattgctgcctag

SEQ ID NO: 148473 - DNA, 1584 bp, Artificial Sequence
  Description of Artificial Sequence: Synthetic coding sequence
atgtatggccctggcagccagctgggcaagagcggcaacaacagctgggccaaggagcggggctgcagcatcgcctgccagggcagcctgaccagcgcccggctgcacgcccccagcatcggggagcggcccctgagccacatgcgctggaaggacaccatgagaagagtggtgcggcagagcaagttcagacatgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacactggacctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcactggagaggccctgatcaacctggatgacatgcacagcgacatgatctacaacgtgtcctggaacagaaatggcagcctcatctgcacagccagcaaggacaagaaggtgcgggtcatcgaccccaggaagcaggagatcgtggccgagaaggagaaggcccatgaaggagcccggcccatgagggccatcttcctggctgatggaaatgtgttcaccaccggcttcagcaggatgtctgagcggcagctggccctgtggaaccccaagaacatgcaggagcccatcgccctgcacgagatggacaccagcaatggagtgctgctgcccttctatgaccctgacaccagcatcatctacctgtgtgggaagggggacagcagcatccgctactttgagatcacagatgagagcccctacgtgcactacctgaacaccttcagcagcaaggagccccagaggggcatgggctacatgcccaagaggggcctggatgtgaacaagtgtgaaattgcccgcttcttcaagctgcacgagaggaaatgtgagcccatcatcatgacagtgcccaggaagagtgacctcttccaggatgacctgtacccagacacagctggccctgaggccgccctggaggccgaggagtggtttgagggcaagaatgctgaccccatcctgatcagcctgaagcacggctacatccctgggaagaacagagacctgaaggtggtgaagaagaacatcctggacagcaagcccacagccaacaagaagtgtgacctgatcagcatccccaagaagaccacagacacagcctctgtgcagaatgaggccaagctggatgagatcctgaaggagatcaagagcatcaaggacaccatctgcaaccaggatgagcgcatcagcaagctggagcagcagatggccaagattgctgcctag

SEQ ID NO: 148474 - DNA, 1425 bp, Artificial Sequence; identical to SEQ ID NO: 148472
  Description of Artificial Sequence: Synthetic coding sequence

SEQ ID NO: 148475 - DNA, 489 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcacctag

SEQ ID NO: 148476 - DNA, 498 bp, Artificial Sequence
  Description of Artificial Sequence: Synthetic coding sequence
agcaaggagccccagaggggcatgggctacatgcccaagaggggcctggatgtgaacaagtgtgaaattgcccgcttcttcaagctgcacgagaggaaatgtgagcccatcatcatgacagtgcccaggaagagtgacctcttccaggatgacctgtacccagacacagctggccctgaggccgccctggaggccgaggagtggtttgagggcaagaatgctgaccccatcctgatcagcctgaagcacggctacatccctgggaagaacagagacctgaaggtggtgaagaagaacatcctggacagcaagcccacagccaacaagaagtgtgacctgatcagcatccccaagaagaccacagacacagcctctgtgcagaatgaggccaagctggatgagatcctgaaggagatcaagagcatcaaggacaccatctgcaaccaggatgagcgcatcagcaagctggagcagcagatggccaagattgctgcctag

SEQ ID NO: 148477 - DNA, 546 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcaccggggaggccctgatcaacctggatgacatgcacagcgacatgatctacaacgtgtcctag

SEQ ID NO: 148478 - DNA, 1443 bp, Artificial Sequence
  Description of Artificial Sequence: Synthetic coding sequence
atgcgctggaaggacaccatgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcaccggggaggccctgatcaacctggatgacatgcacagcgacatgatctacaacgtgtcctggaacagaaatggcagcctcatctgcacagccagcaaggacaagaaggtgcgggtgattgaccccaggaagcaggagatcgtggccgagaaggagaaggcccacgagggcgcccggcccatgagggccatcttcctggctgatggaaatgtgttcaccaccggcttcagcaggatgtctgagcggcagctggccctgtggaaccccaagaacatgcaggagcccatcgccctgcacgagatggacaccagcaatggagtgctgctgcccttctatgaccctgacaccagcatcatctacctgtgtgggaaaggagacagcagcatccgctactttgagatcacagatgagagcccctacgtgcactacctgaacaccttcagcagcaaggagccccagaggggcatgggctacatgcccaagaggggcctggatgtgaacaagtgtgagatcgcccgcttcttcaagctgcacgagaggaaatgtgagcccatcatcatgacagtgcccaggaagagtgacctcttccaggatgacctgtacccagacacagctggccctgaggccgccctggaggccgaggagtggtttgagggcaagaatgctgaccccatcctgatcagcctgaagcacggctacatccctgggaagaacagagacctgaaggtggtgaagaagaacatcctggacagcaagcccacagccaacaagaagtgtgacctgatcagcatccccaagaagaccacagacacagcctctgtgcagaatgaggccaagctggatgagatcctgaaggagatcaagagcatcaaggacaccatctgcaaccaggatgagcgcatcagcaagctggagcagcagatggccaagattgctgcctag

SEQ ID NO: 148479 - DNA, 510 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcaccggggaggccctgatcaacctgtag

SEQ ID NO: 148480 - DNA, 456 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctgggggctag

SEQ ID NO: 148481 - DNA, 492 bp, Artificial Sequence
  Description of Artificial Sequence: Synthetic coding sequence
atgagaagagtggtgcggcagagcaagttccgccacgtgtttggccaggccgtgaagaatgaccagtgctatgatgacatccgggtgtcccgggtgacctgggacagcagcttctgtgctgtgaaccccaggtttgtggccatcatcatcgaggccagcggcggcggggccttcctggtgctgcccctgcacaagacaggaagaattgacaagagctaccccaccgtgtgtggccacacaggccctgtgctggacatcgactggtgcccccacaatgaccaggtgattgccagcggcagcgaggactgcaccgtgatggtgtggcagatcccagaaaatggcctgaccctgagcctgacagagcctgtggtgatcctggagggccacagcaagagggtgggcatcgtggcctggcaccccacagccagaaatgtgctgctgtctgctggctgtgacaatgccatcatcatctggaatgtgggcaccggctag

SEQ ID NO: 148482 - DNA, 1578 bp, Artificial Sequence
  Description of Artificial Sequence: Synthetic coding sequence
atgtcctggcacccccagtaccgcagcagcaagttccgccacgtgtttgggaagccagccagcaaagaaaactgctatgacagcgtgcccatcaccaggtctgtgcatgacaaccacttctgtgctgtgaacccccacttcatcgctgtggtgacagaatgtgccggcggcggggccttcctggtgatccccctgcaccagacaggcaagctggacccccactaccccaaggtgtgtggccacagaggaaatgtgctggatgtgaagtggaacccctttgatgactttgagatcgccagctgcagtgaagatgccaccatcaagatctggagcatccccaagcagctgctgaccaggaacctgacagcctacaggaaggagctggtgggccacgccaggagagtgggcctggtggagtggcaccccacagctgccaacatcctcttctctgctggctatgactacaaggtgatgatctggaacctggacaccaaggagagcgtcatcaccagccccatgagcaccatcagctgccaccaggatgtgatcctgtccatgtccttcaacaccaacggcagcctgctggccaccacctgcaaggacaggaagatccgggtgattgaccccagggctggcaccgtgctgcaggaggccagctacaagggccaccgggccagcaaggtgctcttcctgggcaacctgaagaagctgatgagcacaggcaccagccgctggaacaaccggcaggtggccctgtgggaccaggacaacctgtctgtgcccctgatggaggaggacctggatggcagcagtggagtgctcttccccttctatgatgctgacacctccatgctgtatgtggtgggcaaaggagatggcaacatccgctactatgaggtgtctgctgacaagccccacctgagctacctgacagagtaccgcagctacaacccccagaagggcatcggcgtgatgcccaagaggggcctggatgtgagcagctgtgagatcttccgcttctacaagctgatcaccaccaagagcctcatcgagcccatctccatgattgtgcccaggagaagtgagagctaccaggaggacatctacccacccacagctggggcccagcccagcctgacagcccaggagtggctgagcggcatgaacagagaccccatcctggtgtccctgcggcccggcagcgagctgctgcggccccaccccctgcctgctgagcggcccatcttcaacagcatggccccagccagcccccggctgctgaaccagacagagaagctggccgcagaagatggctggaggagcagcagcctgctggaggagaagatgccccgctgggccgctgagcaccggctggaggagaagaagacctggctgaccaatggatttgatgtgtttgaatgtcctccacccaagacagaaaatgagctgctgcagatgttctaccggcagcaggaggagatccggcggctgcgggagctgctgacccagcgggaggtgcaggccaagcagctggagctggagatcaagaacctgaggatgggcagcgagcagctgtag

SEQ ID NO: 148483 - DNA, 1578 bp, Artificial Sequence; identical to SEQ ID NO: 148482
  Description of Artificial Sequence: Synthetic coding sequence

SEQ ID NO: 148484 - DNA, 1443 bp, Artificial Sequence; identical to SEQ ID NO: 148465
  Description of Artificial Sequence: Synthetic coding sequence

SEQ ID NO: 148485 - DNA, 1428 bp, Artificial Sequence
  Description of Artificial Sequence: Synthetic coding sequence
atgtcctggaggccccagtaccgcagcagcaagttcagaaatgtgtatggcaaggtggccaaccgggagcactgctttgatggcatccccatcaccaagaatgtgcatgacaaccacttctgtgctgtgaacacccgcttcctggccatcgtgacagagagcgctgggggcggcagcttcctggtgatccccctggagcagacaggaagaattgagcccaactaccccaaggtgtgtggccaccagggcaatgtgctggacatcaagtggaaccccttcatcgacaacatcatcgccagctgcagcgaggacacctctgtgcgcatctgggagatccctgagggcggcctgaagaggaacatgacagaggccctgctggagctgcacggccacagcagaagagtgggcctggtggagtggcaccccaccaccaacaacatcctcttctctgctggctatgactacaaggtgctgatctggaacctggatgtgggggagcctgtgaagatgattgactgccacacagatgtgatcctgtgcatgtccttcaacacagatggcagcctgctgaccaccacctgcaaggacaagaagctgcgggtcatcgagcccaggagcggccgggtgctgcaggaggccaactgcaagaaccaccgggtgaacagagtggtgttcctgggcaacatgaagaggctgctgaccactggagtgagccgctggaacacccggcagatcgccctgtgggaccaggaggacctgtccatgcccctcatcgaggaggagattgatggcctgagcggcctgctcttccccttctatgatgctgacacccacatgctgtacctggccgggaaaggagatggcaacatccgctactatgagatcagcacagagaagccctacctgagctacctgatggagttccgcagccctgccccccagaagggcctgggcgtgatgcccaagcacggcctggatgtgtctgcctgtgaggtgttccgcttctacaagctggtgaccctgaagggcctgattgagcccatctccatgattgtgccccggcggagtgacagctaccaggaggacatctaccccatgaccccaggcacagagcccgccctgaccccagatgagtggctgggcggcatcaacagagatcctgtgctgatgagcctgaaggagggctacaagaagagcagcaagatggtgttcaaggcccccatcaaggagaagaagtctgtggtggtgaatggaattgacctgctggagaatgtgccccccaggacagaaaatgagctgctgaggatgttcttccggcagcaggatgagatccggcggctgaaggaggagctggcccagaaggacatccgcatccggcagctgcagctggagctgaagaacctgaggaacagccccaagaactgctag

SEQ ID NO: 148486 - DNA, 1428 bp, Artificial Sequence; identical to SEQ ID NO: 148485
  Description of Artificial Sequence: Synthetic coding sequence

SEQ ID NO: 148487 - DNA, 4992 bp, Artificial Sequence
  Description of Artificial Sequence: Synthetic coding sequence
atggccacagatggagccagctgtgagccagacctgagccgggccccagaagatgctgctggagctgctgctgaggccgccaagaaggagtttgatgtggacaccctgagcaagtctgagctgaggatgctgctgtctgtgatggagggggagctggaggcccgggacctggtgattgaggccctgcgggcccggaggaaggaggtgttcatccaggagagatatggccgcttcaacctgaatgaccccttcctggccctgcagagggactatgaagctggagctggggacaaggagaagaagcctgtgtgcaccaaccccctgagcatcctggaggccgtgatggcccactgcaagaagatgcaggagaggatgtctgcccagctggccgctgctgagagccggcagaagaagctggagatggagaagctgcagctgcaggccctggagcaggagcacaagaagctggccgcccggctggaggaggagcggggcaagaacaagcaggtggtgctgatgctggtgaaggagtgcaagcagctgagcggcaaggtgattgaggaggcccagaagctggaggatgtgatggccaagctggaggaggagaagaagaagaccaatgagctggaggaggagctgtctgctgagaagaggaggagcacagagatggaggcccagatggagaagcagctgtctgaatttgacacagagcgggagcagctgcgggccaagctgaaccgggaggaggcccacaccacagacctgaaggaggagattgacaagatgaggaagatgattgagcagctgaagaggggcagtgacagcaagcccagcctgagcctgcccaggaagaccaaggaccggcggctggtgtccatctctgtgggcacagagggcaccgtgaccaggtctgtggcctgccagacagacctggtgacagaaaatgctgaccacatgaagaagctgcccctgaccatgcctgtgaagcccagcacaggcagccccctggtgtctgccaatgccaagggctctgtgtgcaccagcgccaccatggcccggcccggcatcgaccggcaggccagctatggagacctgattggagcctctgtgcctgccttccccccaccttctgccaacaagattgaagaaaatggccccagcacaggcagcaccccagaccccaccagcagcaccccacccctgcccagcaatgctgccccacccacagcccagaccccaggcatcgccccccagaacagccaggccccacccatgcacagcctgcacagcccctgtgccaacaccagcctgcaccctggcctgaacccccgcatccaggccgcccgcttccgcttccagggcaatgccaatgaccctgaccagaatggaaacaccacccagagcccccccagcagagatgtgagccccaccagccgggacaacctggtggccaagcagctggccaggaacacagtgacccaggccctgagccgcttcaccagcccccaggccggggcccccagcaggcctggggtgcccccaactggagatgtgggcacccacccccctgtgggccgcaccagcctgaagacccacggcgtggcccgggtggaccggggcaaccccccacccatcccccccaagaagccaggcctgagccagacccccagccccccccacccccagctgaaggtgatcatcgacagcagccgggccagcaacacaggagccaaggtggacaacaagacagtggccagcacccccagcagcctgccccagggcaacagagtcatcaatgaggagaacctgcccaagagcagcagcccccagctgccccccaagcccagcattgacctgactgtggccccagctggctgtgctgtgtctgccctggccaccagccaggtgggcgcctggccagctgccaccccaggcctgaaccagcctgcctgcagcgacagcagcctggtgatccccaccaccatcgccttctgcagcagcatcaaccctgtgtctgccagcagctgcaggcctggggccagtgacagcctgctggtgacagccagcggctggagccccagcctgacccccctgctgatgtctgggggccctgcccccctggccggccggcccaccctgctgcagcaggccgccgcccagggcaatgtgaccctgctgtccatgctgctgaatgaggagggcctggacatcaactacagctgtgaagatggccacagcgccctgtacagcgctgccaagaatggccacacagactgtgtgcggctgctgctgtctgctgaggcccaggtgaatgctgctgacaagaatggcttcacccccctgtgtgccgctgctgcccagggccactttgaatgtgtggagctgctgatctcctatgatgccaacatcaaccacgccgcagatggcggccagacccccctgtacctggcctgcaagaatggaaacaaggagtgcatcaagctgctgctggaggccggcaccaacagatctgtgaagaccacagatggctggacccctgtgcatgctgctgtggacacaggaaatgtggacagcctgaagctgctgatgtaccaccgcatcccagcccacggcaacagcttcaatgaggaggagagcgagagctctgtgtttgacctggatggaggagaggagagccctgagggcatcagcaagcctgtggtgcctgctgacctgatcaaccacgccaaccgggagggctggacagctgcccacatcgccgccagcaagggcttcaagaactgcctggagatcctgtgcagacatggaggcctggagcctgagcggcgggacaagtgcaacagaacagtgcatgatgtggccacagatgactgcaagcacctgctggagaacctgaatgccctgaagatccccctgcgcatctctgtgggggagattgagcccagcaactacggcagtgatgacctggagtgtgagaacaccatctgtgccctgaacatcaggaagcagacctcctgggatgacttcagcaaggctgtgtcccaggccctgaccaaccacttccaggccatcagcagtgatggctggtggagcctggaggatgtgacctgcaacaacaccacagacagcaacatcggcctgagcgcccggagcatccgcagcatcaccctgggcaatgtgccctggagcgtgggccagagctttgcccagagcccctgggacttcatgaggaagaacaaggccgagcacatcaccgtgctgctgagcggcccccaggagggctgcctgagctctgtgacctacgcctccatgatccccctgcagatgatgcagaactacctgcggctggtggagcagtaccacaacgtcatcttccacggccctgagggcagcctgcaggactacatcgtgcaccagctggccctgtgcctgaagcaccggcagatggctgctggcttcagctgtgaaattgtgcgggcagaggtggatgctggcttcagcaaggagcagctgctggacctcttcatcagcagcgcctgcctgatccctgtgaagcagagccccagcaagaagaagatcatcatcatcctggagaacctggagaagagcagcctgtctgagctgctgcgggacttcctggcccccctggagaacagaagcacagagagcccctgcaccttccagaagggaaatggcctgtctgagtgctactacttccacgagaactgcttcctgatgggcaccatcgccaaggcctgcctgcagggcagtgacctgctggtgcagcagcacttccgctgggtgcagctgcgctgggatggagagcccatgcagggcctgctgcagcgcttcctgcggaggaaggtggtgaacaagttcaagggccaggcccccagcccctgtgaccctgtgtgcaagatcgtggactgggccctgtctgtgtggaggcagctgaacagctgcctggcccggctgggcaccccagaggccctgctgggccccaagtacttcctgagctgccctgtggtgcccggccacgcccaggtgacagtgaagtggatgagcaagctgtggaatggagtcatcgccccccgggtgcaggaggccatcctgagccgggcctctgtgaagaggcagcccggcttcggccagaccacagccaagaggcaccccagccagggccagcaggccgtggtgaaggccgccctgagcatcctgctgaacaaggctgtgctgcacggctgccccctgcccagggctgagctggaccagcacacagctgacttcaagggcggcagcttccccctgagcatcgtgtcctcctacaacacctgcaacaagaagaagggggagagcggggcctggaggaaggtgaacaccagccccaggaggaagagcggccgcttcagcctgcccacctggaacaagccagacctgagcacagagggcatgaagaacaagaccatcagccagctgaactgcaacagaaatgccagcctgagcaagcagaagagcctggagaatgacctgagcctgaccctgaacctggaccagaggctgagcctgggcagtgatgatgaggccgacctggtgaaggagctgcagagcatgtgcagcagcaagtctgagagtgacatcagcaagattgctgacagcagagatgacctgaggatgtttgacagcagcggcaacaaccctgtgctgagcgccaccatcaacaacctgaggatgcctgtgtcccagaaggaggtgagccccctgagcagccaccagaccacagagtgcagcaacagcaagagcaagacagagctgggcgtgtcccgggtgaagagcttcctgcctgtgcccaggagcaaggtgacccagtgcagccagaacaccaagaggagcagcagcagcagcaacacccggcagatcgagatcaacaacaacagcaaggaggtgaactggaacctgcacaagaatgagcacctggagaagcccaacaagtag

SEQ ID NO: 148488 - DNA, 249 bp, Artificial Sequence
  Description of Artificial Sequence: Synthetic coding sequence
atgtctgccacctggaccctgagccctgagcccctgccccccagcacaggcccccctgtgggcgccggcctggatgctgagcagaggacagtgtttgcctttgtgctgtgcctgctggtggtgctggtgctgctgatggtgcgctgtgtgcgcatcctgctggacccctacagcaggatgcctgccagctcctggacagaccacaaggaggccctggagcggggccagtttgattatgccctggtgtag

SEQ ID NO: 148489 - DNA, 969 bp, Artificial Sequence
  Description of Artificial Sequence: Synthetic coding sequence
atgagccccaacttcaagctgcagtgccacttcatcctgatcttcctgacagccctgcggggggagagccgctacctggagctgcgggaggccgctgactatgaccccttcctgctcttcagcgccaacctgaagcgggagctggccggggagcagccctacagaagagccctgcgctgcctggacatgctgagcctgcagggccagttcaccttcaccgctgaccggccccagctgcactgtgccgccttcttcatcagcgagcctgaggagttcatcaccatccactatgaccaggtgtccattgactgccagggcggggacttcctgaaggtgtttgatggctggatcctgaagggggagaagttccccagcagccaggaccaccccctgcccagcgctgagcgctacatcgacttctgtgagagcggcctgagcagaagaagcatccgcagcagccagaatgtggccatgatcttcttccgggtgcatgagcctggaaatggcttcaccctgaccatcaagacagaccccaacctcttcccctgcaacgtcatcagccagaccccaaatggcaagttcaccctggtggtgccccaccagcacaggaactgcagcttcagcatcatctaccctgtggtgatcaagatcagtgacctgaccctgggccacgtgaatggcctgcagctgaagaagagcagcgctggctgtgagggcatcggggactttgtggagctgctgggcggcaccggcctggaccccagcaagatgacccccctggccgacctgtgctaccccttccacggccctgcccagatgaaggtgggctgtgacaacacagtggtgaggatggtgtcctctgggaagcacgtgaacagagtgacctttgagtaccggcagctggagccctatgagctggagaaccccaacggcaacagcatcggggagttctgcctgagcggcctgtag

SEQ ID NO: 148490 - DNA, 723 bp, Artificial Sequence
  Description of Artificial Sequence: Synthetic coding sequence
atgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 148491 - DNA, 1248 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 148492 - DNA, 858 bp, Artificial Sequence
  Description of Artificial Sequence: Synthetic coding sequence
atggtgtctgccaccatcccccagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtaccgggccagcctgtgcctgtgcagcacagtgagcagcatcgtgcgctctgtgctgcccagcggccggggcggcactggaggccgcaccagcaccaggtctgtgcctgagtggcctgtgccctgccccagccccccaccccagcctgtgtctgccttcaccgccagcagcagcccccagcagagcgagctggccggccacggggccgcccccaaggagctgtggctgggcggctag

SEQ ID NO: 148493 - DNA, 1206 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 148494 - DNA, 1128 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagtgacaatggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 148495 - DNA, 1335 bp, Artificial Sequence
  Description of Artificial Sequence: Synthetic coding sequence
atgggcggccacccccagctgcggctggtgaaggccctgctgctgctgggcctgaaccctgtgtctgccagcctgcaggaccagcactgtgagagcctgagcctggccagcaacatcagcggcctgcagtgcaatgcctctgtggacctgattggcacctgctggcccaggagccctgctggccagctggtggtgcggccctgcccagccttcttctatggagtgcgctacaacaccaccaacaacggctaccgggagtgcctggccaacggctcctgggccgcccgggtgaactacagcgagtgccaggagatcctgaatgaggagaagaagagcaaggtgcactaccacgtggccgtcatcatcaactacctgggccactgcatcagcctggtggccctgctggtggcctttgtgctcttcctgcggctgcggcccggctgcacccactggggagaccaggctgatggagccctggaggtgggcgccccctggagcggggcccccttccaggtgagaagaagcatccgctgcctgaggaacatcatccactggaacctgatcagcgccttcatcctgagaaatgccacctggtttgtggtgcagctgaccatgagccctgaggtgcaccagagcaatgtgggctggtgccgcctggtgacagctgcctacaactacttccacgtgaccaacttcttctggatgtttggagagggctgctacctgcacacagccatcgtgctgacctacagcacagaccggctgaggaagtggatgttcatctgcatcggctggggcgtgcccttccccatcatcgtggcctgggccatcggcaagctgtactatgacaatgagaagtgctggtttgggaagaggcctggggtgtacacagactacatctaccagggccccatgatcctggtgctgctgatcaacttcatcttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgaggtgtcccgggtggtgttcatctacttcaacagcttcctggagagcttccagggcttctttgtgtctgtgttctactgcttcctgaacagcgaggtgcgcagcgccatcaggaagcgctggcaccgctggcaggacaagcacagcatccgggcccgggtggcccgggccatgagcatccccaccagccccaccagggtgtccttccacagcatcaagcagagcacagctgtgtag

SEQ ID NO: 148496 - DNA, 114 bp, Artificial Sequence
  Description of Artificial Sequence: Synthetic coding sequence
gtgtacacagactacatctacttcaacagcttcctggagagcttccagggcttctttgtgtctgtgttctactgcttcctgaacagcgaggtgcgcagcgccatcaggaagtag

SEQ ID NO: 148497 - DNA, 1206 bp, Artificial Sequence; identical to SEQ ID NO: 148493
  Description of Artificial Sequence: Synthetic coding sequence

SEQ ID NO: 148498 - DNA, 1194 bp, Artificial Sequence
  Description of Artificial Sequence: Synthetic coding sequence
atgggccgggagccctggccagaggaccgggacctgggcttcccccagctgttctgccagggcccctacagctactgcaacaccaccctggaccagatcggcacctgctggcccaggtctgctgctggggccctggtggagcggccctgcccagagtacttcaatggagtgaagtacaacaccaccagaaatgcctaccgggagtgcctggagaatggcacctgggccagcaagatcaactacagccagtgtgagcccatcctggatgacaagcagaggaaatatgacctgcactacagaattgccctggtggtgaactacctgggccactgtgtgtctgtggccgccctggtggccgccttcctgctcttcctggccctgcggagcatccgctgcctgagaaatgtcatccactggaacctgatcaccaccttcatcctgagaaatgtgatgtggttcctgctgcagctggtggaccacgaggtgcatgagagcaatgaggtgtggtgccgctgcatcaccaccatcttcaactactttgtggtgaccaacttcttctggatgtttgtggagggctgctacctgcacacagccatcgtgatgacctacagcacagagcggctgaggaagtgcctcttcctgttcatcggctggtgcatccccttccccatcatcgtggcctgggccatcggcaagctgtactatgaaaatgagcagtgctggtttgggaaggagcccggggacctggtggactacatctaccagggccccatcatcctggtgctgctgatcaactttgtgttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgacctgagccagatcatgttcatctacttcaacagcttcctgcagagcttccagggcttctttgtgtctgtgttctactgcttcttcaatggagaggtgcgctctgctgtgaggaagcgctggcaccgctggcaggaccaccacagcctgcgggtgcccatggcccgggccatgagcatccccaccagccccacccgcatctccttccacagcatcaagcagacagctgctgtgtag

SEQ ID NO: 148499 - DNA, 1317 bp, Artificial Sequence
  Description of Artificial Sequence: Synthetic coding sequence
atgaggggccccagcggccccccaggcctgctgtatgtgccccacctgctgctgtgcctgctgtgcctgctgcccccacccctgcagtatgctgctggccagagccagatgcccaaggaccagcccctgtgggccctgctggagcagtactgccacaccatcatgaccctgaccaacctgagcggcccctacagctactgcaacaccaccctggaccagatcggcacctgctggcccaggtctgctgctggggccctggtggagcggccctgcccagagtacttcaacggggtgaagtacaacaccaccagaaatgcctacagagaatgtctggagaatggcacctgggccagcaagatcaactacagccagtgtgagcccatcctggatgacaagcagaggaaatatgacctgcactaccgcatcgccctggtggtgaactacctgggccactgtgtgtctgtggccgccctggtggccgccttcctgctcttcctggccctgcggagcatccgctgcctgagaaatgtcatccactggaacctgatcaccaccttcatcctgagaaatgtgatgtggttcctgctgcagctggtggaccacgaggtgcatgagagcaatgaggtgtggtgccgctgcatcaccaccatcttcaactactttgtggtgaccaacttcttctggatgtttgtggagggctgctacctgcacacagccatcgtgatgacctacagcacagagcggctgaggaaatgtctcttcctgttcatcggctggtgcatccccttccccatcatcgtggcctgggccatcggcaagctgtactatgaaaatgagcagtgctggtttgggaaggagcccggggacctggtggactacatctaccagggccccatcatcctggtgctgctgatcaactttgtgttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgacctgagccagatcatgttcatctacttcaacagcttcctgcagagcttccagggcttctttgtgtctgtgttctactgcttcttcaacggggaggtgcgctctgctgtgaggaagcgctggcaccgctggcaggaccaccacagcctgcgggtgcccatggcccgggccatgagcatccccaccagccccacccgcatctccttccacagcatcaagcagacagctgctgtgtag

SEQ ID NO: 148500 - DNA, 1236 bp, Artificial Sequence
  Description of Artificial Sequence: Synthetic coding sequence
atggatgctgccctgctgcacagcctgctggaggccaactgcagcctggccctggccgaggagctgctgctggatggctggggcccccccctggaccctgagggcccctacagctactgcaacaccaccctggaccagatcggcacctgctggcccaggtctgctgctggggccctggtggagcggccctgcccagagtacttcaatggagtgaagtacaacaccaccagaaatgcctaccgggagtgcctggagaatggcacctgggccagcaagatcaactacagccagtgtgagcccatcctggatgacaagcagaggaaatatgacctgcactacagaattgccctggtggtgaactacctgggccactgtgtgtctgtggccgccctggtggccgccttcctgctcttcctggccctgcggagcatccgctgcctgagaaatgtcatccactggaacctgatcaccaccttcatcctgagaaatgtgatgtggttcctgctgcagctggtggaccacgaggtgcatgagagcaatgaggtgtggtgccgctgcatcaccaccatcttcaactactttgtggtgaccaacttcttctggatgtttgtggagggctgctacctgcacacagccatcgtgatgacctacagcacagagcggctgaggaagtgcctcttcctgttcatcggctggtgcatccccttccccatcatcgtggcctgggccatcggcaagctgtactatgaaaatgagcagtgctggtttgggaaggagcccggggacctggtggactacatctaccagggccccatcatcctggtgctgctgatcaactttgtgttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgacctgagccagatcatgttcatctacttcaacagcttcctgcagagcttccagggcttctttgtgtctgtgttctactgcttcttcaatggagaggtgcgctctgctgtgaggaagcgctggcaccgctggcaggaccaccacagcctgcgggtgcccatggcccgggccatgagcatccccaccagccccacccgcatctccttccacagcatcaagcagacagctgctgtgtag

SEQ ID NO: 148501 - DNA, 1113 bp, Artificial Sequence
  Description of Artificial Sequence: Synthetic coding sequence
atggatgctgccctgctgcacagcctgctggaggccaactgcagcctggccctggccgaggagctgctgctggatggctggggcccccccctggaccctgagggcccctacagctactgcaacaccaccctggaccagatcggcacctgctggcccaggtctgctgctggggccctggtggagcggccctgcccagagtacttcaatggagtgaagtacaacaccaccagaaatgcctaccgggagtgcctggagaatggcacctgggccagcaagatcaactacagccagtgtgagcccatcctggatgacaagcagaggaaatatgacctgcactacagaattgccctggtggtgaactacctgggccactgtgtgtctgtggccgccctggtggccgccttcctgctcttcctggccctgcggagcatccgctgcctgagaaatgtcatccactggaacctgatcaccaccttcatcctgagaaatgtgatgtggttcctgctgcagctggtggaccacgaggtgcatgagagcaatgaggtgtggtgccgctgcatcaccaccatcttcaactactttgtggtgaccaacttcttctggatgtttgtggagggctgctacctgcacacagccatcgtgatgacctacagcacagagcggctgaggaagtgcctcttcctgttcatcggctggtgcatccccttccccatcatcgtggcctgggccatcggcaagctgtactatgaaaatgagcagtgctggtttgggaaggagcccggggacctggtggactacatctaccagggccccatcatcctggtgctgctgatcaactttgtgttcctgttcaacatcgtgcgcatcctgatgaccaagctgcgggccagcaccaccagcgagaccatccagtacaggaaggctgtgaaggccaccctggtgctgctgcccctgctgggcatcacctacatgctgttctttgtgaaccctggagaagatgacctgagccagatcatgttcatctacttcaacagcttcctgcagagcttccagggcttctttgtgtctgtgttctactgcttcttcaatggagagggcctggagcctgtgtag

SEQ ID NO: 148502 - DNA, 468 bp, Artificial Sequence
  Description of Artificial Sequence: Synthetic coding sequence
atgtaccgccacaagaacagctggaggctgggcctgaagtacccacccagcagcaaggaggagacccaggtgcccaagaccctcatcagcggcctgcccggcaggaagagcagcagccgggtgggggagaagctgcagagcgcccacaagatgcccctgagccctggcctgctgctgctgctgctgagcggggccacagccacagctgccctgcccctggagggcggccccaccggccgggacagcgagcacatgcaggaggccgccggcatcaggaagagcagcctgctgaccttcctggcctggtggtttgagtggaccagccaggccagcgctggccccctcatcggggaggaggcccgggaggtggcccggcggcaggagggcgccccaccccagcagagcgcccggcgggacaggatgccctgcaggaacttcttctggaagaccttcagcagctgcaagtag

SEQ ID NO: 148503 - DNA, 318 bp, Artificial Sequence
  Description of Artificial Sequence: Synthetic coding sequence
atgcccctgagccctggcctgctgctgctgctgctgagcggggccacagccacagctgccctgcccctggagggcggccccaccggccgggacagcgagcacatgcaggaggccgccggcatcaggaagagcagcctgctgaccttcctggcctggtggtttgagtggaccagccaggccagcgctggccccctcatcggggaggaggcccgggaggtggcccggcggcaggagggcgccccaccccagcagagcgcccggcgggacaggatgccctgcaggaacttcttctggaagaccttcagcagctgcaagtag

SEQ ID NO: 148504 - DNA, 1332 bp, Artificial Sequence
  Description of Artificial Sequence: Synthetic coding sequence
atggccgccagcccccacaccctgagcagccggctgctgaccggctgtgtgggcggctctgtgtggtacctggagaggaggaccatccaggacagcccccacaagttcctgcacctgctgagaaatgtgaacaagcagtggatcaccttccagcacttctccttcctgaagaggatgtatgtgacccagctgaacagaagccacaaccagcaggtgcggcccaagccagagcctgtggccagccccttcctggagaagaccagcagcggccaggccaaggccgagatctatgagatgaggcccctgagcccccccagcctgagcctgagcaggaagcccaatgagaaggagctgattgagctggagccagattctgtgattgaggacagcattgatgtgggcaaggagaccaaggaggagaagcgctggaaggagatgaagctgcaggtgtatgacctgcccggcatcctggcccggctgagcaagatcaagctgacagccctggtggtgtccaccacagctgctggctttgccctggcccctggcccctttgactggccctgcttcctgctgacctctgtgggcaccggcctggccagctgtgccgccaacagcatcaaccagttctttgaggtgccctttgacagcaacatgaacagaaccaagaaccggcccctggtgcggggccagatcagccccctgctggccgtgtcctttgccacctgctgtgctgtgcctggggtggccatcctgaccctgggcgtgaaccccctgactggagccctgggcctcttcaacatcttcctgtacacctgctgctacacccccctgaagaggatcagcatcgccaacacctgggtgggcgctgtggtgggcgccatcccccctgtgatgggctggacagctgccaccggcagcctggatgctggggccttcctgctgggcggcatcctgtacagctggcagttcccccacttcaatgccctgtcctggggcctgcgggaggactacagccggggcggctactgcatgatgtctgtgacccaccctggcctgtgccggcgggtggccctgcggcactgcctggccctgctggtgctgtctgctgctgcccctgtgctggacatcaccacctggaccttccccatcatggccctgcccatcaatgcctacatctcctacctgggcttccgcttctacgtggatgctgacagaagaagcagcagaagactcttcttctgcagcctgtggcacctgcccctgctgctgctgctgatgctgacctgcaagaggccttctggaggaggagatgctggccccccacccagctag

SEQ ID NO: 148505 - DNA, 399 bp, Artificial Sequence
  Description of Artificial Sequence: Synthetic coding sequence
tgaagaaatgtgaacaagcagtggatcaccttccagcacttctccttcctgaagaggatgtatgtgacccagctgaacagaagccacaaccagcaggtgcggcccaagccagagcctgtggccagccccttcctggagaagaccagcagcggccaggccaaggccgagatctatgagatgaggcccctgagcccccccagcctgagcctgagcaggaagcccaatgagaaggagctgattgagctggagccagacagcgtgattgaagattccattgatgtgggcaaggagaccaaggaggagaagcgctggaaggagatgaagctgcaggtgtatgacctgcccggcatcctggcccggctgagcaagatcaagctgaccggcaccctcttcttctag

SEQ ID NO: 148506 - DNA, 756 bp, Artificial Sequence
  Description of Artificial Sequence: Synthetic coding sequence
atgatctgccaggagttctggctggactaccccaagagcaacagccagttctttgaggtgccctttgacagcaacatgaacagaaccaagaaccggcccctggtgcggggccagatcagccccctgctggccgtgtcctttgccacctgctgtgctgtgcctggggtggccatcctgaccctgggcgtgaaccccctgactggagccctgggcctcttcaacatcttcctgtacacctgctgctacacccccctgaagaggatcagcatcgccaacacctgggtgggcgctgtggtgggcgccatcccccctgtgatgggctggacagctgccaccggcagcctggatgctggggccttcctgctgggcggcatcctgtacagctggcagttcccccacttcaatgccctgtcctggggcctgcgggaggactacagccggggcggctactgcatgatgtctgtgacccaccctggcctgtgccggcgggtggccctgcggcactgcctggccctgctggtgctgtctgctgctgcccctgtgctggacatcaccacctggaccttccccatcatggccctgcccatcaatgcctacatctcctacctgggcttccgcttctacgtggatgctgacagaagaagcagcagaagactcttcttctgcagcctgtggcacctgcccctgctgctgctgctgatgctgacctgcaagaggccttctggaggaggagatgctggccccccacccagctag

SEQ ID NO: 148507 - DNA, 681 bp, Artificial Sequence
  Description of Artificial Sequence: Synthetic coding sequence
atgaacagaaccaagaaccggcccctggtgcggggccagatcagccccctgctggccgtgtcctttgccacctgctgtgctgtgcctggggtggccatcctgaccctgggcgtgaaccccctgaccggggccctgggcctcttcaacatcttcctgtacacctgctgctacacccccctgaagaggatcagcatcgccaacacctgggtgggcgctgtggtgggcgccatcccccctgtgatgggctggacagctgccaccggcagcctggatgctggggccttcctgctgggcggcatcctgtacagctggcagttcccccacttcaatgccctgtcctggggcctgcgggaggactacagcagaggaggctactgcatgatgtctgtgacccaccctggcctgtgcagaagagtggccctgcggcactgcctggccctgctggtgctgtctgctgctgcccctgtgctggacatcaccacctggaccttccccatcatggccctgcccatcaatgcctacatctcctacctgggcttccgcttctacgtggatgctgaccggcgcagcagccggcggctcttcttctgcagcctgtggcacctgcccctgctgctgctgctgatgctgacctgcaagaggcccagcggcggcggagatgctggccccccacccagctag

SEQ ID NO: 148508 - DNA, 831 bp, Artificial Sequence
  Description of Artificial Sequence: Synthetic coding sequence
atgggcggcctgtggaggcctggctggaggtgtgtgcccttctgtggctggcgctggatccaccctggcagccccaccagggctgctgagcgggtggagcccttcctgcggcctgagtggagcggcactggaggagctgagcggggcctgcgctggctgggcacctggaagcgctgcagcctgcgggcccggcacccagccctgcagcccccccggcggcccaagagcagcaaccccttcacccgggcccaggaggaggagcggcggcggcagaacaagaccaccctgacctacgtggccgctgtggccgtgggcatgctgggcgccagctatgctgctgtgcccctgtaccgcctgtactgccagaccaccggcctgggcggcagcgctgtggccggccacgccagtgacaagattgagaacatggtgcctgtgaaggaccgcatcatcaagatctccttcaatgctgatgtgcacgccagcctgcagtggaacttccggccccagcagacagagatctacgtggtgcctggagaaacagccctggccttctaccgggccaagaaccccacagacaagcctgtgattggcatcagcacctacaacatcgtgccctttgaggccggccagtacttcaacaagatccagtgcttctgctttgaggagcagaggctgaacccccaggaggaggtggacatgcctgtgttcttctacattgatcctgagtttgctgaggaccccaggatgatcaaggtggacctgatcaccctgagctacaccttctttgaggccaaggagggccacaagctgcctgtgcccggctacaactag

SEQ ID NO: 148509 - DNA, 1233 bp, Artificial Sequence
  Description of Artificial Sequence: Synthetic coding sequence
atgcagaggctgctcttcccccccctgcgggccctgaagggccggcagtacctgcccctgctggcccccagggctgccccccgggcccagtgtgactgcatcagaagacccctgcggcccggccagtacagcaccatcagcgaggtggccctgcagagcggccggggcaccgtgtccctgcccagcaaggctgctgagcgggtggtgggccgctggctgctggtgtgcagcggcaccgtggccggggctgtgatcctgggcggcgtgacccggctgacagaaagtggcctgtccatggtggactggcacctgatcaaggagatgaagccacccaccagccaggaggagtgggaggccgagttccagcgctaccagcagtttcctgagttcaagatcctgaaccacgacatgaccctgacagagttcaagttcatctggtacatggagtacagccacaggatgtggggccgcctggtgggcctggtgtacatcctgcctgctgcctacttctggaggaagggctggctgagccggggcatgaagggccgggtgctggccctgtgtggcctggtgtgcttccagggcctgctgggctggtacatggtgaagagcggcctggaggagaagagtgacagccatgacatcccccgggtgtcccagtaccgcctggccgcccacctgggcagcgccctggtgctgtactgtgccagcctgtggaccagcctgagcctgctgctgcccccccacaagctgcctgagacccaccagctgctgcagctgcggagatttgcccatggaacagctggcctggtgttcctgacagccctgagcggggcctttgtggccggcctggatgctggcctggtgtacaacagcttccccaagatgggagagagctggatcccagaagatctcttcaccttcagccccatcctgagaaatgtgtttgagaaccccaccatggtgcagtttgaccaccgcatcctgggcatcacctctgtgacagccatcaccgtgctgtacttcctgagccgccgcatccccctgcccaggaggaccaagatggctgctgtgaccctgctggccctggcctacacccaggtgggcctgggcatcagcaccctgctgatgtatgtgcccacccccctggccgccacccaccagagcggcagcctggccctgctgaccggggccctgtggctgatgaatgagctgcggcgggtgcccaagtag

SEQ ID NO: 148510 - DNA, 1167 bp, Artificial Sequence
  Description of Artificial Sequence: Synthetic coding sequence
atgcagaggctgctcttcccccccctgcgggccctgaagggccggcagtacctgcccctgctggcccccagggctgccccccgggcccagtgtgactgcatcagaagacccctgcggcccggccagtacagcaccatcagcgaggtggccctgcagagcggccggggcaccgtgtccctgcccagcaaggctgctgagcgggtggtgggccgctggctgctggtgtgcagcggcaccgtggccggggctgtgatcctgggcggcgtgacccggctgacagaaagtggcctgtccatggtggactggcacctgatcaaggagatgaagccacccaccagccaggaggagtgggaggccgagttccagcgctaccagcagtttcctgagttcaagatcctgaaccacgacatgaccctgacagagttcaagttcatctggtacatggagtacagccacaggatgtggggccgcctggtgggcctggtgtacatcctgcctgctgcctacttctggaggaagggctggctgagccggggcatgaagggccgggtgctggccctgtgtggcctggtgtgcttccagggcctgctgggctggtacatggtgaagagcggcctggaggagaagagtgacagccatgacatcccccgggtgtcccagtaccgcctggccgcccacctgggcagcgccctggtgctgtactgtgccagcctgtggaccagcctgagcctgctgctgcccccccacaagctgcctgagacccaccagctgctgcagctgcggagatttgcccatggaacagctggcctggtgttcctgacagccctgagcggggcctttgtggccggcctggatgctggcctggtgtacaacagcttccccaagatgggagagagctggatcccagaagatctcttcaccttcagccccatcctgagaaatgtgtttgagaaccccaccatggtgcagtttgaccaccgcatcctgggcatcacctctgtgacagccatcaccgtgctgtacttcctgagccgccgcatccccctgcccaggaggaccaagatggctgctgtgaccctgctggccctggcctacacccagggccctgtgctcttcaacttcaccttcaagatcagtgacctggatgagggcatccggaacatctag

SEQ ID NO: 148511 - DNA, 192 bp, Artificial Sequence
  Description of Artificial Sequence: Synthetic coding sequence
atgcctggcctggtggacagcaacccagcccctcctgagagccaggagaagaagcccctgaagccctgctgtgcctgcccagagaccaagaaggccagagatgcctgcatcatcgagaagggggaggagcactgcggccacctgattgaggcccacaaggagtgcatgagggccctgggcttcaagatctag

SEQ ID NO: 148512 - DNA, 192 bp, Artificial Sequence; identical to SEQ ID NO: 148511
  Description of Artificial Sequence: Synthetic coding sequence

SEQ ID NO: 148513 - DNA, 297 bp, Artificial Sequence
  Description of Artificial Sequence: Synthetic coding sequence
atgcctggcctggtggacagcaacccagcccctcctgagagccaggagaagaagcccctgaagccctgctgtgcctgcccagagaccaagaaggccagagatgcctggttccggggccgggtgtctgtggacctgagccgcagcctggtgcctggaaatgatggagagcggggggagcggcaggccagcaccacccacagcttcctgcagatcatcattgaaaaaggagaggagcactgcggccacctgattgaggcccacaaggagtgcatgagggccctgggcttcaagatctag

SEQ ID NO: 148514 - DNA, 192 bp, Artificial Sequence; identical to SEQ ID NO: 148511
  Description of Artificial Sequence: Synthetic coding sequence

SEQ ID NO: 148515 - DNA, 1098 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgatcatcctgtacagcggggacaagatctatgatgactactacccagacctgaagggccgggtgcacttcaccagcaatgacctgaagtctggagatgccagcatcaacgtgaccaacctgcagctgagtgacatcggcacctaccagtgcaaggtgaagaaggcccctggggtggccaacaagaagatccacctggtggtgctggtgaagcccagcggggcccgctgctacgtggatggcagcgaggagatcggcagtgacttcaagatcaagtgtgagcccaaggagggcagcctgcccctgcagtatgagtggcagaagctgagtgacagccagaagatgcccacctcctggctggccgagatgaccagcagcgtcatctctgtgaagaatgccagcagcgagtacagcggcacctacagctgcaccgtgaggaacagagtgggcagtgaccagtgcctgctgcggctgaatgtggtgccccccagcaacaaggccggcctgattgctggggccatcatcggcaccctgctggccctggccctgattggcctcatcatcttctgctgcaggaagaagaggcgggaggagaagtatgagaaggaggtgcaccacgacatcagagaagatgtgcccccacccaagagcaggaccagcacagcccggagctacatcggcagcaaccacagcagcctgggctccatgagccccagcaacatggagggctacagcaagacccagtacaaccaggtgcccagcgaggactttgagaggaccccccagagccccaccctgcccccagccaaggtggccgcccccaacctgagcaggatgggcgccatccctgtgatgatcccagcccagagcaaggatggcagcatcgtgtag

SEQ ID NO: 148516 - DNA, 975 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgatcatcctgtacagcggggacaagatctatgatgactactacccagacctgaagggccgggtgcacttcaccagcaatgacctgaagtctggagatgccagcatcaacgtgaccaacctgcagctgagtgacatcggcacctaccagtgcaaggtgaagaaggcccctggggtggccaacaagaagatccacctggtggtgctggtgaagcccagcggggcccgctgctacgtggatggcagcgaggagatcggcagtgacttcaagatcaagtgtgagcccaaggagggcagcctgcccctgcagtatgagtggcagaagctgagtgacagccagaagatgcccacctcctggctggccgccagcaacaaggccggcctgattgctggggccatcatcggcaccctgctggccctggccctgattggcctcatcatcttctgctgcaggaagaagagaagagaggagaagtatgagaaggaggtgcaccacgacatccgggaggatgtgcccccacccaagagcaggaccagcacagcccggagctacatcggcagcaaccacagcagcctgggctccatgagccccagcaacatggagggctacagcaagacccagtacaaccaggtgcccagtgaagattttgagaggaccccccagagccccaccctgcccccagccaaggtggccgcccccaacctgagcaggatgggcgccatccctgtgatgatcccagcccagagcaaggatggcagcatcgtgtag

SEQ ID NO: 148517 - DNA, 603 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgatcatcctgtacagcggggacaagatctatgatgactactacccagacctgaagggccgggtgcacttcaccagcaatgacctgaagtctggagatgccagcatcaacgtgaccaacctgcagctgagtgacatcggcacctaccagtgcaaggtgaagaaggcccctggggtggccaacaagaagatccacctggtggtgctgggcaagatgtgccacctgcagagagctgtgcggcccctgcctgaggccaccagcgctgtgatcatccacccctggggcccctgcctgctgcccacctggaaggacatcccccggctgagcatcaccaagtaccaggtgaagaccctgaatgccctgctgcgggtgcggctgagccacctgctgaggtag

SEQ ID NO: 148518 - DNA, 759 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgatcatcctgtacagcggggacaagatctatgatgactactacccagacctgaagggccgggtgcacttcaccagcaatgacctgaagtctggagatgccagcatcaacgtgaccaacctgcagctgagtgacatcggcacctaccagtgcaaggtgaagaaggcccctggggtggccaacaagaagatccacctggtggtgctggtgaagcccagcggggcccgctgctacgtggatggcagcgaggagatcggcagtgacttcaagatcaagtgtgagcccaaggagggcagcctgcccctgcagtatgagtggcagaagctgagtgacagccagaagatgcccacctcctggctggccggcaagatgtgccacctgcagagagctgtgcggcccctgcctgaggccaccagcgctgtgatcatccacccctggggcccctgcctgctgcccacctggaaggacatcccccggctgagcatcaccaagtaccaggtgaagaccctgaatgccctgctgcgggtgcggctgagccacctgctgaggtag

SEQ ID NO: 148519 - DNA, 1059 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgatcatcctgtacagcggggacaagatctatgatgactactacccagacctgaagggccgggtgcacttcaccagcaatgacctgaagtctggagatgccagcatcaacgtgaccaacctgcagctgagtgacatcggcacctaccagtgcaaggtgaagaaggcccctggggtggccaacaagaagatccacctggtggtgctggtgaagcccagcggggcccgctgctacgtggatggcagcgaggagatcggcagtgacttcaagatcaagtgtgagcccaaggagggcagcctgcccctgcagtatgagtggcagaagctgagtgacagccagaagatgcccacctcctggctggccgagatgaccagcagcgtcatctctgtgaagaatgccagcagcgagtacagcggcacctacagctgcaccgtgaggaacagagtgggcagtgaccagtgcctgctgcggctgaatgtggtgccccccagcaacaaggccggcctgattgctggggccatcatcggcaccctgctggccctggccctgattggcctcatcatcttctgctgcaggaagaagaggcgggaggagaagtatgagaaggaggtgcaccacgacatcagagaagatgtgcccccacccaagagcaggaccagcacagcccggagctacatcggcagcaaccacagcagcctgggctccatgagccccagcaacatggagggctacagcaagacccagtacaaccaggtgcccagcgaggactttgagaggaccccccagagccccaccctgcccccagccaagttcaagtacccctacaagacagatggcatcaccgtggtgtag

SEQ ID NO: 148520 - DNA, 270 bp, Artificial Sequence
  Description of Artificial Sequence: Synthetic coding sequence
atggccctgctgctgtgctttgtgctgctgtgtggggtggtggactttgcccggagcctgagcatcaccaccccagaggagatgattgagaaggccaagggggagacagcctacctgccctgcaagttcaccctgagccctgaggaccagggccccctggacatcgagtggctgatcagccctgctgacaaccagaaggtggaccaggtgggccgctgtgccaccagcaaggagccctacgtgcactgccagaagctgcaccggcagtag

SEQ ID NO: 148521 - DNA, 900 bp, Artificial Sequence
  Description of Artificial Sequence: Synthetic coding sequence
atggaggagtttgacagcgaggacttcagcaccagcgaggaggatgaggactatgtgcccagcggcggggagtacagtgaagatgatgtgaatgagctggtgaaggaggatgaggtggatggagaggagcagacccagaagacccagggcaagaagaggaaggcccagagcatcccagccaggaagaggcggcagggcggcctgagcctggaggaggaggaggaggaggatgccaacagcgagagcgagggcagcagcagcgaggaggaggatgatgctgctgagcaggagaagggcatcggctctgaagatgccaggaagaagaaggaggatgagctgtgggccagcttcctgaatgatgtgggccccaagagcaaggtgccccccagcacccaggtgaagaagggggaggagacagaggagaccagcagcagcaagctgctggtgaaggccgaggagctggagaagcccaaggagacagagaaggtgaagatcaccaaggtgtttgattttgctggggaggaggtgcgggtgaccaaggaggtggatgccaccagcaaggaggccaagagcttcttcaagcagaatgagaaggagaagccccaggccaacgtgcccagcgccctgcccagcctgcctgctggcagcggcctgaagaggagcagcggcatgagcagcctgctgggcaagattggagccaagaagcagaagatgagcaccctggagaagagcaagctggactgggagagcttcaaggaggaggagggcattggagaggagctggccatccacaacagaggcaaggagggctacatcgagaggaaggccttcctggacagagtggaccaccggcagtttgaaattgaaagagacctgcggctgagcaagatgaagccctag

SEQ ID NO: 148522 - DNA, 675 bp, Artificial Sequence
  Description of Artificial Sequence: Synthetic coding sequence
atggagaagctgctgtgcttcctggtgctgaccagcctgagccacgccttcggccagacagacatgagcaggaaggcctttgtgttccccaaggagagtgacaccagctatgtgtccctgaaggcccccctgaccaagcccctgaaggccttcaccgtgtgcctgcacttctacacagagctgagcagcacccggggctacagcatcttctcctatgccaccaagaggcaggacaatgagatcctgatcttctggagcaaggacatcggctacagcttcaccgtgggcggcagcgagatcctgtttgaggtgcctgaggtgacagtggcccctgtgcacatctgcacctcctgggagagcgccagcggcatcgtggagttctgggtggatggcaagccccgggtgaggaagagcctgaagaagggctacacagtgggcgctgaggccagcatcatcctgggccaggagcaggacagctttggaggcaactttgagggcagccagagcctggtgggggacattggaaatgtgaacatgtgggactttgtgctgagcccagatgagatcaacaccatctacctgggcggccccttcagccccaacgtgctgaactggagggccctgaagtatgaggtgcagggcgaggtgttcaccaagccccagctgtggccctag

SEQ ID NO: 148523 - DNA, 309 bp, Artificial Sequence
  Description of Artificial Sequence: Synthetic coding sequence
atggagaagctgctgtgcttcctggtgctgaccagcctgagccacgccttcggccagacagacatgagcaggaaggcctttgtgttccccaaggagagtgacaccagctatgtgtccctgaaggcccccctgaccaagcccctgaaggccttcaccgtgtgcctgcacttctacacagagctgagcagcacccatgagatcaacaccatctacctgggcggccccttcagccccaacgtgctgaactggagggccctgaagtatgaggtgcagggcgaggtgttcaccaagccccagctgtggccctag

SEQ ID NO: 148524 - DNA, 309 bp, Artificial Sequence; identical to SEQ ID NO: 148523
  Description of Artificial Sequence: Synthetic coding sequence

SEQ ID NO: 148525 - DNA, 309 bp, Artificial Sequence; identical to SEQ ID NO: 148523
  Description of Artificial Sequence: Synthetic coding sequence

SEQ ID NO: 148526 - DNA, 276 bp, Artificial Sequence
  Description of Artificial Sequence: Synthetic coding sequence
atggagaagctgctgtgcttcctggtgctgaccagcctgagccacgccttcggccagacagacatgagcaggaaggcctttgtgttccccaaggagagtgacaccagctatgtgtccctgaaggcccccctgaccaagcccctgaaggccttcaccgtgtgcctgcacttctacacagagctgagcagcacccggggccccaacgtgctgaactggagggccctgaagtatgaggtgcagggcgaggtgttcaccaagccccagctgtggccctag

SEQ ID NO: 148527 - DNA, 141 bp, Artificial Sequence
  Description of Artificial Sequence: Synthetic coding sequence
atgtgggactttgtgctgagcccagatgagatcaacaccatctacctgggcggccccttcagccccaacgtgctgaactggagggccctgaagtatgaggtgcagggcgaggtgttcaccaagccccagctgtggccctag

SEQ ID NO: 148528 - DNA, 1146 bp, Artificial Sequence
  Description of Artificial Sequence: Synthetic coding sequence
atgcccttcagcaacagccacaatgccctgaagctgcgcttcccagcagaagatgagttcccagacctgagcgcccacaacaaccacatggccaaggtgctgaccccagagctgtatgcagagctgcgggccaagagcaccccatctggcttcaccctggatgatgtgatccagacaggagtggacaaccctggccacccctacatcatgacagtgggctgtgtggccggagatgaggagagctatgaggtgttcaaggacctgtttgaccccatcatcgaggacagacatggaggctacaagcccagtgatgagcacaagacagacctgaacccagacaacctgcagggcggagatgacctggaccccaactacgtgctgagcagccgggtgaggacaggccgcagcatccggggcttctgcctgcccccccactgcagcagaggagagcggcgggccatcgagaagctggccgtggaggccctgagcagcctggatggagacctggccggccgctactatgccctgaagtccatgacagaggccgagcagcagcagctgattgatgaccacttcctgtttgacaagcctgtgagccccctgctgctggccagcggcatggcccgggactggccagatgcccggggcatctggcacaatgacaacaagaccttcctggtgtgggtgaatgaggaggaccacctgcgggtcatctccatgcagaagggcggcaacatgaaggaggtgttcacccgcttctgcaccggcctgacccagatcgagaccctcttcaagagcaaggactatgagttcatgtggaacccccacctgggctacatcctgacctgccccagcaacctgggcaccggcctgcgggccggcgtgcacatcaagctgcccaacctgggcaagcatgagaagttcagcgaggtgctgaagaggctgcggctgcagaagaggggcaccggcggcgtggacacagctgctgtgggcggcgtgtttgatgtgtccaatgctgaccggctgggcttcagcgaggtggagctggtgcagatggtggtggatggagtgaagctgctgattgagatggagcagaggctggagcagggccaggccattgatgacctgatgcctgcccagaagtag

SEQ ID NO: 148529 - DNA, 1041 bp, Artificial Sequence
  Description of Artificial Sequence: Synthetic coding sequence
atgcccttcagcaacagccacaatgccctgaagctgcgcttcccagcagaagatgagttcccagacctgagcgcccacaacaaccacatggccaaggtgctgaccccagagctgtatgcagagctgcgggccaagagcaccccatctggcttcaccctggatgatgtgatccagacaggagtggacaaccctggccacccctacatcatgacagtgggctgtgtggccggagatgaggagagctatgaggtgttcaaggacctgtttgaccccatcatcgaggacagacatggaggctacaagcccagtgatgagcacaagacagacctgaacccccccaggggggcccccagaattgagaagctggccgtggaggccctgagcagcctggatggagacctggccggccgctactatgccctgaagtccatgacagaagctgagcagcagcagctgattgatgaccacttcctgtttgacaagcctgtgagccccctgctgctggccagcggcatggcccgggactggccagatgcccggggcatctggcacaatgacaacaagaccttcctggtgtgggtgaatgaggaggaccacctgcgggtcatctccatgcagaagggcggcaacatgaaggaggtgttcacccgcttctgcaccggcctgacccagatcgagaccctcttcaagagcaaggactatgagttcatgtggaacccccacctgggctacatcctgacctgccccagcaacctgggcaccggcctgcgggccggcgtgcacatcaagctgcccaacctgggcaagcatgagaagttcagcgaggtgctgaagaggctgcggctgcagaagaggggcactggaggagtggacacagctgctgtgggcggcgtgtttgatgtgtccaatgctgaccggctgggcttcagcgaggtggagctggtgcagatggtggtggatggagtgaagctgctgattgagatggagcagaggctggagcagggccaggccattgatgacctgatgcctgcccagaagtag

SEQ ID NO: 148530 - DNA, 654 bp, Artificial Sequence
  Description of Artificial Sequence: Synthetic coding sequence
atgcccttcagcaacagccacaatgccctgaagctgcgcttcccagcagaagatgagttcccagacctgagcgcccacaacaaccacatggccaaggtgctgaccccagagctgtatgcagagctgcgggccaagagcaccccatctggcttcaccctggatgatgtgatccagacaggagtggacaaccctggccacccctacatcatgacagtgggctgtgtggccggagatgaggagagctatgaggtgttcaaggacctgtttgaccccatcatcgaggacagacatggaggctacaagcccagtgatgagcacaagacagacctgaacccagacaacctgcagggcggagatgacctggaccccaactacgtgctgagcagccgggtgaggacaggccgcagcatccggggcttctgcctgcccccccactgcagcagaggagagcggcgggccatcgagaagctggccgtggaggccctgagcagcctggatggagacctggccggccgctactatgccctgaagtccatgacagaggccgagcagcagcagctgattgatgaccacttcctgtttgacaagcctgtgagccccctgctgctggccagcggcatggcccgggactggccagatgcccggggcatctag

SEQ ID NO: 148531 - DNA, 447 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgaccccgtcatccaggagcggcacaacggctatgaccccaggaccatgaagcacaccacagacctggatgccagcaagtag

SEQ ID NO: 148532 - DNA, 1254 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgaccccgtcatccaggagcggcacaacggctatgaccccaggaccatgaagcacaccacagacctggatgccagcaagatccgcagcggctactttgatgagcgctacgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaagctgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtggagcggctcatccaggagcggggctgggagttcatgtggaatgaaaggctgggctacatcctgacctgccccagcaacctgggcaccggcctgcgggccggcgtgcacatcaagctgcccctgctgagcaaggacagccgcttccccaagatcctggagaacctgcggctgcagaagaggggcactggaggagtggacacagctgccactggaggagtgtttgacatcagcaacctggaccggctgggcaagtctgaggtggagctggtgcagctggtgattgatggagtgaactacctgattgactgtgagcggcggctggagcggggccaggacatccgcatccccacccctgtgatccacaccaagcactag

SEQ ID NO: 148533 - DNA, 1347 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagccagacctggcccaccggccagctgcccggcaactgcaccaggagccggcggctgtgcccccccagcatggtgacaggctaccccctgcccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgatcctgtgatccaggagcggcacaacggctatgaccccaggaccatgaagcacaccacagacctggatgccagcaagatccgcagcggctactttgatgaaagatatgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaggccgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtggagcggctcatccaggagcggggctgggagttcatgtggaatgaaaggctgggctacatcctgacctgccccagcaacctgggcaccggcctgcgggccggcgtgcacatcaagctgcccctgctgagcaaggacagccgcttccccaagatcctggagaacctgcggctgcagaagaggggcaccggcggcgtggacacagctgccaccggcggcgtgtttgacatcagcaacctggaccggctgggcaagtctgaggtggagctggtgcagctggtgattgatggagtgaactacctgattgactgtgaaagaaggctggagcggggccaggacatccgcatccccacccctgtgatccacaccaagcactag

SEQ ID NO: 148534 - DNA, 1254 bp, Artificial Sequence; identical to SEQ ID NO: 148532
  Description of Artificial Sequence: Synthetic coding sequence

SEQ ID NO: 148535 - DNA, 765 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgaccccgtcatccggggcctgagcctgcccccagcctgcaccagggctgagcggcgggaggtggagcgggtggtggtggatgccctgagcggcctgaagggggacctggccggccgctactaccgcctgtctgagatgacagaagctgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtggtggtgggcatcaagtag

SEQ ID NO: 148536 - DNA, 1254 bp, Artificial Sequence; identical to SEQ ID NO: 148532
  Description of Artificial Sequence: Synthetic coding sequence

SEQ ID NO: 148537 - DNA, 441 bp, Artificial Sequence
  Description of Artificial Sequence: Synthetic coding sequence
atgcctgtgaaggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaggccgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtgcgggaggactgtgtgggggagctgggcggccgcacctag

SEQ ID NO: 148538 - DNA, 507 bp, Artificial Sequence
  Description of Artificial Sequence: Synthetic coding sequence
atgaagcacaccacagacctggatgccagcaagatccgcagcggctactttgatgaaagatatgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaggccgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtgcgggaggactatgtgggggagctgggcggccgcacctag

SEQ ID NO: 148539 - DNA, 312 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagtag

SEQ ID NO: 148540 - DNA, 390 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgaccccgtcatccaggagaggtag

SEQ ID NO: 148541 - DNA, 1017 bp, Artificial Sequence
  Description of Artificial Sequence: Synthetic coding sequence
atggccggccccttcagccggctgctgagcgcccggcccggcctgcggctgctggccctggccggggccggcagcctggccgccggcttctgcagcgacaggaacctgtatgagctgcctgtgaatgatggcggctgcatcccccgggagcagagccagacctggcccaccggccagctgcccggcaactgcaccaggagccggcggctgtgcccccccagcatggtgacaggctaccccctgcccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgatcctgtgatccaggagcggcacaacggctatgaccccaggaccatgaagcacaccacagacctggatgccagcaagatccgcagcggctactttgatgaaagatatgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaggccgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtgcgggaggactatgtgggggagctgggcggccgcacctag

SEQ ID NO: 148542 - DNA, 1254 bp, Artificial Sequence; identical to SEQ ID NO: 148532
  Description of Artificial Sequence: Synthetic coding sequence

SEQ ID NO: 148543 - DNA, 774 bp, Artificial Sequence
  Description of Artificial Sequence: Synthetic coding sequence
atggtgacaggctaccccctgcccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgatcctgtgatccaggagcggcacaacggctatgaccccaggaccatgaagcacaccacagacctggatgccagcaagatccgcagcggctactttgatgaaagatatgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaggccgagcagcagcagctgattgatgaccacttcctgtttgacaagcctgtgagccccctgctgacagctgctggcatggcccgggactggccagatgcccggggcatctggcacaacaatgagaagagcttcctgatctgggtgaatgaggaggaccacaccagggtcatctccatggagaagggcggcaacatgaagagggtgtttgagcgcttctgccggggcctgaaggaggtggtggtgggcatcaagtag

SEQ ID NO: 148544 - DNA, 726 bp, Artificial Sequence
  Description of Artificial Sequence: Synthetic coding sequence
atggccggccccttcagccggctgctgagcgcccggcccggcctgcggctgctggccctggccggggccggcagcctggccgccggcttcctgctgcggcctgagcctgtgcgggccgccagcgagcggcggcggctgtacccacccagcgctgagtacccagacctgaggaagcacaacaactgcatggccagccacctgaccccagctgtgtatgcccggctgtgtgacaagaccacccccaccggctggaccctggaccagtgcatccagacaggagtggacaaccctggccaccccttcatcaagacagtgggcatggtggccggagatgaggagacctatgaggtgtttgctgacctgtttgaccccgtcatccaggagcggcacaacggctatgaccccaggaccatgaagcacaccacagacctggatgccagcaagatccgcagcggctactttgatgagcgctacgtgctgagcagccgggtgaggacaggccgcagcatccggggcctgagcctgcccccagcctgcaccagggctgagcggcgggaggtggagcgggtggtggtggatgccctgagcggcctgaagggggacctggccggccgctactaccgcctgtctgagatgacagaagctgagcagcagcagctgattgatgaccacttcctgtttgacaagcctgtgagccccctgctgacagctgctggcatggcctag

SEQ ID NO: 148545 - DNA, 1260 bp, Artificial Sequence
  Description of Artificial Sequence: Synthetic coding sequence
atggccagcatcttcagcaagctgctgaccggcagaaatgccagcctgctgtttgccaccatgggcacctctgtgctgaccaccggctacctgctgaaccggcagaaggtgtgtgccgaggtgcgggagcagcccaggctcttccccccatctgctgactacccagacctgaggaagcacaacaactgcatggccgagtgcctgaccccagccatctatgccaagctgaggaacaaggtgaccccaaatggctacaccctggaccagtgcatccagacaggagtggacaaccctggccaccccttcatcaagacagtgggcatggtggccggagatgaggagagctatgaggtgtttgctgacctgtttgatcctgtgatcaagctgcggcacaacggctatgacccccgggtgatgaagcacaccacagacctggatgccagcaagatcacccagggccagtttgatgagcactacgtgctgagcagccgggtgaggacaggccgcagcatccggggcctgagcctgcccccagcctgcaccagggctgagcggcgggaggtggagaatgtggccatcacagccctggagggcctgaagggggacctggccggccgctactacaagctgtctgagatgacagagcaggaccagcagaggctgattgatgaccacttcctgtttgacaagcctgtgagccccctgctgacctgtgccggcatggcccgggactggccagatgcccggggcatctggcacaactatgacaagaccttcctgatctggatcaatgaggaggaccacaccagggtcatctccatggagaagggcggcaacatgaagagggtgtttgagcgcttctgccggggcctgaaggaggtggagcggctcatccaggagcggggctgggagttcatgtggaatgaaaggctgggctacatcctgacctgccccagcaacctgggcaccggcctgcgggccggcgtgcacgtgcgcatccccaagctgagcaaggacccccgcttcagcaagatcctggagaacctgcggctgcagaagaggggcaccggcggcgtggacacagctgctgtggctgatgtgtatgacatcagcaacatcgaccgcatcggccgctctgaggtggagctggtgcagatcgtgattgatggagtgaactacctggtggactgtgagaagaagctggagcggggccaggacatcaaggtgcccccacccctgccccagtttgggaagaagtag

SEQ ID NO: 148546 - DNA, 1260 bp, Artificial Sequence; identical to SEQ ID NO: 148545
  Description of Artificial Sequence: Synthetic coding sequence

SEQ ID NO: 148547 - DNA, 1260 bp, Artificial Sequence; identical to SEQ ID NO: 148545
  Description of Artificial Sequence: Synthetic coding sequence

SEQ ID NO: 148548 - DNA, 513 bp, Artificial Sequence
  Description of Artificial Sequence: Synthetic coding sequence
atggccagcatcttcagcaagctgctgaccggcagaaatgccagcctgctgtttgccaccatgggcacctctgtgctgaccaccggctacctgctgaaccggcagaaggtgtgtgccgaggtgcgggagcagcccaggctcttccccccatctgctgactacccagacctgaggaagcacaacaactgcatggccgagtgcctgaccccagccatctatgccaagctgaggaacaaggtgaccccaaatggctacaccctggaccagtgcatccagacaggagtggacaaccctggccaccccttcatcaagacagtgggcatggtggccggagatgaggagagctatgaggtgtttgctgacctgtttgatcctgtgatcaagctgcggcacaacggctatgacccccgggtgatgaagcacaccacagacctggatgccagcaagatcacccagggccagtttgatgagcactacgtgctgagcagccgggtgaggacaggccgctcctag

SEQ ID NO: 148549 - DNA, 1098 bp, Artificial Sequence
  Description of Artificial Sequence: Synthetic coding sequence
atgggcgtgccccggccccagccctgggccctgggcctgctgctcttcctgctgcccggcagcctgggcgctgagagccacctgagcctgctgtaccacctgacagctgtgagcagccctgcccctggcaccccagccttctgggtgtctggctggctgggcccccagcagtacctgagctacaacagcctgcggggggaggccgagccctgtggggcctgggtgtgggagaaccaggtgtcctggtactgggagaaggagaccacagacctgcgcatcaaggagaagctgttcctggaggccttcaaggccctgggcggcaagggcccctacaccctgcagggcctgctgggctgtgagctgggccctgacaacacctctgtgcccacagccaagtttgccctgaatggagaggagttcatgaactttgacctgaagcagggcacctggggcggggactggccagaggccctggccatcagccagcgctggcagcagcaggacaaggccgccaacaaggagctgaccttcctgctcttcagctgcccccaccggctgcgggagcacctggagcggggccggggcaacctggagtggaaggagccccccagcatgaggctgaaggcccggcccagcagccctggcttctctgtgctgacctgcagcgccttctccttctacccacctgagctgcagctgcgcttcctgagaaatggcctggccgccggcaccggccagggcgactttggccccaacagtgatggcagcttccacgccagcagcagcctgactgtgaagtctggagatgagcaccactactgctgcatcgtgcagcacgccggcctggcccagcccctgcgggtggagctggagagccctgccaagagctctgtgctggtggtgggcatcgtgattggagtgctgctgctgacagctgctgctgtgggcggggccctgctgtggaggaggatgaggagcggcctgcctgccccctggatcagcctgcggggagatgacaccggggtgctgctgcccaccccaggagaggcccaggatgctgacctgaaggatgtgaatgtcatcccagccacagcctag

SEQ ID NO: 148550 - DNA, 7329 bp, Artificial Sequence
  Description of Artificial Sequence: Synthetic coding sequence
atggccgagaacctgctggatggcccccccaaccccaagagggccaagctgagcagccctggcttcagcgccaatgacagcacagactttggcagcctgtttgacctggagaatgacctgcctgatgagctgatccccaatggaggagagctgggcctgctgaacagcggcaacctggtgcctgatgctgccagcaagcacaagcagctgtctgagctgctgcggggcggcagcggcagcagcatcaaccctggcattggaaatgtgtctgccagcagccctgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccaccccagctgccagccaggccctgaacccccaggcccagaagcaggtgggcctggccaccagcagccctgccaccagccagacaggccctggcatctgcatgaatgccaacttcaaccagacccaccctggcctgctgaacagcaacagcggccacagcctcatcaaccaggccagccagggccaggcccaggtgatgaatggcagcctgggcgccgccggccggggccgcggggccggcatgccctaccccaccccagccatgcagggcgccagcagctctgtgctggccgagaccctgacccaggtgagcccccagatgactggacatgctggcctgaacacagcccaggccggcggcatggccaagatgggcatcaccggcaacaccagccccttcggccagcccttcagccaggccggcggccagcccatgggcgccactggagtgaacccccagctggccagcaagcagagcatggtgaacagcctgcccaccttccccacagacatcaagaacacctctgtgaccaacgtgcccaacatgagccagatgcagacctctgtgggcatcgtgcccacccaggccatcgccaccggccccacagctgaccctgagaagaggaagctgatccagcagcagctggtgctgctgctgcacgcccacaagtgccagaggcgggagcaggccaacggggaggtgcgggcctgcagcctgccccactgcaggaccatgaagaatgtgctgaaccacatgacccactgccaggccggcaaggcctgccaggtggcccactgtgccagcagccggcagatcatcagccactggaagaactgcaccaggcatgactgccctgtgtgcctgcccctgaagaatgccagtgacaagaggaaccagcagaccatcctgggcagccctgccagcggcatccagaacaccatcggctctgtgggcaccggccagcagaatgccaccagcctgagcaaccccaaccccatcgaccccagctccatgcagagggcctatgctgccctgggcctgccctacatgaaccagccccagacccagctgcagccccaggtgcccggccagcagcctgcccagccccagacccaccagcagatgaggaccctgaaccccctgggcaacaaccccatgaacatcccagctgggggcatcaccacagaccagcagccccccaacctgatcagcgagagcgccctgcccaccagcctgggcgccaccaaccccctgatgaatgatggcagcaacagcggcaacatcggcaccctgagcaccatccccacagctgccccacccagcagcactggagtgaggaagggctggcatgaacatgtgacccaggacctgcggagccacctggtgcacaagctggtgcaggccatcttccccaccccagaccctgctgccctgaaggacaggaggatggagaacctggtggcctatgccaagaaggtggagggggacatgtatgaaagtgccaacagcagagatgagtactaccacctgctggccgagaagatctacaagatccagaaggagctggaggagaagagaagaagccggctgcacaagcagggcatcctgggcaaccagcctgccctgcctgcccctggggcccagccccctgtgatcccccaggcccagcctgtgcggcccccaaatggccccctgagcctgcctgtgaacaggatgcaggtgtcccagggcatgaacagcttcaaccccatgagcctgggcaatgtgcagctgccccaggcccccatgggccccagggctgccagccccatgaaccacagcgtgcagatgaacagcatgggctctgtgcccggcatggccatcagccccagcaggatgccccagccccccaacatgatgggcgcccacaccaacaacatgatggcccaggccccagcccagagccagttcctgccccagaaccagttccccagcagcagcggggccatgtctgtgggcatgggccagcccccagcccagacaggagtgtcccagggccaggtgcctggagctgccctgcccaaccccctgaacatgctgggcccccaggccagccagctgccctgcccccctgtgacccagagccccctgcaccccaccccacctccagccagcacagctgctggcatgcccagcctgcagcacaccaccccacctggcatgaccccaccccagcctgctgcccccacccagcccagcacccctgtgagcagcagcggccagacccccacccccaccccaggctctgtgcccagcgccacccagacccagagcacccccaccgtgcaggccgccgcccaggcccaggtgaccccccagccccagacccctgtgcagccccccagcgtggccaccccccagagcagccagcagcagcccacccctgtgcacgcccagcccccaggcacccccctgagccaggccgccgccagcattgacaacagagtgcccacccccagctctgtggccagcgctgagaccaacagccagcagcccggcccagatgtgcctgtgctggagatgaagacagagacccaggccgaggacacagagccagaccccggggagagcaagggggagcccaggtctgagatgatggaggaggacctgcagggcgccagccaggtgaaggaggagacagacattgctgagcagaagtctgagcccatggaggtggatgagaagaagccagaggtgaaggtggaggtgaaggaggaggaggagagcagcagcaatggaacagccagccagagcaccagccccagccagcccaggaagaagatcttcaagccagaggagctgcggcaggccctgatgcccaccctggaggccctgtaccggcaggaccctgagagcctgcccttccggcagcctgtggacccccagctgctgggcatcccagactactttgacatcgtgaagaaccccatggacctgagcaccatcaagaggaagctggacaccggccagtaccaggagccctggcagtatgtggatgatgtgtggctgatgttcaacaatgcctggctgtacaacaggaagaccagccgggtgtacaagttctgcagcaagctggccgaggtgtttgagcaggagattgatcctgtgatgcagagcctgggctactgctgcggcaggaaatatgagttcagcccccagaccctgtgctgctacggcaagcagctgtgcaccatccccagagatgctgcctactacagctaccagaaccgctaccacttctgtgagaagtgcttcacagagatccagggagaaaatgtgaccctgggagatgaccccagccagccccagaccaccatcagcaaggaccagtttgagaagaagaagaatgacaccctggaccctgagccctttgtggactgcaaggaatgtggcaggaagatgcaccagatctgtgtgctgcactatgacatcatctggcccagcggctttgtgtgtgacaactgcctgaagaagacaggccggcccaggaaagaaaacaagttcagcgccaagaggctgcagaccacccggctgggcaaccacctggaggacagagtgaacaagttcctgcggcggcagaaccaccctgaggccggggaggtgtttgtgcgggtggtggccagcagtgacaagacagtggaggtgaagccaggcatgaagagcagatttgtggacagcggggagatgtctgagagcttcccctaccgcaccaaggccctgtttgcctttgaggagattgatggagtggatgtgtgcttcttcggcatgcacgtgcaggagtatggcagtgactgccccccacccaacaccaggagagtgtacatctcctacctggacagcatccacttcttccggccccgctgcctgaggacagctgtgtaccacgagatcctgattggctacctggagtatgtgaagaagctgggctacgtgacaggccacatctgggcctgccccccatctgaaggagatgactacatcttccactgccaccccccagaccagaagatccccaagcccaagaggctgcaggagtggtacaagaagatgctggacaaggcctttgctgagcgcatcatccatgactacaaggacatcttcaagcaggccacagaggaccggctgaccagcgccaaggagctgccctactttgaaggagacttctggcccaacgtgctggaggagagcatcaaggagctggagcaggaggaggaggagaggaagaaggaggagagcacagctgccagcgagaccacagagggcagccagggcgacagcaagaatgccaagaagaagaacaacaagaagaccaacaagaacaagagcagcatcagccgggccaacaagaagaagcccagcatgcccaacgtgtccaatgacctgagccagaagctgtatgccaccatggagaagcacaaggaggtgttctttgtgatccacctgcatgctggccctgtgatcaacaccctgccccccatcgtggaccctgaccccctgctgagctgtgacctgatggatggaagagatgccttcctgaccctggcccgggacaagcactgggagttcagcagcctgcggcgcagcaagtggagcaccctgtgcatgctggtggagctgcacacccagggccaggacagatttgtgtacacctgcaatgaatgcaagcaccacgtggagacccgctggcactgcaccgtgtgtgaggactatgacctgtgcatcaactgctacaacaccaagagccacgcccacaagatggtgaagtggggcctgggcctggatgatgagggcagcagccagggcgagccccagagcaagagcccccaggagagccggcggctgagcatccagcgctgcatccagagcctggtgcacgcctgccagtgcagaaatgccaactgcagcctgcccagctgccagaagatgaagagggtggtgcagcacaccaagggctgcaagaggaagaccaatggaggctgccctgtgtgcaagcagctgattgccctgtgctgctaccacgccaagcactgccaggagaacaagtgccctgtgcccttctgcctgaacatcaagcacaagctgcggcagcagcagatccagcaccggctgcagcaggcccagctgatgagaagaaggatggccaccatgaacaccagaaatgtgccccagcagagcctgcccagccccaccagcgcccctcctggcacccccacccagcagcccagcaccccccagaccccccagcccccagcccagccccagcccagccctgtgtccatgagccctgctggcttccccagcgtggcccggacccagccccccaccaccgtgtccacaggcaagcccaccagccaggtgcctgcccctcctcctccagcccagcccccacctgctgctgtggaggccgcccggcagatcgagcgggaggcccagcagcagcagcacctgtacagagtgaacatcaacaacagcatgcctcctggccgcacaggcatgggcaccccaggcagccagatggcccctgtgtccctgaatgtgccccggcccaaccaggtgtctggccctgtgatgcccagcatgcctcctggccagtggcagcaggcccccctgccccagcagcagcccatgcctggcctgcccaggcctgtgatctccatgcaggcccaggccgctgtggccggccccaggatgcccagcgtgcagccccccaggagcatcagccccagcgccctgcaggacctgctgcggaccctgaagagccccagcagcccccagcagcagcagcaggtgctgaacatcctgaagagcaacccccagctgatggccgccttcatcaagcagaggacagccaagtatgtggccaaccagcccggcatgcagccccagcccggcctgcagagccagcccggcatgcagccccagcccggcatgcaccagcagcccagcctgcagaacctgaatgccatgcaggccggcgtgcccaggcctggggtgcccccccagcagcaggccatgggcggcctgaacccccagggccaggccctgaacatcatgaaccctggccacaaccccaacatggcctccatgaacccccagtaccgggagatgctgcggcggcagctgctgcagcagcagcagcagcagcagcagcagcagcagcagcagcagcagcagcagcagggcagcgctggcatggccggcggcatggccggccacggccagttccagcagccccagggccctgggggctaccccccagccatgcagcagcagcagaggatgcagcagcacctgcccctgcagggcagctccatgggccagatggccgcccagatgggccagctgggccagatgggccagcccggcctgggcgctgacagcacccccaacatccagcaggccctgcagcagaggatcctgcagcagcagcagatgaagcagcagatcggcagccctggccagcccaaccccatgagcccccagcagcacatgctgagcggccagccccaggccagccacctgcccggccagcagatcgccaccagcctgagcaaccaggtgcgcagccctgcccctgtgcagagcccccggccccagagccagcccccccacagcagccccagcccccgcatccagccccagcccagcccccaccacgtgagcccccagacaggcagcccccaccctggcctggccgtgaccatggccagcagcattgaccagggccacctgggcaaccctgagcagagcgccatgctgccccagctgaacacccccagccgcagcgccctgagcagcgagctgagcctggtgggggacaccactggagacaccctggagaagtttgtggagggcctgtag

SEQ ID NO: 148551 - DNA, 2934 bp, Artificial Sequence
  Description of Artificial Sequence: Synthetic coding sequence
atgcacgtgcaggagtatggcagtgactgccccccacccaacacccggcgggtgtacatctcctacctggacagcatccacttcttccggccccgctgcctgaggacagctgtgtaccacgagatcctgattggctacctggagtatgtgaagaagctgggctacgtgacaggccacatctgggcctgccccccatctgaaggagatgactacatcttccactgccaccccccagaccagaagatccccaagcccaagaggctgcaggagtggtacaagaagatgctggacaaggcctttgctgagcgcatcatccatgactacaaggacatcttcaagcaggccacagaagatcggctgaccagcgccaaggagctgccctactttgaaggagacttctggcccaacgtgctggaggagagcatcaaggagctggagcaggaggaggaggagaggaagaaggaggagagcacagctgccagcgagaccacagaggtgttcttcgtcatccacctgcacgccggccctgtgatcaacaccctgccccccatcgtggaccctgaccccctgctgagctgtgacctgatggatggaagagatgccttcctgaccctggcccgggacaagcactgggagttcagcagcctgcggcgcagcaagtggagcaccctgtgcatgctggtggagctgcacacccagggccaggacagatttgtgtacacctgcaatgaatgcaagcaccacgtggagacccgctggcactgcaccgtgtgtgaagattatgacctgtgcatcaactgctacaacaccaagagccacgcccacaagatggtgaagtggggcctgggcctggatgatgagggcagcagccagggcgagccccagagcaagagcccccaggagagccggcggctgagcatccagcgctgcatccagagcctggtgcacgcctgccagtgcagaaatgccaactgcagcctgcccagctgccagaagatgaagagggtggtgcagcacaccaagggctgcaagaggaagaccaacggcggctgccctgtgtgcaagcagctgattgccctgtgctgctaccacgccaagcactgccaggagaacaagtgccctgtgcccttctgcctgaacatcaagcacaagctgcggcagcagcagatccagcaccggctgcagcaggcccagctgatgagaagaaggatggccaccatgaacaccagaaatgtgccccagcagagcctgcccagccccaccagcgcccctcctggcacccccacccagcagcccagcaccccccagaccccccagcccccagcccagccccagcccagccctgtgtccatgagccctgctggcttccccagcgtggcccggacccagccccccaccaccgtgtccacaggcaagcccaccagccaggtgcctgcccctcctcctccagcccagcccccacctgctgctgtggaggccgcccggcagatcgagcgggaggcccagcagcagcagcacctgtacagagtgaacatcaacaacagcatgcctcctggccgcacaggcatgggcaccccaggcagccagatggcccctgtgtccctgaatgtgccccggcccaaccaggtgtctggccctgtgatgcccagcatgcctcctggccagtggcagcaggcccccctgccccagcagcagcccatgcctggcctgcccaggcctgtgatctccatgcaggcccaggccgctgtggccggccccaggatgcccagcgtgcagcccccaagaagcatcagccccagcgccctgcaggacctgctgcggaccctgaagagccccagcagcccccagcagcagcagcaggtgctgaacatcctgaagagcaacccccagctgatggccgccttcatcaagcagaggacagccaagtatgtggccaaccagcccggcatgcagccccagcccggcctgcagagccagcccggcatgcagccccagcccggcatgcaccagcagcccagcctgcagaacctgaatgccatgcaggccggcgtgcccaggcctggggtgcccccccagcagcaggccatgggcggcctgaacccccagggccaggccctgaacatcatgaaccctggccacaaccccaacatggcctccatgaacccccagtaccgggagatgctgcggcggcagctgctgcagcagcagcagcagcagcagcagcagcagcagcagcagcagcagcagcagcagggcagcgctggcatggccggcggcatggccggccacggccagttccagcagccccagggccctgggggctaccccccagccatgcagcagcagcagaggatgcagcagcacctgcccctgcagggcagctccatgggccagatggccgcccagatgggccagctgggccagatgggccagcccggcctgggcgctgacagcacccccaacatccagcaggccctgcagcagaggatcctgcagcagcagcagatgaagcagcagatcggcagccctggccagcccaaccccatgagcccccagcagcacatgctgagcggccagccccaggccagccacctgcccggccagcagatcgccaccagcctgagcaaccaggtgcgcagccctgcccctgtgcagagcccccggccccagagccagcccccccacagcagccccagcccccgcatccagccccagcccagcccccaccacgtgagcccccagacaggcagcccccaccctggcctggccgtgaccatggccagcagcattgaccagggccacctgggcaaccctgagcagagcgccatgctgccccagctgaacacccccagccgcagcgccctgagcagcgagctgagcctggtgggggacaccaccggggacaccctggagaagtttgtggagggcctgtag

SEQ ID NO: 148552 - DNA, 7215 bp, Artificial Sequence
  Description of Artificial Sequence: Synthetic coding sequence
atggccgagaacctgctggatggcccccccaaccccaagagggccaagctgagcagccctggcttcagcgccaatgacagcacagactttggcagcctgtttgacctggagaatgacctgcctgatgagctgatccccaatggaggagagctgggcctgctgaacagcggcaacctggtgcctgatgctgccagcaagcacaagcagctgtctgagctgctgcggggcggcagcggcagcagcatcaaccctggcattggaaatgtgtctgccagcagccctgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccaccccagctgccagccaggccctgaacccccaggcccagaagcaggtgggcctggccaccagcagccctgccaccagccagacaggccctggcatctgcatgaatgccaacttcaaccagacccaccctggcctgctgaacagcaacagcggccacagcctcatcaaccaggccagccagggccaggcccaggtgatgaatggcagcctgggcgccgccggccggggccgcggggccggcatgccctaccccaccccagccatgcagggcgccagcagctctgtgctggccgagaccctgacccaggtgagcccccagatgactggacatgctggcctgaacacagcccaggccggcggcatggccaagatgggcatcaccggcaacaccagccccttcggccagcccttcagccaggccggcggccagcccatgggcgccactggagtgaacccccagctggccagcaagcagagcatggtgaacagcctgcccaccttccccacagacatcaagaacacctctgtgaccaacgtgcccaacatgagccagatgcagacctctgtgggcatcgtgcccacccaggccatcgccaccggccccacagctgaccctgagaagaggaagctgatccagcagcagctggtgctgctgctgcacgcccacaagtgccagaggcgggagcaggccaacggggaggtgcgggcctgcagcctgccccactgcaggaccatgaagaatgtgctgaaccacatgacccactgccaggccggcaaggcctgccaggccatcctgggcagccctgccagcggcatccagaacaccatcggctctgtgggcaccggccagcagaatgccaccagcctgagcaaccccaaccccatcgaccccagctccatgcagagggcctatgctgccctgggcctgccctacatgaaccagccccagacccagctgcagccccaggtgcccggccagcagcctgcccagccccagacccaccagcagatgaggaccctgaaccccctgggcaacaaccccatgaacatcccagctgggggcatcaccacagaccagcagccccccaacctgatcagcgagagcgccctgcccaccagcctgggcgccaccaaccccctgatgaatgatggcagcaacagcggcaacatcggcaccctgagcaccatccccacagctgccccacccagcagcactggagtgaggaagggctggcatgaacatgtgacccaggacctgcggagccacctggtgcacaagctggtgcaggccatcttccccaccccagaccctgctgccctgaaggacaggaggatggagaacctggtggcctatgccaagaaggtggagggggacatgtatgaaagtgccaacagcagagatgagtactaccacctgctggccgagaagatctacaagatccagaaggagctggaggagaagagaagaagccggctgcacaagcagggcatcctgggcaaccagcctgccctgcctgcccctggggcccagccccctgtgatcccccaggcccagcctgtgcggcccccaaatggccccctgagcctgcctgtgaacaggatgcaggtgtcccagggcatgaacagcttcaaccccatgagcctgggcaatgtgcagctgccccaggcccccatgggccccagggctgccagccccatgaaccacagcgtgcagatgaacagcatgggctctgtgcccggcatggccatcagccccagcaggatgccccagccccccaacatgatgggcgcccacaccaacaacatgatggcccaggccccagcccagagccagttcctgccccagaaccagttccccagcagcagcggggccatgtctgtgggcatgggccagcccccagcccagacaggagtgtcccagggccaggtgcctggagctgccctgcccaaccccctgaacatgctgggcccccaggccagccagctgccctgcccccctgtgacccagagccccctgcaccccaccccacctccagccagcacagctgctggcatgcccagcctgcagcacaccaccccacctggcatgaccccaccccagcctgctgcccccacccagcccagcacccctgtgagcagcagcggccagacccccacccccaccccaggctctgtgcccagcgccacccagacccagagcacccccaccgtgcaggccgccgcccaggcccaggtgaccccccagccccagacccctgtgcagccccccagcgtggccaccccccagagcagccagcagcagcccacccctgtgcacgcccagcccccaggcacccccctgagccaggccgccgccagcattgacaacagagtgcccacccccagctctgtggccagcgctgagaccaacagccagcagcccggcccagatgtgcctgtgctggagatgaagacagagacccaggccgaggacacagagccagaccccggggagagcaagggggagcccaggtctgagatgatggaggaggacctgcagggcgccagccaggtgaaggaggagacagacattgctgagcagaagtctgagcccatggaggtggatgagaagaagccagaggtgaaggtggaggtgaaggaggaggaggagagcagcagcaatggaacagccagccagagcaccagccccagccagcccaggaagaagatcttcaagccagaggagctgcggcaggccctgatgcccaccctggaggccctgtaccggcaggaccctgagagcctgcccttccggcagcctgtggacccccagctgctgggcatcccagactactttgacatcgtgaagaaccccatggacctgagcaccatcaagaggaagctggacaccggccagtaccaggagccctggcagtatgtggatgatgtgtggctgatgttcaacaatgcctggctgtacaacaggaagaccagccgggtgtacaagttctgcagcaagctggccgaggtgtttgagcaggagattgatcctgtgatgcagagcctgggctactgctgcggcaggaaatatgagttcagcccccagaccctgtgctgctacggcaagcagctgtgcaccatccccagagatgctgcctactacagctaccagaaccgctaccacttctgtgagaagtgcttcacagagatccagggagaaaatgtgaccctgggagatgaccccagccagccccagaccaccatcagcaaggaccagtttgagaagaagaagaatgacaccctggaccctgagccctttgtggactgcaaggaatgtggcaggaagatgcaccagatctgtgtgctgcactatgacatcatctggcccagcggctttgtgtgtgacaactgcctgaagaagacaggccggcccaggaaagaaaacaagttcagcgccaagaggctgcagaccacccggctgggcaaccacctggaggacagagtgaacaagttcctgcggcggcagaaccaccctgaggccggggaggtgtttgtgcgggtggtggccagcagtgacaagacagtggaggtgaagccaggcatgaagagcagatttgtggacagcggggagatgtctgagagcttcccctaccgcaccaaggccctgtttgcctttgaggagattgatggagtggatgtgtgcttcttcggcatgcacgtgcaggagtatggcagtgactgccccccacccaacaccaggagagtgtacatctcctacctggacagcatccacttcttccggccccgctgcctgaggacagctgtgtaccacgagatcctgattggctacctggagtatgtgaagaagctgggctacgtgacaggccacatctgggcctgccccccatctgaaggagatgactacatcttccactgccaccccccagaccagaagatccccaagcccaagaggctgcaggagtggtacaagaagatgctggacaaggcctttgctgagcgcatcatccatgactacaaggacatcttcaagcaggccacagaggaccggctgaccagcgccaaggagctgccctactttgaaggagacttctggcccaacgtgctggaggagagcatcaaggagctggagcaggaggaggaggagaggaagaaggaggagagcacagctgccagcgagaccacagagggcagccagggcgacagcaagaatgccaagaagaagaacaacaagaagaccaacaagaacaagagcagcatcagccgggccaacaagaagaagcccagcatgcccaacgtgtccaatgacctgagccagaagctgtatgccaccatggagaagcacaaggaggtgttctttgtgatccacctgcatgctggccctgtgatcaacaccctgccccccatcgtggaccctgaccccctgctgagctgtgacctgatggatggaagagatgccttcctgaccctggcccgggacaagcactgggagttcagcagcctgcggcgcagcaagtggagcaccctgtgcatgctggtggagctgcacacccagggccaggacagatttgtgtacacctgcaatgaatgcaagcaccacgtggagacccgctggcactgcaccgtgtgtgaggactatgacctgtgcatcaactgctacaacaccaagagccacgcccacaagatggtgaagtggggcctgggcctggatgatgagggcagcagccagggcgagccccagagcaagagcccccaggagagccggcggctgagcatccagcgctgcatccagagcctggtgcacgcctgccagtgcagaaatgccaactgcagcctgcccagctgccagaagatgaagagggtggtgcagcacaccaagggctgcaagaggaagaccaatggaggctgccctgtgtgcaagcagctgattgccctgtgctgctaccacgccaagcactgccaggagaacaagtgccctgtgcccttctgcctgaacatcaagcacaagctgcggcagcagcagatccagcaccggctgcagcaggcccagctgatgagaagaaggatggccaccatgaacaccagaaatgtgccccagcagagcctgcccagccccaccagcgcccctcctggcacccccacccagcagcccagcaccccccagaccccccagcccccagcccagccccagcccagccctgtgtccatgagccctgctggcttccccagcgtggcccggacccagccccccaccaccgtgtccacaggcaagcccaccagccaggtgcctgcccctcctcctccagcccagcccccacctgctgctgtggaggccgcccggcagatcgagcgggaggcccagcagcagcagcacctgtacagagtgaacatcaacaacagcatgcctcctggccgcacaggcatgggcaccccaggcagccagatggcccctgtgtccctgaatgtgccccggcccaaccaggtgtctggccctgtgatgcccagcatgcctcctggccagtggcagcaggcccccctgccccagcagcagcccatgcctggcctgcccaggcctgtgatctccatgcaggcccaggccgctgtggccggccccaggatgcccagcgtgcagccccccaggagcatcagccccagcgccctgcaggacctgctgcggaccctgaagagccccagcagcccccagcagcagcagcaggtgctgaacatcctgaagagcaacccccagctgatggccgccttcatcaagcagaggacagccaagtatgtggccaaccagcccggcatgcagccccagcccggcctgcagagccagcccggcatgcagccccagcccggcatgcaccagcagcccagcctgcagaacctgaatgccatgcaggccggcgtgcccaggcctggggtgcccccccagcagcaggccatgggcggcctgaacccccagggccaggccctgaacatcatgaaccctggccacaaccccaacatggcctccatgaacccccagtaccgggagatgctgcggcggcagctgctgcagcagcagcagcagcagcagcagcagcagcagcagcagcagcagcagcagcagggcagcgctggcatggccggcggcatggccggccacggccagttccagcagccccagggccctgggggctaccccccagccatgcagcagcagcagaggatgcagcagcacctgcccctgcagggcagctccatgggccagatggccgcccagatgggccagctgggccagatgggccagcccggcctgggcgctgacagcacccccaacatccagcaggccctgcagcagaggatcctgcagcagcagcagatgaagcagcagatcggcagccctggccagcccaaccccatgagcccccagcagcacatgctgagcggccagccccaggccagccacctgcccggccagcagatcgccaccagcctgagcaaccaggtgcgcagccctgcccctgtgcagagcccccggccccagagccagcccccccacagcagccccagcccccgcatccagccccagcccagcccccaccacgtgagcccccagacaggcagcccccaccctggcctggccgtgaccatggccagcagcattgaccagggccacctgggcaaccctgagcagagcgccatgctgccccagctgaacacccccagccgcagcgccctgagcagcgagctgagcctggtgggggacaccactggagacaccctggagaagtttgtggagggcctgtag

SEQ ID NO: 148553 - DNA, 7419 bp, Artificial Sequence
  Description of Artificial Sequence: Synthetic coding sequence
ctgcggggagctgtggccgtggccgagatctggcccccacctcctcctcctggcctgcggccccccagccccagcgccccagcccggcccctggccgcccgggcccggagcagccccagccagcctgctggcccccccacccctgtgcgggccctggccggccctgctgcccgggcccggggctgcttccgggagcaggtgaagatggccgagaacctgctggatggcccccccaaccccaagagggccaagctgagcagccctggcttcagcgccaatgacagcacagactttggcagcctgtttgacctggagaatgacctgcctgatgagctgatccccaatggaggagagctgggcctgctgaacagcggcaacctggtgcctgatgctgccagcaagcacaagcagctgtctgagctgctgcggggcggcagcggcagcagcatcaaccctggcattggaaatgtgtctgccagcagccctgtgcagcagggcctgggcggccaggcccagggccagcccaacagcgccaacatggccagcctgagcgccatgggcaagagccccctgagccagggcgacagcagcgcccccagcctgcccaagcaggccgccagcaccagcggccccaccccagctgccagccaggccctgaacccccaggcccagaagcaggtgggcctggccaccagcagccctgccaccagccagacaggccctggcatctgcatgaatgccaacttcaaccagacccaccctggcctgctgaacagcaacagcggccacagcctcatcaaccaggccagccagggccaggcccaggtgatgaatggcagcctgggcgccgccggccggggccgcggggccggcatgccctaccccaccccagccatgcagggcgccagcagctctgtgctggccgagaccctgacccaggtgagcccccagatgactggacatgctggcctgaacacagcccaggccggcggcatggccaagatgggcatcaccggcaacaccagccccttcggccagcccttcagccaggccggcggccagcccatgggcgccactggagtgaacccccagctggccagcaagcagagcatggtgaacagcctgcccaccttccccacagacatcaagaacacctctgtgaccaacgtgcccaacatgagccagatgcagacctctgtgggcatcgtgcccacccaggccatcgccaccggccccacagctgaccctgagaagaggaagctgatccagcagcagctggtgctgctgctgcacgcccacaagtgccagaggcgggagcaggccaacggggaggtgcgggcctgcagcctgccccactgcaggaccatgaagaatgtgctgaaccacatgacccactgccaggccggcaaggcctgccaggccatcctgggcagccctgccagcggcatccagaacaccatcggctctgtgggcaccggccagcagaatgccaccagcctgagcaaccccaaccccatcgaccccagctccatgcagagggcctatgctgccctgggcctgccctacatgaaccagccccagacccagctgcagccccaggtgcccggccagcagcctgcccagccccagacccaccagcagatgaggaccctgaaccccctgggcaacaaccccatgaacatcccagctgggggcatcaccacagaccagcagccccccaacctgatcagcgagagcgccctgcccaccagcctgggcgccaccaaccccctgatgaatgatggcagcaacagcggcaacatcggcaccctgagcaccatccccacagctgccccacccagcagcactggagtgaggaagggctggcatgaacatgtgacccaggacctgcggagccacctggtgcacaagctggtgcaggccatcttccccaccccagaccctgctgccctgaaggacaggaggatggagaacctggtggcctatgccaagaaggtggagggggacatgtatgaaagtgccaacagcagagatgagtactaccacctgctggccgagaagatctacaagatccagaaggagctggaggagaagagaagaagccggctgcacaagcagggcatcctgggcaaccagcctgccctgcctgcccctggggcccagccccctgtgatcccccaggcccagcctgtgcggcccccaaatggccccctgagcctgcctgtgaacaggatgcaggtgtcccagggcatgaacagcttcaaccccatgagcctgggcaatgtgcagctgccccaggcccccatgggccccagggctgccagccccatgaaccacagcgtgcagatgaacagcatgggctctgtgcccggcatggccatcagccccagcaggatgccccagccccccaacatgatgggcgcccacaccaacaacatgatggcccaggccccagcccagagccagttcctgccccagaaccagttccccagcagcagcggggccatgtctgtgggcatgggccagcccccagcccagacaggagtgtcccagggccaggtgcctggagctgccctgcccaaccccctgaacatgctgggcccccaggccagccagctgccctgcccccctgtgacccagagccccctgcaccccaccccacctccagccagcacagctgctggcatgcccagcctgcagcacaccaccccacctggcatgaccccaccccagcctgctgcccccacccagcccagcacccctgtgagcagcagcggccagacccccacccccaccccaggctctgtgcccagcgccacccagacccagagcacccccaccgtgcaggccgccgcccaggcccaggtgaccccccagccccagacccctgtgcagccccccagcgtggccaccccccagagcagccagcagcagcccacccctgtgcacgcccagcccccaggcacccccctgagccaggccgccgccagcattgacaacagagtgcccacccccagctctgtggccagcgctgagaccaacagccagcagcccggcccagatgtgcctgtgctggagatgaagacagagacccaggccgaggacacagagccagaccccggggagagcaagggggagcccaggtctgagatgatggaggaggacctgcagggcgccagccaggtgaaggaggagacagacattgctgagcagaagtctgagcccatggaggtggatgagaagaagccagaggtgaaggtggaggtgaaggaggaggaggagagcagcagcaatggaacagccagccagagcaccagccccagccagcccaggaagaagatcttcaagccagaggagctgcggcaggccctgatgcccaccctggaggccctgtaccggcaggaccctgagagcctgcccttccggcagcctgtggacccccagctgctgggcatcccagactactttgacatcgtgaagaaccccatggacctgagcaccatcaagaggaagctggacaccggccagtaccaggagccctggcagtatgtggatgatgtgtggctgatgttcaacaatgcctggctgtacaacaggaagaccagccgggtgtacaagttctgcagcaagctggccgaggtgtttgagcaggagattgatcctgtgatgcagagcctgggctactgctgcggcaggaaatatgagttcagcccccagaccctgtgctgctacggcaagcagctgtgcaccatccccagagatgctgcctactacagctaccagaaccgctaccacttctgtgagaagtgcttcacagagatccagggagaaaatgtgaccctgggagatgaccccagccagccccagaccaccatcagcaaggaccagtttgagaagaagaagaatgacaccctggaccctgagccctttgtggactgcaaggaatgtggcaggaagatgcaccagatctgtgtgctgcactatgacatcatctggcccagcggctttgtgtgtgacaactgcctgaagaagacaggccggcccaggaaagaaaacaagttcagcgccaagaggctgcagaccacccggctgggcaaccacctggaggacagagtgaacaagttcctgcggcggcagaaccaccctgaggccggggaggtgtttgtgcgggtggtggccagcagtgacaagacagtggaggtgaagccaggcatgaagagcagatttgtggacagcggggagatgtctgagagcttcccctaccgcaccaaggccctgtttgcctttgaggagattgatggagtggatgtgtgcttcttcggcatgcacgtgcaggagtatggcagtgactgccccccacccaacaccaggagagtgtacatctcctacctggacagcatccacttcttccggccccgctgcctgaggacagctgtgtaccacgagatcctgattggctacctggagtatgtgaagaagctgggctacgtgacaggccacatctgggcctgccccccatctgaaggagatgactacatcttccactgccaccccccagaccagaagatccccaagcccaagaggctgcaggagtggtacaagaagatgctggacaaggcctttgctgagcgcatcatccatgactacaaggacatcttcaagcaggccacagaggaccggctgaccagcgccaaggagctgccctactttgaaggagacttctggcccaacgtgctggaggagagcatcaaggagctggagcaggaggaggaggagaggaagaaggaggagagcacagctgccagcgagaccacagagggcagccagggcgacagcaagaatgccaagaagaagaacaacaagaagaccaacaagaacaagagcagcatcagccgggccaacaagaagaagcccagcatgcccaacgtgtccaatgacctgagccagaagctgtatgccaccatggagaagcacaaggaggtgttctttgtgatccacctgcatgctggccctgtgatcaacaccctgccccccatcgtggaccctgaccccctgctgagctgtgacctgatggatggaagagatgccttcctgaccctggcccgggacaagcactgggagttcagcagcctgcggcgcagcaagtggagcaccctgtgcatgctggtggagctgcacacccagggccaggacagatttgtgtacacctgcaatgaatgcaagcaccacgtggagacccgctggcactgcaccgtgtgtgaggactatgacctgtgcatcaactgctacaacaccaagagccacgcccacaagatggtgaagtggggcctgggcctggatgatgagggcagcagccagggcgagccccagagcaagagcccccaggagagccggcggctgagcatccagcgctgcatccagagcctggtgcacgcctgccagtgcagaaatgccaactgcagcctgcccagctgccagaagatgaagagggtggtgcagcacaccaagggctgcaagaggaagaccaatggaggctgccctgtgtgcaagcagctgattgccctgtgctgctaccacgccaagcactgccaggagaacaagtgccctgtgcccttctgcctgaacatcaagcacaagctgcggcagcagcagatccagcaccggctgcagcaggcccagctgatgagaagaaggatggccaccatgaacaccagaaatgtgccccagcagagcctgcccagccccaccagcgcccctcctggcacccccacccagcagcccagcaccccccagaccccccagcccccagcccagccccagcccagccctgtgtccatgagccctgctggcttccccagcgtggcccggacccagccccccaccaccgtgtccacaggcaagcccaccagccaggtgcctgcccctcctcctccagcccagcccccacctgctgctgtggaggccgcccggcagatcgagcgggaggcccagcagcagcagcacctgtacagagtgaacatcaacaacagcatgcctcctggccgcacaggcatgggcaccccaggcagccagatggcccctgtgtccctgaatgtgccccggcccaaccaggtgtctggccctgtgatgcccagcatgcctcctggccagtggcagcaggcccccctgccccagcagcagcccatgcctggcctgcccaggcctgtgatctccatgcaggcccaggccgctgtggccggccccaggatgcccagcgtgcagccccccaggagcatcagccccagcgccctgcaggacctgctgcggaccctgaagagccccagcagcccccagcagcagcagcaggtgctgaacatcctgaagagcaacccccagctgatggccgccttcatcaagcagaggacagccaagtatgtggccaaccagcccggcatgcagccccagcccggcctgcagagccagcccggcatgcagccccagcccggcatgcaccagcagcccagcctgcagaacctgaatgccatgcaggccggcgtgcccaggcctggggtgcccccccagcagcaggccatgggcggcctgaacccccagggccaggccctgaacatcatgaaccctggccacaaccccaacatggcctccatgaacccccagtaccgggagatgctgcggcggcagctgctgcagcagcagcagcagcagcagcagcagcagcagcagcagcagcagcagcagcagggcagcgctggcatggccggcggcatggccggccacggccagttccagcagccccagggccctgggggctaccccccagccatgcagcagcagcagaggatgcagcagcacctgcccctgcagggcagctccatgggccagatggccgcccagatgggccagctgggccagatgggccagcccggcctgggcgctgacagcacccccaacatccagcaggccctgcagcagaggatcctgcagcagcagcagatgaagcagcagatcggcagccctggccagcccaaccccatgagcccccagcagcacatgctgagcggccagccccaggccagccacctgcccggccagcagatcgccaccagcctgagcaaccaggtgcgcagccctgcccctgtgcagagcccccggccccagagccagcccccccacagcagccccagcccccgcatccagccccagcccagcccccaccacgtgagcccccagacaggcagcccccaccctggcctggccgtgaccatggccagcagcattgaccagggccacctgggcaaccctgagcagagcgccatgctgccccagctgaacacccccagccgcagcgccctgagcagcgagctgagcctggtgggggacaccactggagacaccctggagaagtttgtggagggcctgtag

SEQ ID NO: 148554 - DNA, 1782 bp, Artificial Sequence
  Description of Artificial Sequence: Synthetic coding sequence
atggccaccagcaacaaccccaggaagttcagcgagaagatcgccctgcacaaccagaagcaggccgaggagacagctgcctttgaggaggtgatgaaggacctgagcctgacccgggccgcccggctgcagctgcagaagagccagtacctgcagctgggccccagccggggccagtactatggaggcagcctgcccaacgtgaaccagatcggcagcggcaccatggacctgcccttccagacccccttccagagcagcggcctggacaccagcaggaccaccaggcaccacggcctggtggacagagtgtaccgggagcggggccgcctgggcagcccccaccggcggcccctgtctgtggacaagcacggccggcaggccgacagctgcccctacggcaccatgtacctgagccccccagctgacacctcctggaggaggaccaacagcgacagcgccctgcaccagagcaccatgacccccacccagcctgagagcttcagcagcggcagccaggatgtgcaccagaagagggtgctgctgctgactgtgcccggcatggaggagaccaccagcgaggccgacaagaacctgagcaagcaggcctgggacaccaagaagacaggcagccggcccaagagctgtgaggtgcccggcatcaacatcttccccagcgctgaccaggagaacaccacagccctgatcccagccacccacaacacaggaggcagcctgcctgacctgaccaacatccacttccccagccccctgcccacccccctggaccctgaggagcccaccttccctgccctgagcagcagcagcagcacaggcaacctggccgccaacctgacccacctgggcatcggcggggccggccagggcatgagcaccccaggcagcagcccccagcacaggcctgctggggtgagccccctgagcctgagcacagaggcccggcggcagcaggccagccccaccctgagccccctgagccccatcacccaggccgtggccatggatgccctgagcctggagcagcagctgccctatgccttcttcacccaggccggcagccagcagcccccaccccagccccagcccccacctcctcctcctccagccagccagcagcccccacctcctcctccaccccaggcccctgtgcggctgcccccaggcggccccctgctgcccagcgccagcctgacccggggcccccagcccccacccctggccgtgacagtgcccagcagcctgccccagagccccccagaaaatcctggccagcccagcatgggcatcgacatcgccagcgccccagccctgcagcagtaccgcaccagcgctggcagccctgccaaccagagccccaccagccctgtgagcaaccagggcttcagccctggcagcagcccccagctggagcagttcaacatgatggagaatgccatcagcagcagcagcctgtacagccctggcagcaccctgaactacagccaggccgccatgatgggcctgaccggcagccacggcagcctgcctgacagccagcagctgggctacgccagccacagcggcatccccaacatcatcctgactgtgactggagagagcccccccagcctgagcaaggagctgaccagccaccggggccacctgcctgatggcccccctgtgtctggccatgctggcaccctgcccctgagcaggccagatggagccagccctgcccggggccggccctgcagcgtgccccggcagaggcccagcctgtag

SEQ ID NO: 148555 - DNA, 1905 bp, Artificial Sequence
  Description of Artificial Sequence: Synthetic coding sequence
atggccaccagcaacaaccccaggaagttcagcgagaagatcgccctgcacaaccagaagcaggccgaggagacagctgcctttgaggaggtgatgaaggacctgagcctgacccgggccgcccggctgcagctgcagaagagccagtacctgcagctgggccccagccggggccagtactatggaggcagcctgcccaacgtgaaccagatcggcagcggcaccatggacctgcccttccagacccccttccagagcagcggcctggacaccagcaggaccaccaggcaccacggcctggtggacagagtgtaccgggagcggggccgcctgggcagcccccaccggcggcccctgtctgtggacaagcacggccggcaggccgacagctgcccctacggcaccatgtacctgagccccccagctgacacctcctggaggaggaccaacagcgacagcgccctgcaccagagcaccatgacccccacccagcctgagagcttcagcagcggcagccaggatgtgcaccagaagagggtgctgctgctgactgtgcccggcatggaggagaccaccagcgaggccgacaagaacctgagcaagcaggcctgggacaccaagaagacaggcagccggcccaagagctgtgaggtgcccggcatcaacatcttccccagcgctgaccaggagaacaccacagccctgatcccagccacccacaacacaggaggcagcctgcctgacctgaccaacatccacttccccagccccctgcccacccccctggaccctgaggagcccaccttccctgccctgagcagcagcagcagcacaggcaacctggccgccaacctgacccacctgggcatcggcggggccggccagggcatgagcaccccaggcagcagcccccagcacaggcctgctggggtgagccccctgagcctgagcacagaggcccggcggcagcaggccagccccaccctgagccccctgagccccatcacccaggccgtggccatggatgccctgagcctggagcagcagctgccctatgccttcttcacccaggccggcagccagcagcccccaccccagccccagcccccacctcctcctcctccagccagccagcagcccccacctcctcctccaccccaggcccctgtgcggctgcccccaggcggccccctgctgcccagcgccagcctgacccggggcccccagcccccacccctggccgtgacagtgcccagcagcctgccccagagccccccagaaaatcctggccagcccagcatgggcatcgacatcgccagcgccccagccctgcagcagtaccgcaccagcgctggcagccctgccaaccagagccccaccagccctgtgagcaaccagggcttcagccctggcagcagcccccagcacaccagcaccctgggctctgtgtttggagatgcctactatgagcagcagatggccgcccggcaggccaatgccctgagccaccagctggagcagttcaacatgatggagaatgccatcagcagcagcagcctgtacagccctggcagcaccctgaactacagccaggccgccatgatgggcctgaccggcagccacggcagcctgcctgacagccagcagctgggctacgccagccacagcggcatccccaacatcatcctgactgtgactggagagagcccccccagcctgagcaaggagctgaccagcagcctggccggcgtgggagatgtgtcctttgacagcgacagccagttccccctggatgagctgaagattgaccccctgaccctggatggcctgcacatgctgaatgaccctgacatggtgctggccgaccctgccacagaggacaccttcaggatggaccggctgtag

SEQ ID NO: 148556 - DNA, 1953 bp, Artificial Sequence
  Description of Artificial Sequence: Synthetic coding sequence
atggccaccagcaacaaccccaggaagttcagcgagaagatcgccctgcacaaccagaagcaggccgaggagacagctgcctttgaggaggtgatgaaggacctgagcctgacccgggccgcccggctgcagctgcagaagagccagtacctgcagctgggccccagccggggccagtactatggaggcagcctgcccaacgtgaaccagatcggcagcggcaccatggacctgcccttccagcccagcggcttcctgggggaggccctggccgccgcccctgtgtccctgacccccttccagagcagcggcctggacaccagcaggaccaccaggcaccacggcctggtggacagagtgtaccgggagcggggccgcctgggcagcccccaccggcggcccctgtctgtggacaagcacggccggcaggccgacagctgcccctacggcaccatgtacctgagccccccagctgacacctcctggaggaggaccaacagcgacagcgccctgcaccagagcaccatgacccccacccagcctgagagcttcagcagcggcagccaggatgtgcaccagaagagggtgctgctgctgactgtgcccggcatggaggagaccaccagcgaggccgacaagaacctgagcaagcaggcctgggacaccaagaagacaggcagccggcccaagagctgtgaggtgcccggcatcaacatcttccccagcgctgaccaggagaacaccacagccctgatcccagccacccacaacacaggaggcagcctgcctgacctgaccaacatccacttccccagccccctgcccacccccctggaccctgaggagcccaccttccctgccctgagcagcagcagcagcacaggcaacctggccgccaacctgacccacctgggcatcggcggggccggccagggcatgagcaccccaggcagcagcccccagcacaggcctgctggggtgagccccctgagcctgagcacagaggcccggcggcagcaggccagccccaccctgagccccctgagccccatcacccaggccgtggccatggatgccctgagcctggagcagcagctgccctatgccttcttcacccaggccggcagccagcagcccccaccccagccccagcccccacctcctcctcctccagccagccagcagcccccacctcctcctccaccccaggcccctgtgcggctgcccccaggcggccccctgctgcccagcgccagcctgacccggggcccccagcccccacccctggccgtgacagtgcccagcagcctgccccagagccccccagaaaatcctggccagcccagcatgggcatcgacatcgccagcgccccagccctgcagcagtaccgcaccagcgctggcagccctgccaaccagagccccaccagccctgtgagcaaccagggcttcagccctggcagcagcccccagcacaccagcaccctgggctctgtgtttggagatgcctactatgagcagcagatggccgcccggcaggccaatgccctgagccaccagctggagcagttcaacatgatggagaatgccatcagcagcagcagcctgtacagccctggcagcaccctgaactacagccaggccgccatgatgggcctgaccggcagccacggcagcctgcctgacagccagcagctgggctacgccagccacagcggcatccccaacatcatcctgactgtgactggagagagcccccccagcctgagcaaggagctgaccagcagcctggccggcgtgggagatgtgtcctttgacagcgacagccagttccccctggatgagctgaagattgaccccctgaccctggatggcctgcacatgctgaatgaccctgacatggtgctggccgaccctgccacagaggacaccttcaggatggaccggctgtag

SEQ ID NO: 148557 - DNA, 2082 bp, Artificial Sequence
  Description of Artificial Sequence: Synthetic coding sequence
atggccaccagcggggccaatggacctggcagcgccacagccagcgccagcaaccccaggaagttcagcgagaagatcgccctgcagaagcagaggcaggccgaggagacagctgcctttgaggaggtgatgatggacatcggcagcacccggctgcaggcccagaagctgcggctggcctacaccaggagcagccactatggaggcagcctgcccaacgtgaaccagatcggcagcggcctggccgagttccagagccccctgcacagccccctggacagcagccgcagcaccaggcaccacggcctggtggagcgggtgcagagggaccccaggaggatggtgagccccctgcggcgctacaccaggcacatcgacagcagcccctacagccctgcctacctgagccccccacctgagagctcctggaggaggaccatggcctggggcaacttccctgctgagaagggccagctgttccggctgcccagcgccctgaacagaaccagcagtgacagcgccctgcacacctctgtgatgaaccccagcccccaggacacctacccaggccccaccccacccagcatcctgcccagccggcggggcggcatcctggatggagagatggaccccaaggtgcctgccatcgaggagaacctgctggatgacaagcacctgctgaagccctgggatgccaagaagctgagcagcagcagcagccggcccaggagctgtgaggtgcccggcatcaacatcttccccagcccagaccagcctgccaacgtgcctgtgctgcccccagccatgaacacaggaggcagcctgcctgacctgaccaacctgcacttccccccacccctgcccacccccctggaccctgaggagacagcctaccccagcctgagcggcggcaacagcaccagcaacctgacccacaccatgacccacctgggcatcagccggggcatgggcctgggccctggctatgatgcccctggcctgcacagccccctgagccaccccagcctgcagagcagcctgagcaaccccaacctgcaggccagcctgagcagcccccagccccagctgcagggcagccacagccaccccagcctgcctgccagcagcctggcccggcacgtgctgcccaccaccagcctgggccaccccagcctgagcgccccagccctgagcagcagcagcagcagcagcagcaccagcagccctgtgctgggcgcccccagctacccagccagcacccctggggccagcccccaccaccggcgggtgcccctgagccccctgagcctgctggccggccctgcagatgcccggcgcagccagcagcagctgcccaagcagttcagccccaccatgagccccaccctgagcagcatcacccagggcgtgcccctggacaccagcaagctgagcacagaccagaggctgcccccctacccctacagcagccccagcctggtgctgcccacccagccccacacccccaagagcctgcagcagcccggcctgcccagccagagctgcagcgtgcagagcagcggcggccagcccccaggccggcagagccactacggcaccccctacccacctggccccagcggccacggccagcagagctaccaccggcccatgtctgacttcaacctgggcaacctggagcagttctccatggagagccccagcgccagcctggtgctggaccccccaggcttcagcgagggccctggcttcctgggcggggagggccccatgggcggcccccaggacccccacaccttcaaccaccagaacctgacccactgcagcagacatggcagcggccccaacatcatcctgaccggggacagcagccctggcttcagcaaggagattgctgctgccctggccggcgtgcccggctttgaggtgtctgctgctggcctggagctgggcctgggcctggaggatgagctgaggatggagcccctgggcctggagggcctgaacatgctgagtgacccctgtgccctgctgcctgaccctgctgtggaggagagcttcagaagtgaccggctgcagtag

SEQ ID NO: 148558 - DNA, 1860 bp, Artificial Sequence
  Description of Artificial Sequence: Synthetic coding sequence
atggccgccagccctggcagcggcagcgccaaccccaggaagttcagcgagaagatcgccctgcacacccagaggcaggccgaggagacccgggcctttgagcagctgatgacagacctgaccctgagccgggtgcagttccagaagctgcagcagctgcggctgacccagtaccatggaggcagcctgcccaacgtgtcccagctgcggagcagcgccagcgagttccagcccagcttccaccaggccgacaacgtgcggggcaccaggcaccacggcctggtggagcggcccagcaggaaccgcttccaccccctgcaccggcgcagcggggacaagccaggccggcagtttgatggcagcgcctttggagccaactacagcagccagcccctggatgagagctggccccggcagcagcccccctggaaggatgagaagcaccctggcttccggctgaccagcgccctgaacagaaccaacagcgacagcgccctgcacaccagcgccctgagcaccaagccccaggacccctatggaggcggcggccagagcgcctggccagccccctacatgggcttctgtgatggagagaacaacggccacggggaggtggccagcttccctggccccctgaaggaggagaacctgctgaatgtgcccaagcccctgcccaagcagctgtgggagaccaaggagatccagagcctgagcggccggcccaggagctgtgatgtgggcggcggcaatgccttcccccacaacggccagaacctgggcctgagccccttcctgggcaccctgaacacaggaggcagcctgcctgacctgaccaacctgcactacagcacccccctgcctgccagcctggacaccacagaccaccacttcggctccatgtctgtgggcaacagcgtgaacaacatcccagctgccatgacccacctgggcatccgcagcagcagcggcctgcagagcagccgcagcaaccccagcatccaggccaccctgaacaagacagtgctgagcagcagcctgaacaaccacccccagacctctgtgcccaatgccagcgccctgcaccccagcctgcggctcttcagcctgagcaaccccagcctgagcaccaccaacctgagcggccccagcagaagacggcagccccctgtgagccccctgaccctgagccctggccctgaggcccaccagggcttcagccggcagctgagcagcaccagccccctggccccctaccccaccagccagatggtgtccagtgacaggagccagctgtccttcctgcccacagaggcccaggcccaggtgagccccccaccaccctacccagccccccaggagctgacccagcccctgctgcagcagccccgggcccctgaggccccagcccagcagccccaggccgccagcagcctgccccagagcgacttccagctgctgcctgcccagggcagcagcctgaccaacttcttcccagatgtgggctttgaccagcagagcatgaggcctggccctgccttcccccagcaggtgcccctggtgcagcagggcagccgggagctgcaggacagcttccacctgcggcccagcccctacagcaactgtggcagcctgcccaacaccatcctgcctgaggacagcagcaccagcctcttcaaggacctgaacagcgccctggccggcctgcctgaggtgtccctgaatgtggacacccccttccccctggaggaggagctgcagatcgagcccctgagcctggatggcctgaacatgctgagtgacagctccatgggcctgctggaccccagcgtggaggagaccttccgggctgaccggctgtag

SEQ ID NO: 148559 - DNA, 1857 bp, Artificial Sequence
  Description of Artificial Sequence: Synthetic coding sequence
atggccgccagccctggcagcggcagcgccaaccccaggaagttcagcgagaagatcgccctgcacacccagaggcaggccgaggagacccgggcctttgagcagctgatgacagacctgaccctgagccgggtgcagttccagaagctgcagcagctgcggctgacccagtaccatggaggcagcctgcccaacgtgtcccagctgcggagcagcgccagcgagttccagcccagcttccaccaggccgacaacgtgcggggcaccaggcaccacggcctggtggagcggcccagcaggaaccgcttccaccccctgcaccggcgcagcggggacaagccaggccggcagtttgatggcagcgcctttggagccaactacagcagccagcccctggatgagagctggccccggcagcagcccccctggaaggatgagaagcaccctggcttccggctgaccagcgccctgaacagaaccaacagcgacagcgccctgcacaccagcgccctgagcaccaagccccaggacccctatggaggcggcggccagagcgcctggccagccccctacatgggcttctgtgatggagagaacaacggccacggggaggtggccagcttccctggccccctgaaggaggagaacctgctgaatgtgcccaagcccctgcccaagcagctgtgggagaccaaggagatccagagcctgagcggccggcccaggagctgtgatgtgggcggcggcaatgccttcccccacaacggccagaacctgggcctgagccccttcctgggcaccctgaacacaggaggcagcctgcctgacctgaccaacctgcactacagcacccccctgcctgccagcctggacaccacagaccaccacttcggctccatgtctgtgggcaacagcgtgaacaacatcccagctgccatgacccacctgggcatccgcagcagcagcggcctgcagagcagccgcagcaaccccagcatccaggccaccctgaacaagacagtgctgagcagcagcctgaacaaccacccccagacctctgtgcccaatgccagcgccctgcaccccagcctgcggctcttcagcctgagcaaccccagcctgagcaccaccaacctgagcggccccagcagaagacggcagccccctgtgagccccctgaccctgagccctggccctgaggcccaccagggcttcagccggcagctgagcagcaccagccccctggccccctaccccaccagccagatggtgtccagtgacaggagccagctgtccttcctgcccacagaggcccaggcccaggtgagccccccaccaccctacccagccccccaggagctgacccagcccctgctgcagcagccccgggcccctgaggccccagcccagcagccccaggccgccagcagcctgccccagagcgacttccagctgctgcctgcccagggcagcagcctgaccaacttcttcccagatgtgggctttgaccagcagagcatgaggcctggccctgccttcccccagcaggtgcccctggtgcagcagggcagccgggagctgcaggacagcttccacctgcggcccagcccctacagcaactgtggcagcctgcccaacaccatcctgcctgacagcagcaccagcctcttcaaggacctgaacagcgccctggccggcctgcctgaggtgtccctgaatgtggacacccccttccccctggaggaggagctgcagatcgagcccctgagcctggatggcctgaacatgctgagtgacagctccatgggcctgctggaccccagcgtggaggagaccttccgggctgaccggctgtag

SEQ ID NO: 148560 - DNA, 1749 bp, Artificial Sequence
  Description of Artificial Sequence: Synthetic coding sequence
atgacagacctgaccctgagccgggtgcagttccagaagctgcagcagctgcggctgacccagtaccatggaggcagcctgcccaacgtgtcccagctgcggagcagcgccagcgagttccagcccagcttccaccaggccgacaacgtgcggggcaccaggcaccacggcctggtggagcggcccagcaggaaccgcttccaccccctgcaccggcgcagcggggacaagccaggccggcagtttgatggcagcgcctttggagccaactacagcagccagcccctggatgagagctggccccggcagcagcccccctggaaggatgagaagcaccctggcttccggctgaccagcgccctgaacagaaccaacagcgacagcgccctgcacaccagcgccctgagcaccaagccccaggacccctatggaggcggcggccagagcgcctggccagccccctacatgggcttctgtgatggagagaacaacggccacggggaggtggccagcttccctggccccctgaaggaggagaacctgctgaatgtgcccaagcccctgcccaagcagctgtgggagaccaaggagatccagagcctgagcggccggcccaggagctgtgatgtgggcggcggcaatgccttcccccacaacggccagaacctgggcctgagccccttcctgggcaccctgaacacaggaggcagcctgcctgacctgaccaacctgcactacagcacccccctgcctgccagcctggacaccacagaccaccacttcggctccatgtctgtgggcaacagcgtgaacaacatcccagctgccatgacccacctgggcatccgcagcagcagcggcctgcagagcagccgcagcaaccccagcatccaggccaccctgaacaagacagtgctgagcagcagcctgaacaaccacccccagacctctgtgcccaatgccagcgccctgcaccccagcctgcggctcttcagcctgagcaaccccagcctgagcaccaccaacctgagcggccccagcagaagacggcagccccctgtgagccccctgaccctgagccctggccctgaggcccaccagggcttcagccggcagctgagcagcaccagccccctggccccctaccccaccagccagatggtgtccagtgacaggagccagctgtccttcctgcccacagaggcccaggcccaggtgagccccccaccaccctacccagccccccaggagctgacccagcccctgctgcagcagccccgggcccctgaggccccagcccagcagccccaggccgccagcagcctgccccagagcgacttccagctgctgcctgcccagggcagcagcctgaccaacttcttcccagatgtgggctttgaccagcagagcatgaggcctggccctgccttcccccagcaggtgcccctggtgcagcagggcagccgggagctgcaggacagcttccacctgcggcccagcccctacagcaactgtggcagcctgcccaacaccatcctgcctgacagcagcaccagcctcttcaaggacctgaacagcgccctggccggcctgcctgaggtgtccctgaatgtggacacccccttccccctggaggaggagctgcagatcgagcccctgagcctggatggcctgaacatgctgagtgacagctccatgggcctgctggaccccagcgtggaggagaccttccgggctgaccggctgtag

SEQ ID NO: 148561 - DNA, 672 bp, Artificial Sequence
  Description of Artificial Sequence: Synthetic coding sequence
atgacctggaggcaccacgtgcggctgctcttcaccgtgtccctggccctgcagatcatcaacctgggcaacagctaccagcgggagaagcacaacggcggccgggaggaggtgaccaaggtggccacccagaagcaccggcagagccccctgaactggaccagcagccactttggagaggtgacaggcagcgctgagggctggggccctgaggagcccctgccctacagccgggccttcggggagggcgccagcgcccggccccgctgctgcagaaatggaggcacctgtgtgctgggcagcttctgtgtgtgcccagcccacttcaccggccgctactgtgaacatgaccagaggagaagtgaatgtggggccctggagcacggggcctggaccctgcgggcctgccacctgtgccgctgcatctttggagccctgcactgcctgcccctgcagaccccagacagatgtgaccccaaggacttcctggccagccacgcccacggccccagcgctgggggcgcccccagcctgctgctgctgctgccctgtgccctgctgcaccggctgctgcggccagatgccccagcccaccccaggagcctggtgcccagcgtgctgcagcgggagcggcggccctgtggccggcccggcctgggccaccggctgtag

SEQ ID NO: 148562 - DNA, 2511 bp, Artificial Sequence
  Description of Artificial Sequence: Synthetic coding sequence
atgacagccaccgtggagaacctgaccttccagaaggacaccctgggcaatgctgtggacaagaacagaagacatggcagcacagagcccctggtgctggcctggagcagccagttccggcggctgacctggggctgtgccctggatgccctgcacaggagcccctgtgtggccgccagccagcacggcgtgacccacctgatccgcagcagcaggaccccccacagcacccgctgcaggaaggaggatgcccagcccggccaccacggcaatggagctgcctctgtgacagcccaggcccggggccagaggtctgtgctgcaggtgcccctgcctgtgcccaggagctgcctcttcagcgagagctttgtggtgtctgtgagcagccagagccgcttcctggcctctgtgcccggcaccggggtgcagaggagcacagctgctgacatggccgccagcacagctgctgggaagcagaggatccccaaggtggccaaggtgaagaacaaggccccagctgaggtgcagatcacagctgagcagctgctgcgggaggccaaggagcgggagctggagctgctgcccccaccaccccagcagaagatcacagatgaggaggagctgaatgactacaagctgaggaagaggaagacctttgaggacaacatcaggaagaacagaactgtcatcagcaactggatcaagtatgcccagtgggaggagagcctgaaggagatccagagggcccggagcatctatgagcgggccctggatgtggactacagaaacatcaccctgtggctgaagtatgcagagatggagatgaagaaccggcaggtgaaccacgccaggaacatctgggaccgggccatcaccaccctgccccgggtgaaccagttctggtacaagtacacctacatggaggagatgctgggcaatgtggccggggcccggcaggtgtttgagcgctggatggagtggcagcctgaggagcaggcctggcacagctacatcaactttgagctgcgctacaaggaggtggaccgggcccggaccatctatgaaagatttgtgctggtgcacccagatgtgaagaactggatcaagtatgccaggtttgaggagaagcacgcctactttgcccacgccaggaaggtgtatgaaagagctgtggagttctttggagatgagcacatggatgagcacctgtatgtggcctttgccaagtttgaggagaaccagaaggagtttgagcgggtgcgggtcatctacaagtatgccctggaccgcatcagcaagcaggatgcccaggagctgttcaagaactacaccatctttgagaagaagtttggagacagaagaggaattgaggacatcatcgtgtccaagaggcgcttccagtatgaggaggaggtgaaggccaacccccacaactatgatgcctggtttgactacctgcggctggtggagagtgatgctgaggccgaggccgtgcgggaggtgtatgaaagagccatcgccaacgtgccccccatccaggagaagaggcactggaagcgctacatctacctgtggatcaactatgccctgtatgaggagctggaggccaaggaccctgagaggacccggcaggtgtaccaggccagcctggagctgatcccccacaagaagttcacctttgccaagatgtggatcctgtatgcccagtttgagatccggcagaagaacctgagcctggcccggcgggccctgggcaccagcatcggcaagtgccccaagaacaagctgttcaaggtgtacatcgagctggagctgcagctgcgggagtttgaccgctgcaggaagctgtatgagaagttcctggagtttggacctgagaactgcacctcctggatcaagtttgctgagctggagaccatcctgggggacatcgaccgggcccgggccatctatgagctggccatcagccagccccggctggacatgcctgaggtgctgtggaagagctacatcgactttgaaattgagcaggaggagacagagaggaccaggaacctgtaccgccgcctgctgcagaggacccagcacgtgaaggtgtggatcagctttgcccagtttgagctgagcagcggcaaggagggcagcctgaccaagtgccggcagatctatgaggaggccaacaagaccatgaggaactgtgaggagaaggaggagcggctgatgctgctggagagctggaggagctttgaggaggagtttggaacagccagtgacaaggagcgggtggacaagctgatgcctgagaaggtgaagaagaggaggaaggtgcagacagatgatggcagtgatgctggctgggaggagtactttgactacatcttcccagaagatgctgccaaccagcccaacctgaagctgctggccatggccaagctgtggaagaagcagcagcaggagaaggaggatgctgagcaccacccagatgaagatgtggatgagagcgagagctag

SEQ ID NO: 148563 - DNA, 2547 bp, Artificial Sequence
  Description of Artificial Sequence: Synthetic coding sequence
atgacagccaccgtggagaacctgaccttccagaaggacaccctgggcaatgctgtggacaagaacaccagccggctggagctgcggagctacagcctggccggcagacatggcagcacagagcccctggtgctggcctggagcagccagttccggcggctgacctggggctgtgccctggatgccctgcacaggagcccctgtgtggccgccagccagcacggcgtgacccacctgatccgcagcagcaggaccccccacagcacccgctgcaggaaggaggatgcccagcccggccaccacggcaatggagctgcctctgtgacagcccaggcccggggccagaggtctgtgctgcaggtgcccctgcctgtgcccaggagctgcctcttcagcgagagctttgtggtgtctgtgagcagccagagccgcttcctggcctctgtgcccggcaccggggtgcagaggagcacagctgctgacatggccgccagcacagctgctgggaagcagaggatccccaaggtggccaaggtgaagaacaaggccccagctgaggtgcagatcacagctgagcagctgctgcgggaggccaaggagcgggagctggagctgctgcccccaccaccccagcagaagatcacagatgaggaggagctgaatgactacaagctgaggaagaggaagacctttgaggacaacatcaggaagaacagaactgtcatcagcaactggatcaagtatgcccagtgggaggagagcctgaaggagatccagagggcccggagcatctatgagcgggccctggatgtggactacagaaacatcaccctgtggctgaagtatgcagagatggagatgaagaaccggcaggtgaaccacgccaggaacatctgggaccgggccatcaccaccctgccccgggtgaaccagttctggtacaagtacacctacatggaggagatgctgggcaatgtggccggggcccggcaggtgtttgagcgctggatggagtggcagcctgaggagcaggcctggcacagctacatcaactttgagctgcgctacaaggaggtggaccgggcccggaccatctatgaaagatttgtgctggtgcacccagatgtgaagaactggatcaagtatgccaggtttgaggagaagcacgcctactttgcccacgccaggaaggtgtatgaaagagctgtggagttctttggagatgagcacatggatgagcacctgtatgtggcctttgccaagtttgaggagaaccagaaggagtttgagcgggtgcgggtcatctacaagtatgccctggaccgcatcagcaagcaggatgcccaggagctgttcaagaactacaccatctttgagaagaagtttggagacagaagaggaattgaggacatcatcgtgtccaagaggcgcttccagtatgaggaggaggtgaaggccaacccccacaactatgatgcctggtttgactacctgcggctggtggagagtgatgctgaggccgaggccgtgcgggaggtgtatgaaagagccatcgccaacgtgccccccatccaggagaagaggcactggaagcgctacatctacctgtggatcaactatgccctgtatgaggagctggaggccaaggaccctgagaggacccggcaggtgtaccaggccagcctggagctgatcccccacaagaagttcacctttgccaagatgtggatcctgtatgcccagtttgagatccggcagaagaacctgagcctggcccggcgggccctgggcaccagcatcggcaagtgccccaagaacaagctgttcaaggtgtacatcgagctggagctgcagctgcgggagtttgaccgctgcaggaagctgtatgagaagttcctggagtttggacctgagaactgcacctcctggatcaagtttgctgagctggagaccatcctgggggacatcgaccgggcccgggccatctatgagctggccatcagccagccccggctggacatgcctgaggtgctgtggaagagctacatcgactttgaaattgagcaggaggagacagagaggaccaggaacctgtaccgccgcctgctgcagaggacccagcacgtgaaggtgtggatcagctttgcccagtttgagctgagcagcggcaaggagggcagcctgaccaagtgccggcagatctatgaggaggccaacaagaccatgaggaactgtgaggagaaggaggagcggctgatgctgctggagagctggaggagctttgaggaggagtttggaacagccagtgacaaggagcgggtggacaagctgatgcctgagaaggtgaagaagaggaggaaggtgcagacagatgatggcagtgatgctggctgggaggagtactttgactacatcttcccagaagatgctgccaaccagcccaacctgaagctgctggccatggccaagctgtggaagaagcagcagcaggagaaggaggatgctgagcaccacccagatgaagatgtggatgagagcgagagctag

SEQ ID NO: 148564 - DNA, 7026 bp, Artificial Sequence
  Description of Artificial Sequence: Synthetic coding sequence
atgaagaacatctactgcctgatccccaagctggtgaactttgccaccctgggctgcctgtggatctctgtggtgcagtgcaccgtgctgaacagctgcctgaagagctgtgtgaccaacctgggccagcagctggacctgggcaccccccacaacctgtctgagccctgcatccagggctgccacttctggaacagcgtggaccagaagaactgtgccctgaagtgcaatgacacctacgccaccgtgtgtgagcgggagagctgtgaggtgggctgcagcagcgctgagggcgcctatgaggaggaggtgctggagaatgctgacctgcccacagccccctttgccagcagcatcggcagccacaacatgaccctgcgctggaagagcgccaacttcagcggcgtgaagtacatcatccagtggaagtatgcccagctgctgggctcctggacctacaccaagacagtgtcccggcccagctatgtggtgaagcccctgcaccccttcacagagtacatcttccgggtggtgtggatcttcaccgcccagctgcagctgtacagcccccccagccccagctaccgcacccacccccacggcgtgcctgagacagcccccctcatccggaacatcgagagcagcagcccagacacagtggaggtgtcctgggaccccccccagtttcctgggggccccatcctgggctacaacctgcggctcatcagcaagaaccagaagctggatgctggcacccagaggaccagcttccagttctacagcaccctgcccaacaccatctaccgcttcagcattgctgctgtgaatgaggtgggggagggccctgaggccgagagcagcatcaccaccagcagcagcgctgtgcagcaggaggagcagtggctgttcctgagcaggaagaccagcctgaggaagaggagcctgaagcacctggtggatgaggcccactgcctgcggctggatgccatctaccacaacatcaccggcatctctgtggatgtgcaccagcagatcgtgtacttcagcgagggcaccctcatctgggccaagaaggccgccaacatgtctgatgtgtctgacctgcgcatcttctaccggggcagcggcctcatcagcagcatcagcattgactggctgtaccagaggatgtacttcatcatggatgagctggtgtgtgtgtgtgacctggagaactgcagcaacatcgaggagatcaccccacccagcatcagcgccccccagaagatcgtggccgacagctacaacggctacgtgttctacctgctgagagatggcatctacagagctgacctgcctgtgcccagcggccgctgtgccgaggccgtgcgcatcgtggagagctgcaccctgaaggactttgccatcaagccccaggccaagaggatcatctacttcaatgacacagcccaggtgttcatgagcaccttcctggatggcagcgccagccacctgatcctgccccgcatcccctttgctgatgtgaagagctttgcctgtgagaacaatgacttcctggtgacagatggcaaggtgatcttccagcaggatgccctgtccttcaatgagttcatcgtgggctgtgacctgagccacatcgaggagtttggatttggaaacctggtgatcttcggcagcagcagccagctgcaccccctgcccggccggccccaggagctgtctgtgctgtttggcagccaccaggccctggtgcagtggaagcccccagccctggccatcggggccagccccagcgcctggcagaactggacctatgaggtgaaggtgtccacccaggaccccccagaggtgacccacatcttcctgaacatcagcggcaccatgctgaatgtgcctgagctgcagagcgccatgaagtacaaggtgtctgtgcgggccagcagccccaagaggcctggcccctggagcgagcccagcgtgggcaccaccctggtgcctgccagcgagccccccttcatcatggctgtgaaggaggatggcctgtggagcaagcccctgaacagctttggacctggagagttcctgagcagtgacattggaaatgtgtctgacatggactggtacaacaacagcctgtactacagcgacaccaagggagatgtgtttgtgtggctgctgaatggaacagacatcagcgagaactaccacctgcccagcattgctggagctggggccctggcctttgagtggctgggccacttcctgtactgggccggcaagacctacgtgatccagaggcagagcgtgctgaccggccacacagacatcgtgacccacgtgaagctgctggtgaatgacatggtggtggacagcgtgggcggctacctgtactggaccaccctgtacagcgtggagagcacccggctgaatggagagagcagcctggtgctgcagacccagccctggttcagcggcaagaaggtgattgccctgaccctggacctgagtgatggcctgctgtactggctggtgcaggacagccagtgcatccacctgtacacagctgtgctgcggggccagagcactggagacaccaccatcacagaatttgctgcctggagcaccagcgagatcagccagaatgccctgatgtactacagcggccgcctcttctggatcaatggcttccgcatcatcaccacccaggagatcggccagaagacctctgtgtctgtgctggagcccgcccgcttcaaccagttcaccatcatccagaccagcctgaagcccctgcccggcaacttctccttcacccccaaggtgatcccagattctgtgcaggagagcagcttcagaattgagggcaatgccagcagcttccagatcctgtggaatggacctcctgctgtggactggggcgtggtgttctacagcgtggagttcagcgcccacagcaagttcctggccagcgagcagcacagcctgcccgtcttcaccgtggagggcctggagccctatgccctcttcaacctgtctgtgaccccctacacctactggggcaagggccccaagaccagcctgagcctgcgggcccctgagaccgtgcccagcgcccctgagaacccccgcatcttcatcctgcccagcggcaagtgctgcaacaagaatgaggtggtggtggagttccgctggaacaagcccaagcatgaaaatggagtgctgaccaagtttgagatcttctacaacatcagcaaccagagcatcaccaacaagacctgtgaggactggattgctgtgaatgtgacccccagcgtgatgtccttccagctggagggcatgagcccccgctgcttcatcgccttccaggtgcgggccttcaccagcaaaggacctggcccctatgcagatgtggtgaagagcaccaccagcgagatcaaccccttcccccacctgatcaccctgctgggcaacaagatcgtgttcctggacatggaccagaaccaggtggtgtggaccttctctgctgagagggtcatctctgctgtgtgctacacagctgacaatgagatgggctactatgcagagggggacagcctcttcctgctgcacctgcacaacagaagcagcagcgagctgttccaggacagcctggtgtttgacatcaccgtcatcaccatcgactggatcagccgccacctgtactttgccctgaaggagagccagaatggcatgcaggtgtttgatgtggacctggagcacaaggtgaagtacccccgggaggtgaagatccacaacagaaacagcaccatcatctccttctctgtgtaccccctgctgagccggctgtactggacagaggtgagcaactttggctaccagatgttctactacagcatcatcagccacaccctgcaccgcatcctgcagcccacagccaccaaccagcagaacaagaggaaccagtgcagctgcaatgtgacagaatttgagctgagcggggccatggccatcgacaccagcaacctggagaagcccctcatctactttgccaaggcccaggagatctgggccatggacctggagggctgccagtgctggagggtcatcaccgtgcctgccatgctgggcaagaccctggtgtccctgactgtggatggagacctgatctactggatcatcacagccaaggacagcacccagatctaccaggccaagaagggaaatggagccatcgtgtcccaggtgaaggccctgcggagccgccacatcctggcctacagctctgtgatgcagcccttcccagacaaggccttcctgagcctggccagtgacacagtggagcccaccatcctgaatgccaccaacaccagcctgaccatccggctgcccctggccaagaccaacctgacctggtacggcatcaccagccccacccccacctacctggtgtactatgcagaggtgaatgacaggaagaacagcagtgacctgaagtaccgcatcctggagttccaggacagcatcgccctgattgaggacctgcagcccttcagcacctacatgatccagattgctgtgaagaactactacagcgaccccctggagcacctgcccccaggcaaggagatctggggcaagaccaagaatggagtgcctgaggccgtgcagctgatcaacaccaccgtgcggagtgacaccagcctcatcatctcctggagggagagccacaagcccaacggccccaaggagagcgtgcgctaccagctggccatcagccacctggccctgatccctgagacccccctgcggcagagcgagttccccaacggccgcctgaccctgctggtgacccggctgagcggcggcaacatctacgtgctgaaggtgctggcctgccacagcgaggagatgtggtgcacagagagccaccctgtgacagtggagatgttcaacaccccagagaagccctacagcctggtgcctgagaacaccagcctgcagttcaactggaaggcccccctgaatgtgaacctgatccgcttctgggtggagctgcagaagtggaagtacaatgagttctaccacgtgaagaccagctgcagccagggccctgcctacgtgtgcaacatcaccaacctgcagccctacaccagctacaacgtgcgggtggtggtggtgtacaagacaggagagaacagcaccagcctgcctgagagcttcaagaccaaggccggcgtgcccaacaagccaggcatccccaagctgctggagggcagcaagaacagcatccagtgggagaaggcagaagataatggctgccgcatcacctactacatcctggagatcaggaagagcaccagcaacaacctgcagaaccagaacctgcgctggaagatgaccttcaacggcagctgcagctctgtgtgcacctggaagagcaagaacctgaagggcatcttccagttccgggtggtggccgccaacaacctgggctttggagagtacagcggcatcagcgagaacatcatcctggtgggagatgacttctggatccctgagaccagcttcatcctgaccatcatcgtgggcatcttcctggtggtgaccatccccctgacctttgtgtggcaccggcggctgaagaaccagaagagcgccaaggagggcgtgacagtgctgatcaatgaagacaaggagctggccgagctgcggggcctggccgccggcgtgggcctggccaatgcctgctacgccatccacaccctgcccacccaggaggagattgagaacctgcctgccttcccccgggagaagctgaccctgcggctgctgctgggcagcggggccttcggggaggtgtatgagggcacagctgtggacatcctgggcgtgggcagcggggagatcaaggtggccgtgaagaccctgaagaagggcagcacagaccaggagaagattgagttcctgaaggaggcccacctgatgagcaagttcaaccaccccaacatcctgaagcagctgggcgtgtgcctgctgaatgagccccagtacatcatcctggagctgatggagggcggggacctgctgacctacctgaggaaggccaggatggccaccttctacggccccctgctgaccctggtggacctggtggacctgtgtgtggacatcagcaagggctgtgtgtacctggagaggatgcacttcatccaccgggacctggccgccaggaactgcctggtgtctgtgaaggactacaccagccccagaattgtgaagatcggggactttggcctggcccgggacatctacaagaatgactactacaggaagagaggagagggcctgctgcctgtgcgctggatggcccctgagagcctgatggatggcatcttcaccacccagagtgatgtgtggagctttggcatcctgatctgggagatcctgaccctgggccaccagccctacccagcccacagcaacctggatgtgctgaactacgtgcagacaggaggccgcctggagccccccaggaactgcccagatgacctgtggaacctgatgacccagtgctgggcccaggagccagaccagaggcccaccttccaccgcatccaggaccagctgcagctgttcaggaacttcttcctgaacagcatctacaagagcagagatgaggccaacaacagcggggtcatcaatgaaagctttgaaggagaagatggagatgtgatctgcctgaacagtgatgacatcatgcctgtggccctgatggagaccaagaaccgggagggcctgaactacatggtgctggccacagaatgtggccagggcgaggagaagtctgagggccccctgggcagccaggagagcgagagctgtggcctgaggaaggaggagaaggagccccatgctgacaaggacttctgccaggagaagcaggtggcctactgccccagcggcaagccagagggcctgaactatgcctgcctgacccacagcggctatggagatggcagtgactag

SEQ ID NO: 148565 - DNA, 7044 bp, Artificial Sequence
  Description of Artificial Sequence: Synthetic coding sequence
atgaagaacatctactgcctgatccccaagctggtgaactttgccaccctgggctgcctgtggatctctgtggtgcagtgcaccgtgctgaacagctgcctgaagagctgtgtgaccaacctgggccagcagctggacctgggcaccccccacaacctgtctgagccctgcatccagggctgccacttctggaacagcgtggaccagaagaactgtgccctgaagtgccgggagagctgtgaggtgggctgcagcagcgctgagggcgcctatgaggaggaggtgctggagaatgctgacctgcccacagccccctttgccagcagcatcggcagccacaacatgaccctgcgctggaagagcgccaacttctctggagtgaagtacatcatccagtggaagtatgcccagctgctgggctcctggacctacaccaagacagtgtcccggcccagctatgtggtgaagcccctgcaccccttcacagagtacatcttccgggtggtgtggatcttcaccgcccagctgcagctgtacagcccccccagccccagctaccgcacccacccccatggagtgcctgagacagcccccctcatcagaaatattgagagcagcagcccagacacagtggaggtgtcctgggaccccccccagtttcctgggggccccatcctgggctacaacctgcggctcatcagcaagaaccagaagctggatgctggcacccagaggaccagcttccagttctacagcaccctgcccaacaccatctaccgcttcagcattgctgctgtgaatgaggtgggggagggccctgaggccgagagcagcatcaccaccagcagcagcgctgtgcagcaggaggagcagtggctgttcctgagcaggaagaccagcctgaggaagaggagcctgaagcacctggtggatgaggcccactgcctgcggctggatgccatctaccacaacatcaccggcatctctgtggatgtgcaccagcagatcgtgtacttcagcgagggcaccctcatctgggccaagaaggccgccaacatgtctgatgtgtctgacctgcgcatcttctaccggggcagcggcctcatcagcagcatcagcattgactggctgtaccagaggatgtacttcatcatggatgagctggtgtgtgtgtgtgacctggagaactgcagcaacatcgaggagatcaccccacccagcatcagcgccccccagaagatcgtggccgacagctacaacggctacgtgttctacctgctgagagatggcatctacagagctgacctgcctgtgcccagcggccgctgtgccgaggccgtgagaattgtggagagctgcaccctgaaggactttgccatcaagccccaggccaagaggatcatctacttcaatgacacagcccaggtgttcatgagcaccttcctggatggcagcgccagccacctgatcctgccccgcatcccctttgctgatgtgaagagctttgcctgtgaaaataatgacttcctggtgacagatggcaaggtgatcttccagcaggatgccctgtccttcaatgagttcatcgtgggctgtgacctgagccacatcgaggagtttggcttcggcaacctggtgatcttcggcagcagcagccagctgcaccccctgcccggccggccccaggagctgtctgtgctgtttggcagccaccaggccctggtgcagtggaagcccccagccctggccatcggggccaacgtcatcctgatcagtgacatcatcgagctgtttgagctgggccccagcgcctggcagaactggacctatgaggtgaaggtgtccacccaggaccccccagaggtgacccacatcttcctgaacatcagcggcaccatgctgaatgtgcctgagctgcagagcgccatgaagtacaaggtgtctgtgcgggccagcagccccaagaggcctggcccctggagcgagcccagcgtgggcaccaccctggtgcctgccagcgagccccccttcatcatggctgtgaaggaggatggcctgtggagcaagcccctgaacagctttggacctggagagttcctgagcagtgacattggaaatgtgtctgacatggactggtacaacaacagcctgtactacagcgacaccaagggagatgtgtttgtgtggctgctgaatggaacagacatcagcgagaactaccacctgcccagcattgctggggccggggccctggcctttgagtggctgggccacttcctgtactgggccggcaagacctacgtgatccagaggcagagcgtgctgaccggccacacagacatcgtgacccacgtgaagctgctggtgaatgacatggtggtggacagcgtgggcggctacctgtactggaccaccctgtacagcgtggagagcacccggctgaatggagagagcagcctggtgctgcagacccagccctggttcagcggcaagaaggtgattgccctgaccctggacctgagtgatggcctgctgtactggctggtgcaggacagccagtgcatccacctgtacacagctgtgctgcggggccagagcactggagacaccaccatcacagaatttgctgcctggagcaccagcgagatcagccagaatgccctgatgtactacagcggccgcctcttctggatcaatggcttccgcatcatcaccacccaggagatcggccagaagacctctgtgtctgtgctggagcccgcccgcttcaaccagttcaccatcatccagaccagcctgaagcccctgcccggcaacttctccttcacccccaaggtgatcccagacagcgtgcaggagagcagcttccgcatcgagggcaatgccagcagcttccagatcctgtggaatggccccccagctgtggactggggcgtggtgttctacagcgtggagttcagcgcccacagcaagttcctggccagcgagcagcacagcctgcctgtgttcaccgtggagggcctggagccctatgccctcttcaacctgtctgtgaccccctacacctactggggcaagggccccaagaccagcctgagcctgcgggcccctgagaccgtgcccagcgcccctgagaacccccgcatcttcatcctgcccagcggcaagtgctgcaacaagaatgaggtggtggtggagttccgctggaacaagcccaagcatgaaaatggagtgctgaccaagtttgagatcttctacaacatcagcaaccagagcatcaccaacaagacctgtgaggactggattgctgtgaatgtgaccccatctgtgatgtccttccagctggagggcatgagcccccgctgcttcatcgccttccaggtgcgggccttcaccagcaagggccctggcccctatgcagatgtggtgaagagcaccaccagcgagatcaaccccttcccccacctgatcaccctgctgggcaacaagatcgtgttcctggacatggaccagaaccaggtggtgtggaccttctctgctgagagggtcatctctgctgtgtgctacacagctgacaatgagatgggctactatgcagagggggacagcctcttcctgctgcacctgcacaacagaagcagcagcgagctgttccaggacagcctggtgtttgacatcaccgtcatcaccatcgactggatcagccgccacctgtactttgccctgaaggagagccagaatggcatgcaggtgtttgatgtggacctggagcacaaggtgaagtacccccgggaggtgaagatccacaacagaaacagcaccatcatctccttctctgtgtaccccctgctgagccggctgtactggacagaggtgagcaactttggctaccagatgttctactacagcatcatcagccacaccctgcaccgcatcctgcagcccacagccaccaaccagcagaacaagaggaaccagtgcagctgcaatgtgacagaatttgagctgagcggggccatggccatcgacaccagcaacctggagaagcccctcatctactttgccaaggcccaggagatctgggccatggacctggagggctgccagtgctggagggtcatcaccgtgcctgccatgctggccggcaagaccctggtgtccctgactgtggatggagacctgatctactggatcatcacagccaaggacagcacccagatctaccaggccaagaagggaaatggagccatcgtgtcccaggtgaaggccctgcggagccgccacatcctggcctacagctctgtgatgcagcccttcccagacaaggccttcctgagcctggccagtgacacagtggagcccaccatcctgaatgccaccaacaccagcctgaccatccggctgcccctggccaagaccaacctgacctggtacggcatcaccagccccacccccacctacctggtgtactatgcagaggtgaatgacaggaagaacagcagtgacctgaagtaccgcatcctggagttccaggacagcatcgccctgattgaggacctgcagcccttcagcacctacatgatccagattgctgtgaagaactactacagcgaccccctggagcacctgcccccaggcaaggagatctggggcaagaccaagaatggagtgcctgaggccgtgcagctgatcaacaccaccgtgcggagtgacaccagcctcatcatctcctggagggagagccacaagcccaacggccccaaggagagcgtgcgctaccagctggccatcagccacctggccctgatccctgagacccccctgcggcagagcgagttccccaacggccgcctgaccctgctggtgacccggctgagcggcggcaacatctacgtgctgaaggtgctggcctgccacagcgaggagatgtggtgcacagagagccaccctgtgacagtggagatgttcaacaccccagagaagccctacagcctggtgcctgagaacaccagcctgcagttcaactggaaggcccccctgaatgtgaacctgatccgcttctgggtggagctgcagaagtggaagtacaatgagttctaccacgtgaagaccagctgcagccagggccctgcctacgtgtgcaacatcaccaacctgcagccctacaccagctacaacgtgcgggtggtggtggtgtacaagacaggagagaacagcaccagcctgcctgagagcttcaagaccaaggccggcgtgcccaacaagccaggcatccccaagctgctggagggcagcaagaacagcatccagtgggagaaggcagaagataatggctgccgcatcacctactacatcctggagatcaggaagagcaccagcaacaacctgcagaaccagaacctgcgctggaagatgaccttcaacggcagctgcagctctgtgtgcacctggaagagcaagaacctgaagggcatcttccagttccgggtggtggccgccaacaacctgggctttggagagtacagcggcatcagcgagaacatcatcctggtgggagatgacttctggatccctgagaccagcttcatcctgaccatcatcgtgggcatcttcctggtggtgaccatccccctgacctttgtgtggcaccggcggctgaagaaccagaagagcgccaaggagggcgtgacagtgctgatcaatgaagacaaggagctggccgagctgcggggcctggccgccggcgtgggcctggccaatgcctgctacgccatccacaccctgcccacccaggaggagattgagaacctgcctgccttcccccgggagaagctgaccctgcggctgctgctgggcagcggggccttcggggaggtgtatgagggcacagctgtggacatcctgggcgtgggcagcggggagatcaaggtggccgtgaagaccctgaagaagggcagcacagaccaggagaagattgagttcctgaaggaggcccacctgatgagcaagttcaaccaccccaacatcctgaagcagctgggcgtgtgcctgctgaatgagccccagtacatcatcctggagctgatggagggcggggacctgctgacctacctgaggaaggccaggatggccaccttctacggccccctgctgaccctggtggacctggtggacctgtgtgtggacatcagcaagggctgtgtgtacctggagaggatgcacttcatccaccgggacctggccgccaggaactgcctggtgtctgtgaaggactacaccagccccagaattgtgaagatcggggactttggcctggcccgggacatctacaagaatgactactacaggaagagaggagagggcctgctgcctgtgcgctggatggcccctgagagcctgatggatggcatcttcaccacccagagtgatgtgtggagctttggcatcctgatctgggagatcctgaccctgggccaccagccctacccagcccacagcaacctggatgtgctgaactacgtgcagacaggaggccgcctggagccccccaggaactgcccagatgacctgtggaacctgatgacccagtgctgggcccaggagccagaccagaggcccaccttccaccgcatccaggaccagctgcagctgttcaggaacttcttcctgaacagcatctacaagagcagagatgaggccaacaacagcggggtcatcaatgaaagctttgaaggagaagatggagatgtgatctgcctgaacagtgatgacatcatgcctgtggccctgatggagaccaagaaccgggagggcctgaactacatggtgctggccacagaatgtggccagggcgaggagaagtctgagggccccctgggcagccaggagagcgagagctgtggcctgaggaaggaggagaaggagccccatgctgacaaggacttctgccaggagaagcaggtggcctactgccccagcggcaagccagagggcctgaactatgcctgcctgacccacagcggctatggagatggcagtgactag

SEQ ID NO: 148566 - DNA, 294 bp, Artificial Sequence
  Description of Artificial Sequence: Synthetic coding sequence
tggaagtacaatgagttctaccacgtgaagaccagctgcagccagggccctgcctacgtgtgcaacatcaccaacctgcagccctacaccagctacaacgtgcgggtggtggtggtgtacaagacaggagagaacagcaccagcctgcctgagagcttcaagaccaaggccggcgtgcccaacaagccaggcatccccaagctgctggagggcagcaagaacagcatccagtgggagaaggccgaggacaatggctgccgcatcacctactacatcctggagatccgggactag

SEQ ID NO: 148567 - DNA, 2025 bp, Artificial Sequence
  Description of Artificial Sequence: Synthetic coding sequence
atgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgaaaaaggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagagcaacccctgccacaatggaggagtgtgccacagccgctgggatgacttcagctgcagctgcccagccctgaccagcggcaaggcctgtgaggaggtgcagtggtgtggcttcagcccctgcccccacggggcccagtgccagcctgtgctgcagggctttgagtgcatcgccaatgctgtgttcaacggccagagcggccagatcctcttccgcagcaatggaaacatcacccgggagctgaccaacatcaccttcggcttccgcaccagagatgccaacgtcatcatcctgcatgctgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccattgaaattggaggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcatggaggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaacggggccacctgcatcagccacaccaacggctacagctgcctgtgcttcggcaacttcaccgggaagttctgccggcagagccggctgcccagcacagtgtgtggaaatgagaagaccaacctgacctgctacaatggaggcaactgcacagagttccagacagagctgaagtgcatgtgccggcccggcttcaccggggagtggtag

SEQ ID NO: 148568 - DNA, 4221 bp, Artificial Sequence
  Description of Artificial Sequence: Synthetic coding sequence
atggccctgaagaacatcaactacctgctgatcttctacctgtccttcagcctgctgatctacatcaagaacagcttctgcaacaagaacaacacccgctgcctgagcaacagctgccagaacaacagcacctgcaaggacttcagcaaggacaatgactgcagctgcagcgacacagccaacaacctggacaaggactgtgacaacatgaaggacccctgcttcagcaacccctgccagggcagcgccacctgtgtgaacaccccaggagagaggagcttcctgtgcaagtgccccccaggctacagcggcaccatctgtgagaccaccatcggcagctgtgggaagaacagctgccagcacggcggcatctgccaccaggaccccatctaccctgtgtgcatctgcccagctggctacgccggccgcttctgtgaaattgaccatgatgaatgtgccagcagcccctgccagaatggagctgtgtgccaggacggcattgatggctacagctgcttctgtgtgcccggctaccagggccgccactgtgacctggaggtggatgaatgtgccagtgacccctgcaagaatgaggccacctgcctgaatgaaattggccgctacacctgcatctgcccccacaactacagcggcgtgaactgtgagctggagattgatgagtgctggagccagccctgcctgaatggagccacctgccaggatgccctgggcgcctacttctgtgactgtgcccctggcttcctgggggaccactgtgagctgaacacagatgaatgtgccagccagccctgcctgcatggaggcctgtgtgtggatggagaaaatcgctacagctgcaactgcaccggcagcggcttcaccggcacccactgtgagaccctgatgcccctgtgctggagcaagccctgccacaacaatgccacctgtgaagattctgtggacaactacacctgccactgctggccaggctacaccggggcccagtgtgaaattgacctgaatgaatgcaacagcaacccctgccagagcaatggagaatgtgtggagctgagcagcgagaagcagtatggccgcatcaccggcctgcccagcagcttctcctaccacgaggccagcggctacgtgtgcatctgccagcccggcttcaccggcatccactgtgaggaggatgtgaatgaatgtagcagcaacccctgccagaatggaggcacctgtgagaacctgcccggcaactacacctgccactgcccctttgacaacctgagcaggaccttctatggaggccgggactgcagcgacatcctgctgggctgcacccaccagcagtgcctgaacaacggcacctgcatcccccacttccaggacggccagcacggcttcagctgcctgtgccccagcggctacacaggcagcctgtgtgagatcgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgagaagggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagagcaacccctgccacaacggcggcgtgtgccacagccgctgggatgacttcagctgcagctgcccagccctgaccagcggcaaggcctgtgaggaggtgcagtggtgtggcttcagcccctgcccccatggagcccagtgccagcctgtgctgcagggctttgaatgtattgccaatgctgtgttcaacggccagagcggccagatcctcttccgcagcaatggaaacatcacccgggagctgaccaacatcaccttcggcttccgcaccagagatgccaacgtcatcatcctgcacgccgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccatcgagatcggcggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcacggcggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaatggagccacctgcatcagccacaccaacggctacagctgcctgtgctttggaaacttcaccgggaagttctgccggcagagccggctgcccagcacagtgtgtggaaatgagaagaccaacctgacctgctacaacggcggcaactgcacagagttccagacagagctgaagtgcatgtgcaggcctggcttcaccggggagtggtgtgagaaggacattgatgaatgtgccagtgacccctgtgtgaatggaggcctgtgccaggacctgctgaacaagttccagtgcctgtgtgatgtggcctttgctggggagcgctgtgaggtggacctggctgatgacctgatcagtgacatcttcaccaccatcggctctgtgacagtggccctgctgctgatcctgctgctggccatcgtggcctctgtggtgaccagcaacaagagggccacccagggcacctacagccccagccggcaggagaaggagggcagccgggtggagatgtggaacctgatgcctcctccagccatggagcggctcatctag

SEQ ID NO: 148569 - DNA, 2826 bp, Artificial Sequence
  Description of Artificial Sequence: Synthetic coding sequence
atgatccggaacagcctgtgccagcccagccgctgcctggatggctacctgttcttcaacaggaagatgtttggagcccggacccacggcttccacatcctgatggccatgctgattggcatccactgtgaagaagatgtgaatgaatgtagcagcaacccctgccagaatggaggcacctgtgagaacctgcccggcaactacacctgccactgcccctttgacaacctgagcaggaccttctacggcggccgggactgcagcgacatcctgctgggctgcacccaccagcagtgcctgaacaacggcacctgcatcccccacttccaggacggccagcacggcttcagctgcctgtgccccagcggctacacaggcagcctgtgtgaaattgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgaaaaaggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagagcaacccctgccacaatggaggagtgtgccacagccgctgggatgacttcagctgcagctgcccagccctgaccagcggcaaggcctgtgaggaggtgcagtggtgtggcttcagcccctgcccccacggggcccagtgccagcctgtgctgcagggctttgagtgcatcgccaatgctgtgttcaacggccagagcggccagatcctcttccgcagcaatggaaacatcacccgggagctgaccaacatcaccttcggcttccgcaccagagatgccaacgtcatcatcctgcatgctgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccattgaaattggaggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcatggaggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaacggggccacctgcatcagccacaccaacggctacagctgcctgtgcttcggcaacttcaccgggaagttctgccggcagagccggctgcccagcacagtgtgtggaaatgagaagaccaacctgacctgctacaatggaggcaactgcacagagttccagacagagctgaagtgcatgtgccggcccggcttcaccggggagtag

SEQ ID NO: 148570 - DNA, 129 bp, Artificial Sequence
  Description of Artificial Sequence: Synthetic coding sequence
gagaaggacattgatgaatgtgccagtgacccctgtgtgaatggaggcctgtgccaggacctgctgaacaagttccagtgcctgtgtgatgtggcctttgctggggagcgctgtgaggtggactactag

SEQ ID NO: 148571 - DNA, 4149 bp, Artificial Sequence
  Description of Artificial Sequence: Synthetic coding sequence
atgaaggacccctgcttcagcaacccctgccagggcagcgccacctgtgtgaacaccccaggagagaggagcttcctgtgcaagtgccccccaggctacagcggcaccatctgtgagaccaccatcggcagctgtgggaagaacagctgccagcacggcggcatctgccaccaggaccccatctaccctgtgtgcatctgcccagctggctacgccggccgcttctgtgaaattgaccatgatgaatgtgccagcagcccctgccagaatggagctgtgtgccaggacggcattgatggctacagctgcttctgtgtgcccggctaccagggccgccactgtgacctggaggtggatgaatgtgccagtgacccctgcaagaatgaggccacctgcctgaatgagatcggccgctacacctgcatctgcccccacaactacagcggcgtgaactgtgagctggagattgatgagtgctggagccagccctgcctgaatggagccacctgccaggatgccctgggcgcctacttctgtgactgtgcccctggcttcctgggggaccactgtgagctgaacacagatgaatgtgccagccagccctgcctgcacggcggcctgtgtgtggatggagagaaccgctacagctgcaactgcaccggcagcggcttcaccggcacccactgtgagaccctgatgcccctgtgctggagcaagccctgccacaacaatgccacctgtgaggacagcgtggacaactacacctgccactgctggccaggctacacaggagcccagtgtgaaattgacctgaatgaatgcaacagcaacccctgccagagcaatggagaatgtgtggagctgagcagcgagaagcagtatggccgcatcaccggcctgcccagcagcttctcctaccacgaggccagcggctacgtgtgcatctgccagcccggcttcaccggcatccactgtgaagaagatgtgaatgaatgtagcagcaacccctgccagaatggaggcacctgtgagaacctgcccggcaactacacctgccactgcccctttgacaacctgagcaggaccttctacggcggccgggactgcagcgacatcctgctgggctgcacccaccagcagtgcctgaacaacggcacctgcatcccccacttccaggacggccagcacggcttcagctgcctgtgccccagcggctacacaggcagcctgtgtgaaattgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgaaaaaggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagaggcagaccaacgtgggccgggccctgacagagctgggcagccggggccccaagtaccaggtgtccctcttccgcttctgtgtgggctcctgggccaccggcaacaccttcttcctgagcagcatcaagccaggcagcaacccctgccacaacggcggcgtgtgccacagccgctgggatgacttcagctgcagctgcccagccctgaccagcggcaaggcctgtgaggaggtgcagtggtgtggcttcagcccctgcccccatggagcccagtgccagcctgtgctgcagggctttgaatgtattgccaatgctgtgttcaacggccagagcggccagatcctcttccgcagcaatggaaacatcacccgggagctgaccaacatcaccttcggcttccgcaccagagatgccaacgtcatcatcctgcacgccgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccatcgagatcggcggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcacggcggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaatggagccacctgcatcagccacaccaacggctacagctgcctgtgctttggaaacttcaccgggaagttctgccggcagagccggctgcccagcacagtgtgtggaaatgagaagaccaacctgacctgctacaacggcggcaactgcacagagttccagacagagctgaagtgcatgtgcaggcctggcttcaccggggagtggtgtgagaaggacattgatgaatgtgccagtgacccctgtgtgaatggaggcctgtgccaggacctgctgaacaagttccagtgcctgtgtgatgtggcctttgctggggagcgctgtgaggtggacctggctgatgacctgatcagtgacatcttcaccaccatcggctctgtgacagtggccctgctgctgatcctgctgctggccatcgtggcctctgtggtgaccagcaacaagagggccacccagggcacctacagccccagccggcaggagaaggagggcagccgggtggagatgtggaacctgatgcctcctccagccatggagcggctcatctag

SEQ ID NO: 148572 - DNA, 2613 bp, Artificial Sequence
  Description of Artificial Sequence: Synthetic coding sequence
atggccctgaagaacatcaactacctgctgatcttctacctgtccttcagcctgctgatctacatcaagaacagcttctgcaacaagaacaacacccgctgcctgagcaacagctgccagaacaacagcacctgcaaggacttcagcaaggacaatgactgcagctgcagcgacacagccaacaacctggacaaggactgtgacaacatgaaggacccctgcttcagcaacccctgccagggcagcgccacctgtgtgaacaccccaggagagaggagcttcctgtgcaagtgccccccaggctacagcggcaccatctgtgagaccaccatcggcagctgtgggaagaacagctgccagcacggcggcatctgccaccaggaccccatctaccctgtgtgcatctgcccagctggctacgccggccgcttctgtgaaattgaccatgatgaatgtgccagcagcccctgccagaatggagctgtgtgccaggacggcattgatggctacagctgcttctgtgtgcccggctaccagggccgccactgtgacctggaggtggatgaatgtgccagtgacccctgcaagaatgaggccacctgcctgaatgaaattggccgctacacctgcatctgcccccacaactacagcggcgtgaactgtgagctggagattgatgagtgctggagccagccctgcctgaatggagccacctgccaggatgccctgggcgcctacttctgtgactgtgcccctggcttcctgggggaccactgtgagctgaacacagatgaatgtgccagccagccctgcctgcatggaggcctgtgtgtggatggagaaaatcgctacagctgcaactgcaccggcagcggcttcaccggcacccactgtgagaccctgatgcccctgtgctggagcaagccctgccacaacaatgccacctgtgaagattctgtggacaactacacctgccactgctggccaggctacaccggggcccagtgtgaaattgacctgaatgaatgcaacagcaacccctgccagagcaatggagaatgtgtggagctgagcagcgagaagcagtatggccgcatcaccggcctgcccagcagcttctcctaccacgaggccagcggctacgtgtgcatctgccagcccggcttcaccggcatccactgtgaggaggatgtgaatgaatgtagcagcaacccctgccagaatggaggcacctgtgagaacctgcccggcaactacacctgccactgcccctttgacaacctgagcaggaccttctatggaggccgggactgcagcgacatcctgctgggctgcacccaccagcagtgcctgaacaacggcacctgcatcccccacttccaggacggccagcacggcttcagctgcctgtgccccagcggctacacaggcagcctgtgtgagatcgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcggggcaagttctgccggcagagccggctgcccagcacagtgtgtggaaatgagaagaccaacctgacctgctacaacggcggcaactgcacagagttccagacagagctgaagtgcatgtgcaggcctggcttcaccggggagtggtgtgagaaggacattgatgaatgtgccagtgacccctgtgtgaatggaggcctgtgccaggacctgctgaacaagttccagtgcctgtgtgatgtggcctttgctggggagcgctgtgaggtggacctggctgatgacctgatcagtgacatcttcaccaccatcggctctgtgacagtggccctgctgctgatcctgctgctggccatcgtggcctctgtggtgaccagcaacaagagggccacccagggcacctacagccccagccggcaggagaaggagggcagccgggtggagatgtggaacctgatgcctcctccagccatggagcggctcatctag

SEQ ID NO: 148573 - DNA, 882 bp, Artificial Sequence
  Description of Artificial Sequence: Synthetic coding sequence
atgcccctgtgctggagcaagccctgccacaacaatgccacctgtgaggacagcgtggacaactacacctgccactgctggccaggctacacaggagcccagtgtgaaattgacctgaatgaatgcaacagcaacccctgccagagcaatggagaatgtgtggagctgagcagcgagaagcagtatggccgcatcaccggcctgcccagcagcttctcctaccacgaggccagcggctacgtgtgcatctgccagcccggcttcaccggcatccactgtgaagaagatgtgaatgaatgtagcagcaacccctgccagaatggaggcacctgtgagaacctgcccggcaactacacctgccactgcccctttgacaacctgagcaggaccttctacggcggccgggactgcagcgacatcctgctgggctgcacccaccagcagtgcctgaacaacggcacctgcatcccccacttccaggacggccagcacggcttcagctgcctgtgccccagcggctacacaggcagcctgtgtgaaattgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggccgtgtccaagaccctgaagctgattggcatcaccctgccctggaggaccagccggctggcccaccactag

SEQ ID NO: 148574 - DNA, 2664 bp, Artificial Sequence
  Description of Artificial Sequence: Synthetic coding sequence
atggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgaaaaaggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagagcaacccctgccacaatggaggagtgtgccacagccgctgggatgacttcagctgcagctgcccagccctgaccagcggcaaggcctgtgaggaggtgcagtggtgtggcttcagcccctgcccccacggggcccagtgccagcctgtgctgcagggctttgagtgcatcgccaatgctgtgttcaacggccagagcggccagatcctcttccgcagcaatggaaacatcacccgggagctgaccaacatcaccttcggcttccgcaccagagatgccaacgtcatcatcctgcatgctgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccattgaaattggaggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcatggaggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaacggggccacctgcatcagccacaccaacggctacagctgcctgtgcttcggcaacttcaccgggaagttctgccggcagagccggctgcccagcacagtgtgtggaaatgagaagaccaacctgacctgctacaatggaggcaactgcacagagttccagacagagctgaagtgcatgtgccggcccggcttcaccggggagtggtgtgagaaggacattgatgaatgtgccagtgacccctgtgtgaatggaggcctgtgccaggacctgctgaacaagttccagtgcctgtgtgatgtggcctttgctggggagcgctgtgaggtggacctggctgatgacctgatcagtgacatcttcaccaccatcggctctgtgacagtggccctgctgctgatcctgctgctggccatcgtggcctctgtggtgaccagcaacaagagggccacccagggcacctacagccccagccggcaggagaaggagggcagccgggtggagatgtggaacctgatgcctcctccagccatggagcggctcatctag

SEQ ID NO: 148575 - DNA, 3885 bp, Artificial Sequence
  Description of Artificial Sequence: Synthetic coding sequence
atggccctgaagaacatcaactacctgctgatcttctacctgtccttcagcctgctgatctacatcaagaacagcttctgcaacaagaacaacacccgctgcctgagcaacagctgccagaacaacagcacctgcaaggacttcagcaaggacaatgactgcagctgcagcgacacagccaacaacctggacaaggactgtgacaacatgaaggacccctgcttcagcaacccctgccagggcagcgccacctgtgtgaacaccccaggagagaggagcttcctgtgcaagtgccccccaggctacagcggcaccatctgtgagaccaccatcggcagctgtgggaagaacagctgccagcacggcggcatctgccaccaggaccccatctaccctgtgtgcatctgcccagctggctacgccggccgcttctgtgaaattgaccatgatgaatgtgccagcagcccctgccagaatggagctgtgtgccaggacggcattgatggctacagctgcttctgtgtgcccggctaccagggccgccactgtgacctggaggtggatgaatgtgccagtgacccctgcaagaatgaggccacctgcctgaatgaaattggccgctacacctgcatctgcccccacaactacagcggctacaccggggcccagtgtgaaattgacctgaatgaatgcaacagcaacccctgccagagcaatggagaatgtgtggagctgagcagcgagaagcagtatggccgcatcaccggcctgcccagcagcttctcctaccacgaggccagcggctacgtgtgcatctgccagcccggcttcaccggcatccactgtgaggaggatgtgaatgaatgtagcagcaacccctgccagaatggaggcacctgtgagaacctgcccggcaactacacctgccactgcccctttgacaacctgagcaggaccttctatggaggccgggactgcagcgacatcctgctgggctgcacccaccagcagtgcctgaacaacggcacctgcatcccccacttccaggacggccagcacggcttcagctgcctgtgccccagcggctacacaggcagcctgtgtgagatcgccaccaccctgagctttgaaggagatggcttcctgtgggtgaagagcggctctgtgaccaccaagggctctgtgtgcaacatcgccctgcgcttccagacagtgcagcccatggccctgctgctcttccgcagcaacagagatgtgtttgtgaagctggagctgctgagcggctacatccacctgagcatccaggtgaacaaccagagcaaggtgctgctcttcatcagccacaacaccagtgatggagagtggcactttgtggaggtgatctttgctgaggccgtgaccctgaccctgattgatgacagctgcaaggagaagtgcatcgccaaggcccccacccccctggagagtgaccagagcatctgtgccttccagaacagcttcctgggcggcctgcctgtgggcatgaccagcaatggagtggccctgctgaacttctacaacatgcccagcacccccagctttgtgggctgcctgcaggacatcaagattgactggaaccacatcaccctggagaacatcagcagcggcagcagcctgaatgtgaaggccggctgtgtgaggaaggactggtgtgagagccagccctgccagagccggggccgctgcatcaacctgtggctgagctaccagtgtgactgccaccggccctatgagggccccaactgcctgcgggagtatgtggccggccgcttcggccaggatgacagcacaggctacgtgatcttcaccctggatgagagctatggagacaccatcagcctgtccatgtttgtgaggaccctgcagcccagcggcctgctgctggccctggagaacagcacctaccagtacatccgggtgtggctggagcggggccgcctggccatgctgacccccaacagccccaagctggtggtgaagtttgtgctgaatgatggaaatgtgcacctgatcagcctgaagatcaagccctacaagattgagctgtaccagagcagccagaacctgggcttcatcagcgccagcacctggaagattgagaagggagatgtgatctacatcggcggcctgcctgacaagcaggagacagagctgaatggaggcttcttcaagggctgcatccaggatgtgcggctgaacaaccagaacctggagttcttccccaaccccaccaacaatgccagcctgaaccctgtgctggtgaatgtgacccagggctgtgccggggacaacagctgcaagagcaacccctgccacaacggcggcgtgtgccacagccgctgggatgacttcagctgcagctgcccagccctgaccagcggcaaggcctgtgaggaggtgcagtggtgtggcttcagcccctgcccccatggagcccagtgccagcctgtgctgcagggctttgaatgtattgccaatgctgtgttcaacggccagagcggccagatcctcttccgcagcaatggaaacatcacccgggagctgaccaacatcaccttcggcttccgcaccagagatgccaacgtcatcatcctgcacgccgagaaggagcctgagttcctgaacatcagcatccaggacagccgcctcttcttccagctgcagagcggcaacagcttctacatgctgagcctgaccagcctgcagagcgtgaatgatggcacctggcatgaggtgaccctgtccatgacagaccccctgagccagaccagccgctggcagatggaggtggacaatgagaccccatttgtgaccagcaccatcgccaccggcagcctgaacttcctgaaggacaacacagacatctacgtgggggaccgggccatcgacaacatcaagggcctgcagggctgcctgagcaccatcgagatcggcggcatctacctgagctactttgaaaatgtgcacggcttcatcaacaagccccaggaggagcagttcctgaagatcagcaccaacagcgtggtgacaggctgcctgcagctgaatgtgtgcaacagcaacccctgcctgcacggcggcaactgtgaggacatctacagcagctaccactgcagctgccccctgggctggagcggcaagcactgtgagctgaacattgatgagtgcttcagcaacccctgcatccacggcaactgcagcgacagagtggccgcctaccactgcacctgtgagcccggctacacaggagtgaactgtgaggtggacatcgacaactgccagagccaccagtgtgccaatggagccacctgcatcagccacaccaacggctacagctgcctgtgctttggaaacttcaccgggaagttctgccggcagagccggctgcccagcacagtgtgtggaaatgagaagaccaacctgacctgctacaacggcggcaactgcacagagttccagacagagctgaagtgcatgtgcaggcctggcttcaccggggagtggtgtgagaaggacattgatgaatgtgccagtgacccctgtgtgaatggaggcctgtgccaggacctgctgaacaagttccagtgcctgtgtgatgtggcctttgctggggagcgctgtgaggtggacctggctgatgacctgatcagtgacatcttcaccaccatcggctctgtgacagtggccctgctgctgatcctgctgctggccatcgtggcctctgtggtgaccagcaacaagagggccacccagggcacctacagccccagccggcaggagaaggagggcagccgggtggagatgtggaacctgatgcctcctccagccatggagcggctcatctag

SEQ ID NO: 148576 - DNA, 3531 bp, Artificial Sequence
  Description of Artificial Sequence: Synthetic coding sequence
atggccctggcccggcccggcaccccagacccccaggccctggcctctgtgctgctgctgctgctgtgggccccagccctgagcctgctggccggcaccgtgcccagcgagccccccagcgcctgtgccagtgacccctgtgcccctggaacagagtgccaggccacagagagcggcggctacacctgtggccccatggagccccggggctgtgccacccagccctgccaccacggggccctgtgtgtgccccagggccctgaccccaccggcttccgctgctactgtgtgcccggcttccagggcccccgctgtgagctggacattgatgaatgtgccagccggccctgccaccacggggccacctgcaggaacctggccgacagatatgagtgccactgccccctgggctacgccggcgtgacctgtgagatggaggtggatgaatgtgccagcgccccctgcctgcatggaggcagctgcctggatggagtgggcagcttccgctgtgtgtgtgcccctggctacggcggcacccgctgccagctggacctggatgagtgccagagccagccctgtgcccatggaggcacctgccacgacctggtgaatggcttccgctgtgactgtgccggcaccggctatgagggcacccactgtgagcgggaggtgctggagtgtgccagcgccccctgtgagcacaatgccagctgcctggagggcctgggcagcttccgctgcctgtgctggccaggctacagcggggagctgtgtgaggtggatgaagatgaatgtgccagcagcccctgccagcacggcggccgctgcctgcagaggagtgaccctgccctgtatggaggagtgcaggccgccttccctggggccttctccttcagacatgctgctggcttcctgtgccactgccccccaggctttgagggcgctgactgtggggtggaggtggatgaatgtgccagccggccctgcctgaatggaggccactgccaggacctgcccaacggcttccagtgccactgcccagatggctacgccggccccacctgtgaagaagatgtggatgaatgtctgagtgacccctgcctgcatggaggcacctgcagcgacacagtggccggctacatctgccgctgcccagagacctggggcggccgggactgcagcgtgcagctgaccggctgccagggccacacctgccccctggccgccacctgcatccccatctttgaaagtggagtgcacagctatgtgtgccactgccccccaggcacccacggccccttctgtggccagaacaccaccttctctgtgatggccggcagccccatccaggcctctgtgcctgctgggggccccctgggcctggccctgcgcttccgcaccaccctgcctgctggcaccctggccaccagaaatgacaccaaggagagcctggagctggccctggtggccgccaccctgcaggccaccctgtggagctacagcaccaccgtgctggtgctgcggctgcctgacctggccctgaatgatggccactggcaccaggtggaggtggtgctgcacctggccaccctggagctgcggctgtggcatgagggctgcccagcccggctgtgtgtggccagcggccctgtggccctggccagcacagccagcgccacccccctgcctgctggcatcagcagcgcccagctgggagatgccacctttgctggctgcctgcaggatgtgcgggtggatggccacctgctgctgcctgaggacctgggagaaaatgtgctgctgggctgtgaaagaagagagcagtgccggcccctgccctgtgtgcacggcggcagctgtgtggacctgtggacccacttccgctgtgactgtgcccggccccaccggggccccacctgtgctgatgagatcccagctgccaccttcggcctgggcggggcccccagcagcgccagcttcctgctgcaggagctgcccggccccaacctgactgtgtccttcctgctgcggacccgggagagcgctggcctgctgctgcagtttgccaatgacagcgctgctggcctgactgtgttcctgtctgagggccgcatccgggcagaggtgcccggcagccctgctgtggtgctgcccggccgctgggatgatggcctgcggcacctggtgatgctgagctttggaccagaccagctgcaggacctgggccagcacgtgcacgtgggcggccgcctgctggccgctgacagccagccctggggcggccccttccggggctgcctgcaggacctgcggctggatggctgccacctgcccttcttccccctgcccctggacaacagcagccagcccagcgagctgggcggccggcagagctggaacctgacagctggctgtgtgtctgaggacatgtgcagcccagacccctgcttcaacggcggcacctgcctggtgacctggaatgacttccactgcacctgcccagccaacttcaccggccccacctgtgcccagcagctgtggtgccccggccagccctgcctgcccccagccacctgtgaggaggtgcctgatggctttgtgtgtgtggccgaggccaccttccgggagggccccccagctgccttcagcggccacaatgccagcagcggccgcctgctgggcggcctgagcctggccttccgcacccgggacagcgaggcctggctgctgcgggctgctgctggggccctggagggcgtgtggctggccgtgagaaatggcagcctggccggcggcgtgcggggcggccacggcctgcccggggctgtgctgcccatccctggcccccgggtggctgatggagcctggcaccgggtgcggctggccatggagaggcctgctgccaccaccagccgctggctgctgtggctggatggagctgccacccctgtggccctgcggggcctggccagtgacctgggcttcctgcagggccctggagctgtgcgcatcctgctggccgagaacttcaccggctgcctgggccgggtggccctgggcggcctgcccctgcccctggcccggcccaggcctggagctgcccctggggcccgggagcactttgcctcctggccaggcaccccagcccccatcctgggctgccgcggggcccctgtgtgtgcccccagcccctgcctgcatgatggagcctgccgggacctgtttgatgcctttgcctgtgcctgtggccctggctgggagggcccccgctgtgaggcccacgtggacccctgccacagcgccccctgtgcccggggccgctgccacacccacccagatggccgctttgaatgtcgctgccccccaggctttggaggcccccgctgccgctgggatggctgggccggcggctgggccgccaatgccccctggggctacggcggcgctgagaagagcgcccggtctgtggatgagagcctgcccttccctggcccccacgtgctgatctgtgacatgagaagaacagtgtag

SEQ ID NO: 148577 - DNA, 2862 bp, Artificial Sequence
  Description of Artificial Sequence: Synthetic coding sequence
atggccatggagcccggggccctgtggaccttcctgggccacctgtggctgctggccggccccacctgtgaagaagatgtggatgaatgtctgagtgacccctgcctgcatggaggcacctgcagcgacacagtggccggctacatctgccgctgcccagagacctggggcggccgggactgcagcgtgcagctgaccggctgccagggccacacctgccccctggccgccacctgcatccccatctttgaaagtggagtgcacagctatgtgtgccactgccccccaggcacccacggccccttctgtggccagaacaccaccttctctgtgatggccggcagccccatccaggcctctgtgcctgctgggggccccctgggcctggccctgcgcttccgcaccaccctgcctgctggcaccctggccaccagaaatgacaccaaggagagcctggagctggccctggtggccgccaccctgcaggccaccctgtggagctacagcaccaccgtgctggtgctgcggctgcctgacctggccctgaatgatggccactggcaccaggtggaggtggtgctgcacctggccaccctggagctgcggctgtggcatgagggctgcccagcccggctgtgtgtggccagcggccctgtggccctggccagcacagccagcgccacccccctgcctgctggcatcagcagcgcccagctgggagatgccacctttgctggctgcctgcaggatgtgcgggtggatggccacctgctgctgcctgaggacctgggagaaaatgtgctgctgggctgtgaaagaagagagcagtgccggcccctgccctgtgtgcacggcggcagctgtgtggacctgtggacccacttccgctgtgactgtgcccggccccaccggggccccacctgtgctgatgagatcccagctgccaccttcggcctgggcggggcccccagcagcgccagcttcctgctgcaggagctgcccggccccaacctgactgtgtccttcctgctgcggacccgggagagcgctggcctgctgctgcagtttgccaatgacagcgctgctggcctgactgtgttcctgtctgagggccgcatccgggcagaggtgcccggcagccctgctgtggtgctgcccggccgctgggatgatggcctgcggcacctggtgatgctgagctttggaccagaccagctgcaggacctgggccagcacgtgcacgtgggcggccgcctgctggccgctgacagccagccctggggcggccccttccggggctgcctgcaggacctgcggctggatggctgccacctgcccttcttccccctgcccctggacaacagcagccagcccagcgagctgggcggccggcagagctggaacctgacagctggctgtgtgtctgaggacatgtgcagcccagacccctgcttcaacggcggcacctgcctggtgacctggaatgacttccactgcacctgcccagccaacttcaccggccccacctgtgcccagcagctgtggtgccccggccagccctgcctgcccccagccacctgtgaggaggtgcctgatggctttgtgtgtgtggccgaggccaccttccgggagggccccccagctgccttcagcggccacaatgccagcagcggccgcctgctgggcggcctgagcctggccttccgcacccgggacagcgaggcctggctgctgcgggctgctgctggggccctggagggcgtgtggctggccgtgagaaatggcagcctggccggcggcgtgcggggcggccacggcctgcccggggctgtgctgcccatccctggcccccgggtggctgatggagcctggcaccgggtgcggctggccatggagaggcctgctgccaccaccagccgctggctgctgtggctggatggagctgccacccctgtggccctgcggggcctggccagtgacctgggcttcctgcagggccctggagctgtgcgcatcctgctggccgagaacttcaccggctgcctgggccgggtggccctgggcggcctgcccctgcccctggcccggcccaggcctggagctgcccctggggcccgggagcactttgcctcctggccaggcaccccagcccccatcctgggctgccgcggggcccctgtgtgtgcccccagcccctgcctgcatgatggagcctgccgggacctgtttgatgcctttgcctgtgcctgtggccctggctgggagggcccccgctgtgaggcccacgtggacccctgccacagcgccccctgtgcccggggccgctgccacacccacccagatggccgctttgaatgtcgctgccccccaggctttggaggcccccgctgccgcctgcctgtgcccagcaaagaatgttccctgaatgtgacctgcctggatggcagcccctgtgagggcggcagccctgctgccaactgcagctgcctggagggcctggccggccagcgctgccaggtgcccaccctgccctgtgaggccaacccctgcctgaatggaggcacctgcagagctgctggaggagtgtctgagtgcatctgcaatgcccgcttcagcggccagttctgtgaggtggccaagggcctgcccctgcccctgcccttccccctgctggaggtggccgtgcctgctgcctgtgcctgcctgctgctgctgctgctgggcctgctgagcggcatcctggccgccaggaagaggcggcagagcgagggcacctacagccccagccagcaggaggtggccggggcccggctggagatggacagcgtgctgaaggtgcccccagaggagcggctcatctag

SEQ ID NO: 148578 - DNA, 3858 bp, Artificial Sequence
  Description of Artificial Sequence: Synthetic coding sequence
atggccctggcccggcccggcaccccagacccccaggccctggcctctgtgctgctgctgctgctgtgggccccagccctgagcctgctggccggcaccgtgcccagcgagccccccagcgcctgtgccagtgacccctgtgcccctggaacagagtgccaggccacagagagcggcggctacacctgtggccccatggagccccggggctgtgccacccagccctgccaccacggggccctgtgtgtgccccagggccctgaccccaccggcttccgctgctactgtgtgcccggcttccagggcccccgctgtgagctggacattgatgaatgtgccagccggccctgccaccacggggccacctgcaggaacctggccgacagatatgagtgccactgccccctgggctacgccggcgtgacctgtgagatggaggtggatgaatgtgccagcgccccctgcctgcatggaggcagctgcctggatggagtgggcagcttccgctgtgtgtgtgcccctggctacggcggcacccgctgccagctggacctggatgagtgccagagccagccctgtgcccatggaggcacctgccacgacctggtgaatggcttccgctgtgactgtgccggcaccggctatgagggcacccactgtgagcgggaggtgctggagtgtgccagcgccccctgtgagcacaatgccagctgcctggagggcctgggcagcttccgctgcctgtgctggccaggctacagcggggagctgtgtgaggtggatgaagatgaatgtgccagcagcccctgccagcacggcggccgctgcctgcagaggagtgaccctgccctgtatggaggagtgcaggccgccttccctggggccttctccttcagacatgctgctggcttcctgtgccactgccccccaggctttgagggcgctgactgtggggtggaggtggatgaatgtgccagccggccctgcctgaatggaggccactgccaggacctgcccaacggcttccagtgccactgcccagatggctacgccggccccacctgtgaagaagatgtggatgaatgtctgagtgacccctgcctgcatggaggcacctgcagcgacacagtggccggctacatctgccgctgcccagagacctggggcggccgggactgcagcgtgcagctgaccggctgccagggccacacctgccccctggccgccacctgcatccccatctttgaaagtggagtgcacagctatgtgtgccactgccccccaggcacccacggccccttctgtggccagaacaccaccttctctgtgatggccggcagccccatccaggcctctgtgcctgctgggggccccctgggcctggccctgcgcttccgcaccaccctgcctgctggcaccctggccaccagaaatgacaccaaggagagcctggagctggccctggtggccgccaccctgcaggccaccctgtggagctacagcaccaccgtgctggtgctgcggctgcctgacctggccctgaatgatggccactggcaccaggtggaggtggtgctgcacctggccaccctggagctgcggctgtggcatgagggctgcccagcccggctgtgtgtggccagcggccctgtggccctggccagcacagccagcgccacccccctgcctgctggcatcagcagcgcccagctgggagatgccacctttgctggctgcctgcaggatgtgcgggtggatggccacctgctgctgcctgaggacctgggagaaaatgtgctgctgggctgtgaaagaagagagcagtgccggcccctgccctgtgtgcacggcggcagctgtgtggacctgtggacccacttccgctgtgactgtgcccggccccaccggggccccacctgtgctgatgagatcccagctgccaccttcggcctgggcggggcccccagcagcgccagcttcctgctgcaggagctgcccggccccaacctgactgtgtccttcctgctgcggacccgggagagcgctggcctgctgctgcagtttgccaatgacagcgctgctggcctgactgtgttcctgtctgagggccgcatccgggcagaggtgcccggcagccctgctgtggtgctgcccggccgctgggatgatggcctgcggcacctggtgatgctgagctttggaccagaccagctgcaggacctgggccagcacgtgcacgtgggcggccgcctgctggccgctgacagccagccctggggcggccccttccggggctgcctgcaggacctgcggctggatggctgccacctgcccttcttccccctgcccctggacaacagcagccagcccagcgagctgggcggccggcagagctggaacctgacagctggctgtgtgtctgaggacatgtgcagcccagacccctgcttcaacggcggcacctgcctggtgacctggaatgacttccactgcacctgcccagccaacttcaccggccccacctgtgcccagcagctgtggtgccccggccagccctgcctgcccccagccacctgtgaggaggtgcctgatggctttgtgtgtgtggccgaggccaccttccgggagggccccccagctgccttcagcggccacaatgccagcagcggccgcctgctgggcggcctgagcctggccttccgcacccgggacagcgaggcctggctgctgcgggctgctgctggggccctggagggcgtgtggctggccgtgagaaatggcagcctggccggcggcgtgcggggcggccacggcctgcccggggctgtgctgcccatccctggcccccgggtggctgatggagcctggcaccgggtgcggctggccatggagaggcctgctgccaccaccagccgctggctgctgtggctggatggagctgccacccctgtggccctgcggggcctggccagtgacctgggcttcctgcagggccctggagctgtgcgcatcctgctggccgagaacttcaccggctgcctgggccgggtggccctgggcggcctgcccctgcccctggcccggcccaggcctggagctgcccctggggcccgggagcactttgcctcctggccaggcaccccagcccccatcctgggctgccgcggggcccctgtgtgtgcccccagcccctgcctgcatgatggagcctgccgggacctgtttgatgcctttgcctgtgcctgtggccctggctgggagggcccccgctgtgaggcccacgtggacccctgccacagcgccccctgtgcccggggccgctgccacacccacccagatggccgctttgaatgtcgctgccccccaggctttggaggcccccgctgccgcctgcctgtgcccagcaaagaatgttccctgaatgtgacctgcctggatggcagcccctgtgagggcggcagccctgctgccaactgcagctgcctggagggcctggccggccagcgctgccaggtgcccaccctgccctgtgaggccaacccctgcctgaatggaggcacctgcagagctgctggaggagtgtctgagtgcatctgcaatgcccgcttcagcggccagttctgtgaggtggccaagggcctgcccctgcccctgcccttccccctgctggaggtggccgtgcctgctgcctgtgcctgcctgctgctgctgctgctgggcctgctgagcggcatcctggccgccaggaagaggcggcagagcgagggcacctacagccccagccagcaggaggtggccggggcccggctggagatggacagcgtgctgaaggtgcccccagaggagcggctcatctag

SEQ ID NO: 148579 - DNA, 363 bp, Artificial Sequence
  Description of Artificial Sequence: Synthetic coding sequence
atggccaaccctggcctgggcctgctgctggccctgggcctgcccttcctgctggcccgctggggccgggcctggggccagatccagaccaccagcgccaatgaaaacagcacagtgctgcccagcagcaccagcagcagcagtgatggcaacctgcggcctgaggccatcacagccatcatcgtggtgttcagcctgctggccgccctgctgctggccgtgggcctggccctgctggtgaggaagctgcgggagaagaggcagacagagggcacctaccggcccagcagcgaggagcaggtgggcgcccgggtgccccccacccccaacctgaagctgcccccagaggagcggctcatctag

SEQ ID NO: 148580 - DNA, 372 bp, Artificial Sequence
  Description of Artificial Sequence: Synthetic coding sequence
atggccaaccctggcctgggcctgctgctggccctgggcctgcccttcctgctggcccgctggggccgggcctggggccagatccagaccaccagcgccaatgaaaacagcacagtgctgcccagcagcaccagcagcagcagtgatggcaacctgcggcctgaggccatcacagccatcatcgtggtgttcagcctgctggccgccctgctgctggccgtgggcctggccctgctggtgaggaagctgcgggagaagaggcagacagagggcacctaccggcccagcagcgaggagcagttcagccacgccgctgaggcccgggccccccaggacagcaaggagaccgtgcagggctgcctgcccatctag

SEQ ID NO: 148581 - DNA, 363 bp, Artificial Sequence; identical to SEQ ID NO: 148579
  Description of Artificial Sequence: Synthetic coding sequence

SEQ ID NO: 148582 - DNA, 1599 bp, Artificial Sequence
  Description of Artificial Sequence: Synthetic coding sequence
atgcctgcccctcctggccgcacccacacctggttcctgctgcagagcctggaggacctggacaccagcctgaggaagctgaacagccggctgtttgtggtgcggggccagcctgcagatgtgttccccaggctcttcaaggagtggggcgtgacccggctgacctttgaatatgacagcgagccctttgggaaggagagagatgctgccatcatgaagatggccaaggaggccggcgtggaggtggtgacagagaacagccacaccctgtatgacctggaccgcatcatcgagctgaatggccagaagccacccctgacctacaagcgcttccaggccatcatcagcaggatggagctgcccaagaagcctgtgggcctggtgaccagccagcagatggagagctgcagagctgagatccaggagaaccatgatgagacctacggcgtgcccagcctggaggagctgggcttccccacagagggcctgggccctgctgtgtggcagggcggggagacagaggccctggcccggctggacaagcacctggagaggaaggcctgggtggccaactatgaaagacccaggatgaatgccaacagcctgctggccagccccaccggcctgagcccctacctgcgcttcggctgcctgagctgccgcctcttctactaccgcctgtgggacctgtacaagaaggtgaagaggaacagcaccccacccctgagcctgtttggccagctgctgtggagggagttcttctacacagctgccaccaacaaccccaggtttgacaggatggagggcaaccccatctgcatccagatcccctgggacaggaaccctgaggccctggccaagtgggccgagggcaagacaggcttcccctggattgatgccatcatgacccagctgcggcaggagggctggatccaccacctggcccggcatgctgtggcctgcttcctgaccaggggggacctgtgggtgtcctgggagagcggcgtgcgggtgtttgatgagctgctgctggatgctgacttctctgtgaatgccggctcctggatgtggctgagctgcagcgccttcttccagcagttcttccactgctactgccctgtgggcttcggccgcaggacagaccccagcggggactacatccgccgctacctgcccaagctgaaggccttccccagccgctacatctatgagccctggaatgcccctgagagcatccagaaggccgccaagtgcatcatcggcgtggactacccccggcccatcgtgaaccacgccgagaccagccggctgaacattgaaagaatgaagcagatctaccagcagctgagccgctaccggggcctgtgcctgctggcctctgtgcccagctgtgtggaggacctgagccaccctgtggccgagcccagcagcagccaggccggctccatgagcagcgctggcccccggcccctgcccagcggccctgccagccccaagaggaagctggaggccgctgaggagcccccaggagaggagctgagcaagagggcccgggtggccgagctgcccaccccagagctgcccagcaaggatgcctag

SEQ ID NO: 148583 - DNA, 1845 bp, Artificial Sequence
  Description of Artificial Sequence: Synthetic coding sequence
atgggcggcgtgcacgtggcctaccggggcggggccggcgtggccggggctgtgtggacagtgatggccgccaccgtggccacagctgctgctgtggccccagccccagcccctggaacagacagcgccagctctgtgcactggttcaggaagggcctgcggctgcatgacaacccagccctgctggccgctgtgcggggggcccgctgtgtgcgctgtgtgtacatcctggacccctggtttgctgccagcagctctgtgggcatcaaccgctggaggttcctgctgcagagcctggaggacctggacaccagcctgaggaagctgaacagccggctgtttgtggtgcggggccagcctgcagatgtgttccccaggctcttcaaggagtggggcgtgacccggctgacctttgaatatgacagcgagccctttgggaaggagagagatgctgccatcatgaagatggccaaggaggccggcgtggaggtggtgacagagaacagccacaccctgtatgacctggaccgcatcatcgagctgaatggccagaagccacccctgacctacaagcgcttccaggccatcatcagcaggatggagctgcccaagaagcctgtgggcctggtgaccagccagcagatggagagctgcagagctgagatccaggagaaccatgatgagacctacggcgtgcccagcctggaggagctgggcttccccacagagggcctgggccctgctgtgtggcagggcggggagacagaggccctggcccggctggacaagcacctggagaggaaggcctgggtggccaactatgaaagacccaggatgaatgccaacagcctgctggccagccccaccggcctgagcccctacctgcgcttcggctgcctgagctgccgcctcttctactaccgcctgtgggacctgtacaagaaggtgaagaggaacagcaccccacccctgagcctgtttggccagctgctgtggagggagttcttctacacagctgccaccaacaaccccaggtttgacaggatggagggcaaccccatctgcatccagatcccctgggacaggaaccctgaggccctggccaagtgggccgagggcaagacaggcttcccctggattgatgccatcatgacccagctgcggcaggagggctggatccaccacctggcccggcatgctgtggcctgcttcctgaccaggggggacctgtgggtgtcctgggagagcggcgtgcgggtgtttgatgagctgctgctggatgctgacttctctgtgaatgccggctcctggatgtggctgagctgcagcgccttcttccagcagttcttccactgctactgccctgtgggcttcggccgcaggacagaccccagcggggactacatccgccgctacctgcccaagctgaaggccttccccagccgctacatctatgagccctggaatgcccctgagagcatccagaaggccgccaagtgcatcatcggcgtggactacccccggcccatcgtgaaccacgccgagaccagccggctgaacattgaaagaatgaagcagatctaccagcagctgagccgctaccggggcctgtgcctgctggcctctgtgcccagctgtgtggaggacctgagccaccctgtggccgagcccagcagcagccaggccggctccatgagcagcgctggcccccggcccctgcccagcggccctgccagccccaagaggaagctggaggccgctgaggagcccccaggagaggagctgagcaagagggcccgggtggccgagctgcccaccccagagctgcccagcaaggatgcctag

SEQ ID NO: 148584 - DNA, 522 bp, Artificial Sequence
  Description of Artificial Sequence: Synthetic coding sequence
atggatgtgaccatccagcacccctggttcaagaggaccctgggccccttctaccccagccggctgtttgaccagttctttggagagggcctgtttgaatatgacctgctgcccttcctgagcagcaccatcagcccctactaccggcagagcctcttcagaacagtgctggacagcggcatcagcgaggtgcggagtgaccgggacaagtttgtgatcttcctggatgtgaagcacttctccccagaggacctgactgtgaaggtgcaggatgactttgtggagatccacggcaagcacaatgaaaggcaggatgaccacggctacatcagccgggagttccaccggcgctaccgcctgcccagcaatgtggaccagagcgccctgagctgcagcctgtctgcagatggcatgctgaccttctgtggccccaagatccagacaggcctggatgccacccatgctgagcgggccatccctgtgtcccgggaggagaagcccaccagcgcccccagcagctag

SEQ ID NO: 148585 - DNA, 570 bp, Artificial Sequence
  Description of Artificial Sequence: Synthetic coding sequence
atggccctggtgcggggcggctggctgtggaggcagagcagcatcctgcggcgctggaagaggaactggtttgccctgtggctggatggcaccctgggctactaccatgatgaaacagcccaggatgaggaggacagagtgctgatccacttcaacgtgcgggacatcaagattggaccagaatgtcatgatgtgcagcccccagagggccgcagcagagatggcctgctgactgtgaacctgcgggagggcggccgcctgcacctgtgtgccgagaccaaggatgatgccctggcctggaagacagccctgctggaggccaacagcacccctgtgcgggtgtacagcccctaccaggactactatgaggtggtgcccccaaatgcccacgaggccacctacgtgcgcagctactacggccccccctatgccggccctggggtgacccacgtgattgtgcgggaggacccctgctacagcgctggggcccccctggccatgggcatgctggccggggccgccactggagctgccctgggcagcctgatgtggagcccctgctggttctag

SEQ ID NO: 148586 - DNA, 528 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggctggagaaggaccgcttctctgtgaacctggatgtgaagcacttcagccctgaggagctgaaggtgaaggtgctgggagatgtgattgaggtgcacggcaagcatgaggagcggcaggatgaacatggcttcatcagccgggagttccacaggaagtaccgcatcccagcagatgtggaccccctgaccatcaccagcagcctgagcagtgatggagtgctgactgtgaatggccccaggaagcaggtgtctggccctgagaggaccatccccatcacccgggaggagaagccagctgtgacagctgcccccaagaagtag

SEQ ID NO: 148587 - DNA, 525 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggctggagaaggaccgcttctctgtgaacctggatgtgaagcacttcagccctgaggagctgaaggtgaaggtgctgggagatgtgattgaggtgcacggcaagcatgaggagcggcaggatgaacatggcttcatcagccgggagttccacaggaagtaccgcatcccagcagatgtggaccccctgaccatcaccagcagcctgagcagtgatggagtgctgactgtgaatggccccaggaagcaggtgtctggccctgagaggaccatccccatcacccgggaggagaagccagctgtgacagctgcccccaagtag

SEQ ID NO: 148588 - DNA, 528 bp, Artificial Sequence; identical to SEQ ID NO: 148586
  Description of Artificial Sequence: Synthetic coding sequence

SEQ ID NO: 148589 - DNA, 234 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggctggagaaggaccgcttctctgtgtag

SEQ ID NO: 148590 - DNA, 393 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggctggagaaggaccgcttctctgtgaacctggatgtgaagcacttcagccctgaggagctgaaggtgaaggtgctgggagatgtgattgaggtgcacggcaagcatgaggagcggcaggatgaacatggcttcatcagccgggagttccacaggaagtaccgcatcccagcagatgtggacccctag

SEQ ID NO: 148591 - DNA, 528 bp, Artificial Sequence; identical to SEQ ID NO: 148586
  Description of Artificial Sequence: Synthetic coding sequence

SEQ ID NO: 148592 - DNA, 528 bp, Artificial Sequence; identical to SEQ ID NO: 148586
  Description of Artificial Sequence: Synthetic coding sequence

SEQ ID NO: 148593 - DNA, 210 bp, Artificial Sequence
  Description of Artificial Sequence: Synthetic coding sequence
atggacatcgccatccaccacccctggatcagaagacccttcttccccttccacagccccagccggctgtttgaccagttcttcggggagcacctgctggagagtgacctcttccccaccagcaccagcctgagccccttctacctgcggcccccatccttcctgcgggcccccagctggtttgacaccggcctgtctgagatgaggtag

SEQ ID NO: 148594 - DNA, 2148 bp, Artificial Sequence
  Description of Artificial Sequence: Synthetic coding sequence
atgcacctgctgcctgccctggccggcgtgctggccaccctggtgctggcccagccctgtgagggcacagatcctgccagccctggagctgtggagacctctgtgctgcgggactgcatcgccgaggccaagctgctggtggatgctgcctacaactggacccagaagagcatcaagcagaggctgcggagcggcagcgccagccccatggacctgctgagctacttcaagcagcctgtggccgccaccaggacagtggtgcgggctgctgactacatgcacgtggccctgggcctgctggaggagaagctgcagccccagaggagcggccccttcaacgtgacagatgtgctgacagagccccagctgcggctgctgagccaggccagcggctgtgccctgcgggaccaggccgagcgctgcagcgacaagtaccgcaccatcaccggccgctgcaacaacaagaggcggcccctgctgggcgccagcaaccaggccctggcccgctggctgcctgcagaatatgaagatggcctgagcctgcccttcggctggacccccagcagaagaagaaatggcttcctgctgcccctggtgcgggctgtgagcaaccagatcgtgcgcttccccaatgaaaggctgaccagtgaccggggccgggccctgatgttcatgcagtggggccagttcatcgaccatgacctggacttcagccctgagagccctgcccgggtggccttcaccgctggggtggactgtgagaggacctgtgcccagctgcccccctgcttccccatcaagatccccccaaatgacccccgcatcaagaaccagagggactgcatccccttcttccgcagcgcccccagctgcccccagaacaagaacagagtgaggaaccagatcaatgccctgaccagctttgtggatgcctccatggtgtatggcagcgaggtgtccctgagcctgcggctgaggaacagaaccaactacctgggcctgctggccatcaaccagcgcttccaggacaatggccgggccctgctgccctttgacaacctgcatgatgacccctgcctgctgaccaacagaagtgcccgcatcccctgcttcctggccggggacaccaggagcacagagacccccaagctggccgccatgcacaccctcttcatgagggagcacaaccggctggccacagagctgcggcggctgaacccccgctggaatggagacaagctgtacaatgaggccaggaagatcatgggcgccatggtgcagatcatcacctacagagacttcctgcccctggtgctgggcaaggcccgggcccggaggaccctgggccactaccggggctactgcagcaatgtggacccccgggtggccaacgtgttcaccctggccttccgcttcggccacaccatgctgcagcccttcatgttccggctggacagccagtaccgggccagcgcccccaacagccacgtgcccctgagcagcgccttctttgcctcctggagaattgtgtatgaaggaggcatcgaccccatcctgcggggcctgatggccaccccagccaagctgaaccggcaggatgccatgctggtggatgagctgcgggacaggctcttccggcaggtgagaagaattggcctggacctggccgccctgaacatgcagaggagccgggaccacggcctgcccggctacaatgcctggaggcgcttctgtggcctgagccagcccaggaacctggcccagctgagccgggtgctgaagaaccaggacctggccaggaagttcctgaacctgtatggcaccccagacaacatcgacatctggattggagccatcgccgagcccctgctgcccggggcccgggtgggccccctgctggcctgcctgtttgagaaccagttccggcgggccagagatggagaccgcttctggtggcagaagaggggcgtcttcaccaagaggcagaggaaggccctgagccgcatcagcctgagccgcatcatctgtgacaacacaggcatcaccaccgtgtcccgggacatcttccgggccaacatctacccccggggctttgtgaactgcagccgcatcccccggctgaacctgagcgcctggaggggcacctag

SEQ ID NO: 148595 - DNA, 594 bp, Artificial Sequence
  Description of Artificial Sequence: Synthetic coding sequence
atgagcagcgccccagcccctggccctgccccagccagcctgaccctgtgggatgaggaggacttccagggccgccgctgccgcctgctgagtgactgtgccaacgtgtgtgagcggggcggcctgccccgggtgcgctctgtgaaggtggagaatggagtgtgggtggcctttgagtacccagacttccagggccagcagttcatcctggagaagggggactacccccgctggagcgcctggagcggcagcagcagccacaacagcaaccagctgctgtccttccggcctgtgctgtgtgccaaccacaatgacagccgggtgaccctgtttgaaggagacaacttccagggctgcaagtttgacctggtggatgactaccccagcctgcccagcatgggctgggccagcaaggatgtgggcagcctgaaggtgtcctctggggcctgggtggcctaccagtacccaggctaccggggctaccagtatgtgctggagcgggacagacattctggagagttctgcacctatggagagctgggcacccaggcccacacaggccagctgcagagcatcagaagagtgcagcactag

SEQ ID NO: 148596 - DNA, 594 bp, Artificial Sequence; identical to SEQ ID NO: 148595
  Description of Artificial Sequence: Synthetic coding sequence

SEQ ID NO: 148597 - DNA, 390 bp, Artificial Sequence
  Description of Artificial Sequence: Synthetic coding sequence
atgagcagcgccccagcccctggccctgccccagccagcctgaccctgtgggatgaggaggacttccagggccgccgctgccgcctgctgagtgactgtgccaacgtgtgtgagcggggcggcctgccccgggtgcgctctgtgaaggtggagaatggagtgtgggtggcctttgagtacccagacttccagggccagcagttcatcctggagaagggggactacccccgctggagcgcctggagcggcagcagcagccacaacagcaaccagctgctgtccttccggcctgtgctgtgtgccaaccacaatgacagccgggtgaccctgtttgaaggagacaacttccagggctgcaagtttgacctggtggatgactaccccagctag

SEQ ID NO: 148598 - DNA, 591 bp, Artificial Sequence
  Description of Artificial Sequence: Synthetic coding sequence
atgaccctgcagtgcaccaagtctgctggcccctggaagatggtggtgtgggatgaagatggcttccagggcagaagacatgagttcaccgctgagtgccccagcgtgctggagctgggctttgaaacagtgcgcagcctgaaggtgctgagcggggcctgggtgggctttgaacatgctggcttccagggccagcagtacatcctggagcggggggagtaccccagctgggatgcctggggcggcaacacagcctacccagctgagcggctgaccagcttccggcctgctgcctgtgccaaccaccgggacagccggctgaccatctttgagcaggagaacttcctgggcaagaagggggagctgagtgatgactaccccagcctgcaggccatgggctgggagggcaatgaggtgggcagcttccacgtgcacagcggggcctgggtgtgcagccagtttcctggctaccggggcttccagtatgtgctggagtgtgaccaccacagcggggactacaagcacttccgggagtggggcagccacgcccccaccttccaggtgcagagcatccgccgcatccagcagtag

SEQ ID NO: 148599 - DNA, 1614 bp, Artificial Sequence
  Description of Artificial Sequence: Synthetic coding sequence
atggagcgggtgaatgatgccagctgtggccccagcggctgctacacctaccaggtgagccgccacagcacagagatgctgcacaacctgaaccagcagaggaagaatggaggccgcttctgtgatgtgctgctgcgggtgggagatgagagcttccctgcccacagagctgtgctggccgcctgcagcgagtactttgagagcgtcttcagcgcccagctgggagatggaggagctgctgatggcggccctgcagatgtgggcggggccacagctgcccctgggggcggggccggcggcagccgggagctggagatgcacaccatcagcagcaaggtgtttggagacatcctggactttgcctacaccagccgcatcgtggtgcggctggagagcttccctgagctgatgacagctgccaagttcctgctgatgaggtctgtgattgagatctgccaggaggtgatcaagcagagcaatgtgcagatcctggtgcccccagcccgggctgacatcatgctgttccggcccccaggcaccagtgacctgggcttccccctggacatgaccaatggagctgccctggccgccaacagcaatggaattgctggctccatgcagcctgaggaggaggccgcccgggccgccggggccgccatcgccggccaggccagcctgcctgtgctgcccggggtggaccggctgcccatggtggccggccccctgagcccccagctgctgaccagccccttccccagcgtggccagcagcgccccacccctgaccgggaagaggggccggggccggcccaggaaggccaacctgctggacagcatgtttggcagccctgggggcctgcgggaggccggcatcctgccctgtggcctgtgtgggaaggtgttcacagatgccaaccggctgcggcagcacgaggcccagcacggcgtgaccagcctgcagctgggctacatcgacctgcccccaccccggctgggagaaaatggcctgcccatcagcgaggaccctgatggccccaggaagaggagcaggaccaggaagcaggtggcctgtgagatctgtgggaagatcttcagagatgtgtaccacctgaacagacacaagctgagccacagcggggagaagccctacagctgccctgtgtgtggcctgcgcttcaagaggaaggacaggatgagctaccacgtgcgcagccatgatggctctgtgggcaagccctacatctgccagagctgtgggaagggcttcagcaggccagaccacctgaatggccacatcaagcaggtgcacaccagcgagcggccccacaagtgccaggtgtgggtgggcagcagcagcggcctgccccccctggagcccctgcccagcgacctgcccagctgggactttgcccagcctgccctgtggaggagcagccacagcgtgcctgacacagccttcagcctgagcctgaagaagagcttccctgccctggagaacctgggccctgcccacagcagcaacaccctcttctgcccagcccctcctggctacctgcggcagggctggaccaccccagagggcagccgggccttcacccagtggcctgtgggctag

SEQ ID NO: 148600 - DNA, 618 bp, Artificial Sequence
  Description of Artificial Sequence: Synthetic coding sequence
atggccagtgaccaccagacccaggccggcaagccccagagcctgaaccccaagatcatcatctttgagcaggagaacttccagggccacagccatgagctgaatggcccctgccccaacctgaaggagaccggggtggagaaggccggctctgtgctggtgcaggccggcccctgggtgggctatgagcaggccaactgcaagggggagcagtttgtgtttgagaagggggagtacccccgctgggacagctggaccagcagcagaagaacagacagcctgagcagcctgcggcccatcaaggtggacagccaggagcacaagatcatcctgtatgagaaccccaacttcaccgggaagaagatggagatcattgatgatgatgtgcccagcttccacgcccacggctaccaggagaaggtgtcctctgtgcgggtgcagagcggcacctgggtgggctaccagtacccaggctaccggggcctgcagtacctgctggagaagggggactacaaggacagcagtgactttggagccccccacccccaggtgcagagcgtgcggcgcatccgggacatgcagtggcaccagagaggagccttccaccccagcaactag

SEQ ID NO: 148601 - DNA, 1284 bp, Artificial Sequence
  Description of Artificial Sequence: Synthetic coding sequence
atgaggcacctgggcgccttcctgttcctgctgggcgtgctgggcgccctgacagagatgtgtgagatccctgagatggacagccacctggtggagaagctgggccagcacctgctgccctggatggaccggctgagcctggagcacctgaaccccagcatctacgtgggcctgcggctgagcagcctgcaggccggcaccaaggaggacctgtacctgcacagcctgaagctgggctaccagcagtgcctgctgggcagcgccttctctgaagatgatggagactgccagggcaagcccagcatgggccagctggccctgtacctgctggccctgcgggccaactgtgaatttgtgcggggccacaagggggaccggctggtgtcccagctgaagtggttcctggaggatgagaagagggccatcggccatgaccacaagggccacccccacaccagctactaccagtatggcctgggcatcctggccctgtgcctgcaccagaagagggtgcatgacagcgtggtggacaagctgctgtatgctgtggagcccttccaccagggccaccacagcgtggacacagctgccatggccggcctggccttcacctgcctgaagaggagcaacttcaaccctggaagacggcagaggatcaccatggccatcagaacagtgcgggaggagatcctgaaggcccagaccccagagggccactttggaaatgtgtacagcacccccctggccctgcagttcctgatgaccagccccatgagaggagctgagctgggcacagcctgcctgaaggcccgggtggccctgctggccagcctgcaggatggagccttccagaatgccctgatgatcagccagctgctgcctgtgctgaaccacaagacctacatcgacctgatcttcccagactgcctggccccccgggtgatgctggagcctgctgctgagaccatcccccagacccaggagatcatctctgtgaccctgcaggtgctgagcctgctgcccccctaccggcagagcatctctgtgctggccggcagcacagtggaggatgtgctgaagaaggcccacgagctgggcggcttcacctatgagacccaggccagcctgagcggcccctacctgacctctgtgatgggcaaggctgctggggagcgggagttctggcagctgctgcgggaccccaacacccccctgctgcagggcattgctgactaccggcccaaggatggagagaccatcgagctgcggctggtgtcctggtag

SEQ ID NO: 148602 - DNA, 525 bp, Artificial Sequence
  Description of Artificial Sequence: Synthetic coding sequence
atgggcaagatcaccttctatgaggaccgggacttccagggccgctgctacaactgcatcagtgactgccccaacctgcgggtgtacttcagccgctgcaacagcatccgggtggacagcggctgctggatgctgtatgaaagacccaactaccagggccaccagtacttcctgcggcggggcaagtacccagactaccagcactggatgggcctgagtgacagcgtgcagagctgccgcatcatcccccacaccagcagccacaagctgcggctgtatgaaagagatgactaccggggcctgatgtctgagctgacagatgactgtgcctgtgtgcctgagctgttccggctgcctgagatctacagcctgcacgtgctggagggctgctgggtgctgtatgagatgcccaactaccggggccggcagtacctgctgcggcctggggactaccgccgctaccatgactggggcggcgcagatgccaaggtgggcagcctgcggcgggtgacagacctgtactag

SEQ ID NO: 148603 - DNA, 528 bp, Artificial Sequence
  Description of Artificial Sequence: Synthetic coding sequence
atgggcaagatcaccttctatgaggaccgggccttccagggccgctcctatgagtgcaccacagactgccccaacctgcagccctacttcagccgctgcaacagcatccgggtggagagcggctgctggatgatctatgaaagacccaactaccagggccaccagtacttcctgcggcggggggagtacccagactaccagcagtggatgggcctgagtgacagcatccgcagctgctgcctgatccccccccacagcggggcctacaggatgaagatctatgacagagatgagctgcggggccagatgtctgagctgacagatgactgcatctctgtgcaggaccgcttccacctgacagagatccacagcctgaatgtgctggagggctcctggatcctgtatgagatgcccaactaccggggccggcagtacctgctgcggcctggagagtaccgccgcttcctggactggggcgccccaaatgccaaggtgggcagcctgcggcgggtgatggacctgtactag

SEQ ID NO: 148604 - DNA, 525 bp, Artificial Sequence
  Description of Artificial Sequence: Synthetic coding sequence
atgggcaagatcaccttctatgaggaccgggccttccagggccgctcctatgagaccaccacagactgccccaacctgcagccctacttcagccgctgcaacagcatccgggtggagagcggctgctggatgctgtatgaaagacccaactaccagggccagcagtacctgctgcggcggggggagtacccagactaccagcagtggatgggcctgagtgacagcatccgcagctgctgcctgatcccccagacagtgagccaccggctgcggctgtatgagcgggaggaccacaagggcctgatgatggagctgtctgaggactgccccagcatccaggaccgcttccacctgtctgagatccgcagcctgcacgtgctggagggctgctgggtgctgtatgagctgcccaactaccggggccggcagtacctgctgcggccccaggagtaccgccgctgccaggactggggcgccatggatgccaaggccggcagcctgcggcgggtggtggacctgtactag

SEQ ID NO: 148605 - DNA, 525 bp, Artificial Sequence
  Description of Artificial Sequence: Synthetic coding sequence
atgggcaagatcaccctgtatgaggaccggggcttccagggccgccactatgagtgcagcagtgaccaccccaacctgcagccctacctgagccgctgcaacagcgcccgggtggacagcggctgctggatgctgtatgagcagcccaactacagcggcctgcagtacttcctgcggcggggggactatgctgaccaccagcagtggatgggcctgagtgacagcgtgcgcagctgccgcctcatcccccacagcggcagccaccgcatccggctgtatgagcgggaggactaccggggccagatgattgagttcacagaggactgcagctgcctgcaggaccgcttccgcttcaatgagatccacagcctgaatgtgctggagggctcctgggtgctgtatgagctgagcaactaccggggccggcagtacctgctgatgcctggggactaccgccgctaccaggactggggcgccaccaatgcccgggtgggcagcctgcggcgggtgattgacttctcctag

SEQ ID NO: 148606 - DNA, 537 bp, Artificial Sequence
  Description of Artificial Sequence: Synthetic coding sequence
atgagcaagacaggcaccaagatcaccttctatgaggacaagaacttccagggcagaagatatgactgtgactgtgactgtgccgacttccacacctacctgagccgctgcaacagcatcaaggtggagggcggcacctgggccgtgtatgaaagacccaactttgctggctacatgtacatcctgccccagggcgagtacccagagtaccagcgctggatgggcctgaatgaccggctgagcagctgcagagctgtgcacctgcccagcggcggccagtacaagatccagatctttgagaagggggacttcagcggccagatgtatgagaccacagaggactgccccagcatcatggagcagttccacatgagggagatccacagctgcaaggtgctggagggcgtgtggatcttctatgagctgcccaactaccggggccggcagtacctgctggacaagaaggagtacaggaagcccatcgactggggcgccgccagccctgctgtgcagagcttccgccgcatcgtggagtag

SEQ ID NO: 148607 - DNA, 537 bp, Artificial Sequence; identical to SEQ ID NO: 148606
  Description of Artificial Sequence: Synthetic coding sequence

SEQ ID NO: 148608 - DNA, 960 bp, Artificial Sequence
  Description of Artificial Sequence: Synthetic coding sequence
atggccagcagcgctgctggctgtgtggtgattgtgggcagcggcgtgattggccgctcctgggccatgctgtttgccagcggcggcttccaggtgaagctgtatgacatcgagcagcagcagatcagaaatgccctggagaacatcaggaaggagatgaagctgctggagcaggccggcagcctgaagggcagcctgtctgtggaggagcagctgagcctcatcagcggctgccccaacatccaggaggccgtggagggcgccatgcacatccaggagtgtgtgcctgaggacctggagctgaagaagaagatctttgcccagctggacagcatcattgatgacagagtcatcctgagcagcagcaccagctgcctgatgcccagcaagctgtttgctggcctggtgcacgtgaagcagtgcatcgtggcccaccctgtgaaccccccctactacatccccctggtggagctggtgccccaccctgagacagcccccaccaccgtggacaggacccacgccctgatgaagaagattggccagtgccccatgagggtgcagaaggaggtggccggctttgtgctgaaccggctgcagtatgccatcatcagcgaggcctggaggctggtggaggagggcatcgtgagccccagcgacctggacctggtgatgtctgagggcctgggcatgagatatgccttcatcggccccctggagaccatgcacctgaatgctgagggcatgctgagctactgtgaccgctacagcgagggcatcaagcacgtgctgcagaccttcggccccatccctgagttcagccgggccacagctgagaaggtgaaccaggacatgtgcatgaaggtgcctgatgatcctgagcacctggccgcccggcggcagtggagagatgagtgcctgatgaggctggccaagctgaagagccaggtgcagccccagtag

SEQ ID NO: 148609 - DNA, 2346 bp, Artificial Sequence
  Description of Artificial Sequence: Synthetic coding sequence
atggccaagacccccagcgaccacctgctgagcaccctggaggagctggtgccctatgactttgagaagttcaagttcaagctgcagaacacctctgtgcagaaggagcacagccgcatccccaggagccagatccagagggcccggcctgtgaagatggccaccctgctggtgacctactatggagaggagtatgctgtgcagctgaccctgcaggtgctgcgggccatcaaccagaggctgctggccgaggagctgcacagagctgccatccaggagtacagcacccaggagaatggaacagatgacagcgctgccagcagcagcctgggggagaacaagcccaggagcctgaagaccccagaccaccctgagggcaatgaaggaaatggcccccggccctatggaggaggagctgccagcctgcgctgcagccagcctgaggccggccggggcctgagcaggaagcccctgagcaagagaagagagaaggccagcgagggcctggatgcccagggcaagcccaggaccaggagccctgccctgcccggcggccgcagccctggcccctgccgggccctggagggcggccaggccgaggtgcggctgcggagaaatgccagcagcgctggccgcctgcagggcctggccggcggggcccctggccagaaggaatgtcggccctttgaggtgtacctgcccagcggcaagatgaggcccaggagcctggaggtgaccatcagcactggagagaaggccccagccaaccctgagatcctgctgaccctggaggagaagacagctgccaacctggacagcgccacagagccccgggcccggcccaccccagatggaggagccagcgctgacctgaaggagggccctggcaaccctgagcacagcgtgacaggccggcccccagacacagctgccagcccccgctgccacgcccaggagggggaccctgtggatggcacctgtgtgcgggacagctgcagcttccctgaggccgtgtctggccacccccaggccagcggcagccgcagccctggctgcccccgctgccaggacagccatgagaggaagagccctggcagcctgagcccccagcccctgccccagtgcaagaggcacctgaagcaggtgcagctgctcttctgtgaggaccatgatgagcccatctgcctgatctgcagcctgagccaggagcaccagggccaccgggtgcggcccatcgaggaggtggccctggagcacaagaagaagatccagaagcagctggagcacctgaagaagctgaggaagagcggggaggagcagaggagctatggagaggagaaggctgtgtccttcctgaagcagacagaggccctgaagcagagggtgcagaggaagctggagcaggtgtactacttcctggagcagcaggagcacttctttgtggccagcctggaggatgtgggccagatggtgggccagatcaggaaggcctatgacaccagggtgtcccaggacatcgccctgctggatgccctgattggagagctggaggccaaggagtgccagagcgagtgggagctgctgcaggacattggagacatcctgcaccgggccaagacagtgcctgtgcctgagaagtggaccaccccccaggagatcaagcagaagatccagctgctgcaccagaagtcagaatttgtggagaagagcaccaagtacttcagcgagaccctgcggtctgagatggagatgttcaacgtgcctgagctgattggagcccaggcccatgctgtgaatgtcatcctggatgctgagacagcctaccccaacctgatcttcagtgatgacctgaagtctgtgcggctgggcaacaagtgggagcggctgcctgatggcccccagagatttgacagctgcatcatcgtgctgggcagccccagcttcctgagcggccgccgctactgggaggtggaggtgggggacaagacagcctggatcctgggcgcctgcaagaccagcatcagcaggaaaggaaacatgaccctgagcccagaaaatggctactgggtggtgatcatgatgaaggaaaatgagtaccaggccagctctgtgccccccacccggctgctgatcaaggagccccccaagagggtgggcatctttgtggactacagagtgggcagcatctccttctacaacgtgacagcccggagccacatctacacctttgccagctgcagcttcagcggccccctgcagcccatcttcagccctggcaccagagatggcggcaagaacacagcccccctgaccatctgccctgtgggcggccagggccctgactag

SEQ ID NO: 148610 - DNA, 945 bp, Artificial Sequence
  Description of Artificial Sequence: Synthetic coding sequence
atgagccgggtgcctgccttcctgtctgctgctgaggtggaggagcacctgcggagcagcagcctgctgatcccccccctggagacagccctggccaacttcagcagcggccctgagggcggcgtgatgcagcctgtgaggacagtggtgcctgtgaccaagcaccggggctacctgggcgtgatgcctgcctacagcgctgctgaagatgccctgaccaccaagctggtgaccttctatgaagatcggggcatcacctctgtggtgcccagccaccaggccaccgtgctgctgtttgagcccagcaatggcaccctgctggccgtgatggatggaaatgtcatcacagccaagaggacagctgctgtgtctgccatcgccaccaagttcctgaagccacccagcagcgaggtgctgtgcatcctgggcgctggggtgcaggcctacagccactatgagatcttcacagagcagttctccttcaaggaggtgcgcatctggaacagaaccaaggaaaatgctgagaagtttgctgacacagtgcagggcgaggtgcgggtgtgcagctctgtgcaggaggccgtggccggggctgatgtgatcatcaccgtgaccctggccacagagcccatcctgtttggagagtgggtgaagccaggggcccacatcaatgctgtgggcgccagcaggccagactggagggagctggatgatgagctgatgaaggaggccgtgctgtatgtggacagccaggaggccgccctgaaggagagcggagatgtgctgctgagcggggctgagatctttgctgagctgggggaggtgatcaagggcgtgaagccagcccactgtgagaagaccaccgtcttcaagagcctgggcatggctgtggaggacacagtggccgccaagctgatctatgacagctggagcagcggcaagtag

SEQ ID NO: 148611 - DNA, 819 bp, Artificial Sequence
  Description of Artificial Sequence: Synthetic coding sequence
atgcagcctgtgaggacagtggtgcctgtgaccaagcaccggggctacctgggcgtgatgcctgcctacagcgctgctgaagatgccctgaccaccaagctggtgaccttctatgaagatcggggcatcacctctgtggtgcccagccaccaggccaccgtgctgctgtttgagcccagcaatggcaccctgctggccgtgatggatggaaatgtcatcacagccaagaggacagctgctgtgtctgccatcgccaccaagttcctgaagccacccagcagcgaggtgctgtgcatcctgggcgctggggtgcaggcctacagccactatgagatcttcacagagcagttctccttcaaggaggtgcgcatctggaacagaaccaaggaaaatgctgagaagtttgctgacacagtgcagggcgaggtgcgggtgtgcagctctgtgcaggaggccgtggccggggctgatgtgatcatcaccgtgaccctggccacagagcccatcctgtttggagagtgggtgaagccaggggcccacatcaatgctgtgggcgccagcaggccagactggagggagctggatgatgagctgatgaaggaggccgtgctgtatgtggacagccaggaggccgccctgaaggagagcggagatgtgctgctgagcggggctgagatctttgctgagctgggggaggtgatcaagggcgtgaagccagcccactgtgagaagaccaccgtcttcaagagcctgggcatggctgtggaggacacagtggccgccaagctgatctatgacagctggagcagcggcaagtag

SEQ ID NO: 148612 - DNA, 945 bp, Artificial Sequence; identical to SEQ ID NO: 148610
  Description of Artificial Sequence: Synthetic coding sequence

SEQ ID NO: 148613 - DNA, 990 bp, Artificial Sequence
  Description of Artificial Sequence: Synthetic coding sequence
atggccaccggccagaagctgatgagagctgtgcgggtgtttgaatttggaggccctgaggtgctgaagctgcggagtgacattgctgtgcccatccccaaggaccaccaggtgctgatcaaggtgcacgcctgtggggtgaaccctgtggagacctacatccgcagcggcacctacagcaggaagcccctgctgccctacaccccaggcagtgatgtggccggcgtgattgaagctgtgggggacaatgccagcgccttcaagaagggggacagagtcttcaccagcagcaccatcagcggcggctacgccgagtatgccctggccgctgaccacacagtgtacaagctgcctgagaagctggacttcaagcagggcgccgccatcggcatcccctacttcaccgcctaccgggccctgatccacagcgcctgtgtgaaggccggggagagcgtgctggtgcatggagccagcggcggcgtgggcctggccgcctgccagatcgcccgggcctacggcctgaagatcctgggcacagctggaacagaggagggccagaagatcgtgctgcagaatggagcccacgaggtgttcaaccaccgggaggtgaactacatcgacaagatcaagaagtatgtgggggagaagggcatcgacatcatcatcgagatgctggccaacgtgaacctgagcaaggacctgagcctgctgagccatggaggccgggtcatcgtggtgggcagccggggcaccatcgagatcaacccccgggacaccatggccaaggagagcagcatcattggagtgaccctcttcagcagcaccaaggaggagttccagcagtatgctgctgccctgcaggccggcatggagatcggctggctgaagcctgtgattggcagccagtaccccctggagaaggtggccgaggcccacgagaacatcatccacggcagcggggccaccgggaagatgatcctgctgctgtag

SEQ ID NO: 148614 - DNA, 732 bp, Artificial Sequence
  Description of Artificial Sequence: Synthetic coding sequence
atggccaccggccagaagctgatgagagctgtgcgggtgtttgaatttggaggccctgaggtgctgaagctgcggagtgacattgctgtgcccatccccaaggaccaccaggtgctgatcaaggtgcacgcctgtggggtgaaccctgtggagacctacatccgcagcggcacctacagcaggaagcccctgctgccctacaccccaggcagtgatgtggccggcgtgattgaagctgtgggggacaatgccagcgccttcaagaagggggacagagtcttcaccagcagcaccatcagcggcggctacgccgagtatgccctggccgctgaccacacagtgtacaagctgcctgagaagctggacttcaagcagggcgccgccatcggcatcccctacttcaccgcctaccgggccctgatccacagcgcctgtgtgaaggccggggagagcgtgctggtgcatggagccagcggcggcgtgggcctggccgcctgccagatcgcccgggcctacggcctgaagatcctgggcacagctggaacagaggagggccagaagatcgtgctgcagaatggagcccacgaggtgttcaaccaccgggaggtgaactacatcgacaagatcaagaagtatgtgggggagaagggcatcgacatcatcatcgagatgctggccaacgtgaacctgagcaaggacctgagcctgctgagccatggaggccgggtgtag

SEQ ID NO: 148615 - DNA, 888 bp, Artificial Sequence
  Description of Artificial Sequence: Synthetic coding sequence
atggccaccggccagaagctgatgagagctgtgcgggtgtttgaatttggaggccctgaggtgctgaagctgcggagtgacattgctgtgcccatccccaaggaccaccaggtgctgatcaaggtgcacgcctgtggggtgaaccctgtggagacctacatccgcagcggcacctacagcaggaagcccctgctgccctacaccccaggcagtgatgtggccggcgtgattgaagctgtgggggacaatgccagcgccttcaagaagggggacagagtcttcaccagcagcaccatcagcggcggctacgccgagtatgccctggccgctgaccacacagtgtacaagctgcctgagaagctggacttcaagcagggcgccgccatcggcatcccctacttcaccgcctaccgggccctgatccacagcgcctgtgtgaaggccggggagagcgtgctggtgcatggagccagcggcggcgtgggcctggccgcctgccagatcgcccgggcctacggcctgaagatcctgggcacagctggaacagaggagggccagaagatcgtgctgcagaatggagcccacgaggtgttcaaccaccgggaggtgaactacatcgacaagatcaaggtggtgggcagccggggcaccatcgagatcaacccccgggacaccatggccaaggagagcagcatcattggagtgaccctcttcagcagcaccaaggaggagttccagcagtatgctgctgccctgcaggccggcatggagatcggctggctgaagcctgtgattggcagccagtaccccctggagaaggtggccgaggcccacgagaacatcatccacggcagcggggccaccgggaagatgatcctgctgctgtag

SEQ ID NO: 148616 - DNA, 579 bp, Artificial Sequence
  Description of Artificial Sequence: Synthetic coding sequence
atgcacctgctgagcagcgcctgtgtgaaggccggggagagcgtgctggtgcacggggccagcggaggagtgggcctggccgcctgccagatcgcccgggcctacggcctgaagatcctgggcacagctggaacagaggagggccagaagatcgtgctgcagaatggagcccacgaggtgttcaaccaccgggaggtgaactacatcgacaagatcaagaagtatgtgggggagaagggcatcgacatcatcatcgagatgctggccaacgtgaacctgagcaaggacctgagcctgctgagccacggcggccgggtgattgtggtgggcagccggggcaccatcgagatcaacccccgggacaccatggccaaggagagcagcatcatcggcgtgaccctcttcagcagcaccaaggaggagttccagcagtatgctgctgccctgcaggccggcatggagatcggctggctgaagcctgtgattggcagccagtaccccctggagaaggtggccgaggcccacgagaacatcatccacggcagcggggccaccgggaagatgatcctgctgctgtag

SEQ ID NO: 148617 - DNA, 990 bp, Artificial Sequence; identical to SEQ ID NO: 148613
  Description of Artificial Sequence: Synthetic coding sequence

SEQ ID NO: 148618 - DNA, 621 bp, Artificial Sequence
  Description of Artificial Sequence: Synthetic coding sequence
atggccaccggccagaagctgatgagagctgtgcgggtgtttgaatttggaggccctgaggtgctgaagctgcggagtgacattgctgtgcccatccccaaggaccaccaggtgctgatcaaggtgcacgcctgtggggtgaaccctgtggagacctacatccgcagcggcacctacagcaggaagcccctgctgccctacaccccaggcagtgatgtggccggcgtgattgaagctgtgggggacaatgccagcgccttcaagaagggggacagagtcttcaccagcagcaccatcagcggcggctacgccgagtatgccctggccgctgaccacacagtgtacaagctgcctgagaagctggacttcaagcagggcgccgccatcggcatcccctacttcaccgcctaccgggccctgatccacagcgcctgtgtgaaggccggggagagcgtgctggtgcatggagccagcggcggcgtgggcctggccgcctgccagatcgcccgggcctacggcctgaagatcctgggcacagctggaacagaggagggccagaagatcgtgctgcagaatggagcccacgaggtgttcaaccaccgggaggtgaactacatctag

SEQ ID NO: 148619 - DNA, 1050 bp, Artificial Sequence
  Description of Artificial Sequence: Synthetic coding sequence
atgaagggcctgtacttccagcagagcagcacagatgaggagatcacctttgtgttccaggagaaggaggacctgcctgtgacagaggacaactttgtgaagctgcaggtgaaggcctgtgccctgagccagatcaacaccaagctgctggccgagatgaagatgaagaaggacctcttccctgtgggccgggagattgctggcatcgtgctggatgtgggcagcaaggtgtccttcttccagccagatgatgaggtggtgggcatcctgcccctggacagtgaagatcctggcctgtgtgaggtggtgcgggtgcatgagcactacctggtgcacaagccagagaaggtgacctggacagaggccgccggcagcatcagagatggagtgcgggcctacacagccctgcactacctgagccacctgagccctgggaagtctgtgctgatcatggatggagccagcgccttcggcaccatcgccatccagctggcccaccacagaggagccaaggtgatcagcacagcctgcagcctggaggacaagcagtgcctggagcgcttccggccccccatcgcccgggtgattgatgtgtccaatggcaaggtgcacgtggccgagagctgcctggaggagactggaggcctgggcgtggacatcgtgctggatgctggggtgcggctgtacagcaaggatgatgagcctgctgtgaagctgcagctgctgccccacaagcatgacatcatcaccctgctgggcgtgggcggccactgggtgaccacagaggagaacctgcagctggaccccccagacagccactgcctcttcctgaagggggccaccctggccttcctgaatgatgaggtgtggaacctgagcaatgtgcagcagggcaagtacctgtgcatcctgaaggatgtgatggagaagctgagcactggagtcttccggccccagctggatgagcccatccccctgtatgaggccaaggtgtccatggaggccgtgcagaagaaccagggcaggaagaagcaggtggtgcagttctag

SEQ ID NO: 148620 - DNA, 546 bp, Artificial Sequence
  Description of Artificial Sequence: Synthetic coding sequence
atgaagggcctgtacttccagcagagcagcacagatgaggagatcacctttgtgttccaggagaaggaggacctgcctgtgacagaggacaactttgtgaagctgcaggtgaaggcctgtgccctgagccagatcaacaccaagctgctggccgagatgaagatgaagaaggacctcttccctgtgggccgggagattgctggcatcgtgctggatgtgggcagcaaggtgtccttcttccagccagatgatgaggtggtgggcatcctgcccctggacagtgaagatcctggcctgtgtgaggtggtgcgggtgcatgagcactacctggtgcacaagccagagaaggtgacctggacagaggccgccggcagcatcagagatggagtgcgggcctacacagccctgcactacctgagccacctgagccctgggaagtctgtgctgatcatggatggagccagcgccttcggcaccatcgccatccagctggcccaccacagaggagccaaggtgatcagcacagcctgcagcctggaggactag

SEQ ID NO: 148621 - DNA, 60 bp, Artificial Sequence
  Description of Artificial Sequence: Synthetic coding sequence
atgaagggcctgtacttccagcagagcagcacagatgaggagatcacctttgtgttctag

SEQ ID NO: 148622 - DNA, 597 bp, Artificial Sequence
  Description of Artificial Sequence: Synthetic coding sequence
atgaagggcctgtacttccagcagagcagcacagatgaggagatcacctttgtgttccaggagaaggaggacctgcctgtgacagaggacaactttgtgaagctgcaggtgaaggcctgtgccctgagccagatcaacaccaagctgctggccgagatgaagatgaagaaggacctcttccctgtgggccgggagattgctggcatcgtgctggatgtgggcagcaaggtgtccttcttccagccagatgatgaggtggtgggcatcctgcccctggacagtgaagatcctggcctgtgtgaggtggtgcgggtgcatgagcactacctggtgcacaagccagagaaggtgacctggacagaggccgccggcagcatcagagatggagtgcgggcctacacagccctgcactacctgagccacctgagccctgggaagtctgtgctgatcatggatggagccagcgccttcggcaccatcgccatccagctggcccaccacagaggagccaaggtgatcagcacagcctgcagcctggaggacaagcagtgcctggagcgcttccggccccccatcgagaacagcaccatcgcctag

SEQ ID NO: 148623 - DNA, 2916 bp, Artificial Sequence
  Description of Artificial Sequence: Synthetic coding sequence
atggagctgagtgatgccaacctgcagaccctgacagagtacctgaagaagaccctggaccctgaccctgccatccggcggcctgctgagaagttcctggagagcgtggagggcaaccagaactaccccctgctgctgctgaccctgctggagaagagccaggacaacgtcatcaaggtgtgtgcctctgtgaccttcaagaactacatcaagaggaactggagaattgtggaggatgagcccaacaagatctgtgaggccgacagagtggccatcaaggccaacatcgtgcacctgatgctgagcagccctgagcagatccagaagcagctgagtgatgccatcagcatcatcggccgggaggacttcccccagaagtggccagacctgctgacagagatggtgaaccgcttccagagcggggacttccacgtgatcaatggagtgctgaggacagcccacagcctcttcaagcgctacagacatgagttcaagagcaatgagctgtggacagagatcaagctggtgctggatgcctttgccctgcccctgaccaacctcttcaaggccaccatcgagctgtgcagcacccacgccaatgatgccagcgccctgcgcatcctcttcagcagcctcatcctgatcagcaagctgttctacagcctgaacttccaggacctgcctgagttctttgaggacaacatggagacctggatgaacaacttccacaccctgctgaccctggacaacaagctgctgcagacagatgatgaggaggaggccggcctgctggagctgctgaagagccagatctgtgacaatgctgccctgtatgcccagaagtatgatgaggagttccagcgctacctgcccaggtttgtgacagccatctggaacctgctggtgaccaccggccaggaggtgaagtatgacctgctggtgtccaatgccatccagttcctggcctctgtgtgtgagcggccccactacaagaacctgtttgaggaccagaacaccctgaccagcatctgtgagaaggtgattgtgcccaacatggagttccgggctgctgatgaggaggcctttgaggacaacagcgaggagtacatcagaagagacctggagggcagtgacatcgacaccaggagaagagctgcctgtgacctggtgcggggcctgtgcaagttctttgagggccctgtgacaggcatcttcagcggctacgtgaacagcatgctgcaggagtatgccaagaaccccagcgtgaactggaagcacaaggatgctgccatctacctggtgaccagcctggccagcaaggcccagacccagaagcacggcatcacccaggccaatgagctggtgaacctgacagagttctttgtgaaccacatcctgcctgacctgaagagcgccaacgtgaatgagttccctgtgctgaaggcagatggcatcaagtacatcatgatcttcaggaaccaggtgcccaaggagcacctgctggtgtccatccccctgctgatcaaccacctgcaggccgagagcatcgtggtgcacacctacgccgcccacgccctggagcggctcttcaccatgaggggccccaacaatgccaccctcttcaccgctgctgagatcgccccctttgtggagatcctgctgaccaacctcttcaaggccctgaccctgcccggcagcagtgaaaatgagtacatcatgaaggccatcatgaggagcttcagcctgctgcaggaggccatcatcccctacatccccaccctcatcacccagctgacccagaagctgctggccgtgtccaagaaccccagcaagccccacttcaaccactacatgtttgaggccatctgcctgagcatccgcatcacctgcaaggccaacccagctgctgtggtgaactttgaggaggccctcttcctggtgttcacagagatcctgcagaatgatgtgcaggagttcatcccctacgtgttccaggtgatgagcctgctgctggagacccacaagaatgacatccccagcagctacatggccctcttcccccacctgctgcagcctgtgctgtgggagaggacaggcaacatcccagccctggtgcggctgctgcaggccttcctggagcggggcagcaacaccatcgccagcgctgctgctgacaagatccctggcctgctgggcgtcttccagaagctgattgccagcaaggccaatgaccaccagggcttctacctgctgaacagcatcatcgagcacatgcctcctgagagcgtggaccagtacaggaagcagatcttcatcctgctcttccagaggctgcagaacagcaagaccaccaagttcatcaagagcttcctggtgttcatcaacctgtactgcatcaagtatggagccctggccctgcaggagatctttgatggcatccagcccaagatgtttggcatggtgctggagaagatcatcatccctgagatccagaaggtgtctggaaatgtggagaagaagatctgtgctgtgggcatcaccaagctgctgacagagtgcccccccatgatggacacagagtacaccaagctgtggacccccctgctgcagagcctgattggcctgtttgagctgcctgaagatgacaccatcccagatgaggagcacttcattgatattgaggacaccccaggctaccagacagccttcagccagctggcctttgctgggaagaaggagcatgaccctgtgggccagatggtgaacaaccccaagatccacctggcccagagcctgcacaagctgagcacagcctgccccggccgggtgcccagcatggtgtccaccagcctgaatgctgaggccctgcagtacctgcagggctacctgcaggccgcctctgtgaccctgctgtag

SEQ ID NO: 148624 - DNA, 2748 bp, Artificial Sequence
  Description of Artificial Sequence: Synthetic coding sequence
atggagctgagtgatgccaacctgcagaccctgacagagtacctgaagaagaccctggaccctgaccctgccatccggcggcctgctgagaagttcctggagagcgtggagggcaaccagaactaccccctgctgctgctgaccctgctggagaagagccaggacaacgtcatcaaggtgtgtgcctctgtgaccttcaagaactacatcaagaggaactggagaattgtggaggatgagcccaacaagatctgtgaggccgacagagtggccatcaaggccaacatcgtgcacctgatgctgagcagccctgagcagatccagaagcagctgagtgatgccatcagcatcatcggccgggaggacttcccccagaagtggccagacctgctgacagagatggtgaaccgcttccagagcggggacttccacgtgatcaatggagtgctgaggacagcccacagcctcttcaagcgctacagacatgagttcaagagcaatgagctgtggacagagatcaagctggtgctggatgcctttgccctgcccctgaccaacctcttcaaggccaccatcgagctgtgcagcacccacgccaatgatgccagcgccctgcgcatcctcttcagcagcctcatcctgatcagcaagctgttctacagcctgaacttccaggacctgcctgagttctttgaggacaacatggagacctggatgaacaacttccacaccctgctgaccctggacaacaagctgctgcagacagacctggtgtccaatgccatccagttcctggcctctgtgtgtgagcggccccactacaagaacctgtttgaggaccagaacaccctgaccagcatctgtgagaaggtgattgtgcccaacatggagttccgggctgctgatgaggaggcctttgaggacaacagcgaggagtacatcagaagagacctggagggcagtgacatcgacaccaggagaagagctgcctgtgacctggtgcggggcctgtgcaagttctttgagggccctgtgacaggcatcttcagcggctacgtgaacagcatgctgcaggagtatgccaagaaccccagcgtgaactggaagcacaaggatgctgccatctacctggtgaccagcctggccagcaaggcccagacccagaagcacggcatcacccaggccaatgagctggtgaacctgacagagttctttgtgaaccacatcctgcctgacctgaagagcgccaacgtgaatgagttccctgtgctgaaggcagatggcatcaagtacatcatgatcttcaggaaccaggtgcccaaggagcacctgctggtgtccatccccctgctgatcaaccacctgcaggccgagagcatcgtggtgcacacctacgccgcccacgccctggagcggctcttcaccatgaggggccccaacaatgccaccctcttcaccgctgctgagatcgccccctttgtggagatcctgctgaccaacctcttcaaggccctgaccctgcccggcagcagtgaaaatgagtacatcatgaaggccatcatgaggagcttcagcctgctgcaggaggccatcatcccctacatccccaccctcatcacccagctgacccagaagctgctggccgtgtccaagaaccccagcaagccccacttcaaccactacatgtttgaggccatctgcctgagcatccgcatcacctgcaaggccaacccagctgctgtggtgaactttgaggaggccctcttcctggtgttcacagagatcctgcagaatgatgtgcaggagttcatcccctacgtgttccaggtgatgagcctgctgctggagacccacaagaatgacatccccagcagctacatggccctcttcccccacctgctgcagcctgtgctgtgggagaggacaggcaacatcccagccctggtgcggctgctgcaggccttcctggagcggggcagcaacaccatcgccagcgctgctgctgacaagatccctggcctgctgggcgtcttccagaagctgattgccagcaaggccaatgaccaccagggcttctacctgctgaacagcatcatcgagcacatgcctcctgagagcgtggaccagtacaggaagcagatcttcatcctgctcttccagaggctgcagaacagcaagaccaccaagttcatcaagagcttcctggtgttcatcaacctgtactgcatcaagtatggagccctggccctgcaggagatctttgatggcatccagcccaagatgtttggcatggtgctggagaagatcatcatccctgagatccagaaggtgtctggaaatgtggagaagaagatctgtgctgtgggcatcaccaagctgctgacagagtgcccccccatgatggacacagagtacaccaagctgtggacccccctgctgcagagcctgattggcctgtttgagctgcctgaagatgacaccatcccagatgaggagcacttcattgatattgaggacaccccaggctaccagacagccttcagccagctggcctttgctgggaagaaggagcatgaccctgtgggccagatggtgaacaaccccaagatccacctggcccagagcctgcacaagctgagcacagcctgccccggccgggtgcccagcatggtgtccaccagcctgaatgctgaggccctgcagtacctgcagggctacctgcaggccgcctctgtgaccctgctgtag

SEQ ID NO: 148625 - DNA, 1710 bp, Artificial Sequence
  Description of Artificial Sequence: Synthetic coding sequence
atggagacctggatgaacaacttccacaccctgctgaccctggacaacaagctgctgcagacagatgatgaggaggaggccggcctgctggagctgctgaagagccagatctgtgacaatgctgccctgtatgcccagaagtatgatgaggagttccagcgctacctgcccaggtttgtgacagccatctggaacctgctggtgaccaccggccaggaggtgaagtatgacctgctggtgtccaatgccatccagttcctggcctctgtgtgtgagcggccccactacaagaacctgtttgaggaccagaacaccctgaccagcatctgtgagaagagcatcgtggtgcacacctacgccgcccacgccctggagcggctcttcaccatgaggggccccaacaatgccaccctcttcaccgctgctgagatcgccccctttgtggagatcctgctgaccaacctcttcaaggccctgaccctgcccggcagcagtgaaaatgagtacatcatgaaggccatcatgaggagcttcagcctgctgcaggaggccatcatcccctacatccccaccctcatcacccagctgacccagaagctgctggccgtgtccaagaaccccagcaagccccacttcaaccactacatgtttgaggccatctgcctgagcatccgcatcacctgcaaggccaacccagctgctgtggtgaactttgaggaggccctcttcctggtgttcacagagatcctgcagaatgatgtgcaggagttcatcccctacgtgttccaggtgatgagcctgctgctggagacccacaagaatgacatccccagcagctacatggccctcttcccccacctgctgcagcctgtgctgtgggagaggacaggcaacatcccagccctggtgcggctgctgcaggccttcctggagcggggcagcaacaccatcgccagcgctgctgctgacaagatccctggcctgctgggcgtcttccagaagctgattgccagcaaggccaatgaccaccagggcttctacctgctgaacagcatcatcgagcacatgcctcctgagagcgtggaccagtacaggaagcagatcttcatcctgctcttccagaggctgcagaacagcaagaccaccaagttcatcaagagcttcctggtgttcatcaacctgtactgcatcaagtatggagccctggccctgcaggagatctttgatggcatccagcccaagatgtttggcatggtgctggagaagatcatcatccctgagatccagaaggtgtctggaaatgtggagaagaagatctgtgctgtgggcatcaccaagctgctgacagagtgcccccccatgatggacacagagtacaccaagctgtggacccccctgctgcagagcctgattggcctgtttgagctgcctgaagatgacaccatcccagatgaggagcacttcattgatattgaggacaccccaggctaccagacagccttcagccagctggcctttgctgggaagaaggagcatgaccctgtgggccagatggtgaacaaccccaagatccacctggcccagagcctgcacaagctgagcacagcctgccccggccgggtgcccagcatggtgtccaccagcctgaatgctgaggccctgcagtacctgcagggctacctgcaggccgcctctgtgaccctgctgtag

SEQ ID NO: 148626 - DNA, 2265 bp, Artificial Sequence
  Description of Artificial Sequence: Synthetic coding sequence
atgctgagcaacctgaacttccaggacctgcctgagttctttgaggacaacatggagacctggatgaacaacttccacaccctgctgaccctggacaacaagctgctgcagacagatgatgaggaggaggccggcctgctggagctgctgaagagccagatctgtgacaatgctgccctgtatgcccagaagtatgatgaggagttccagcgctacctgcccaggtttgtgacagccatctggaacctgctggtgaccaccggccaggaggtgaagtatgacctgctggtgtccaatgccatccagttcctggcctctgtgtgtgagcggccccactacaagaacctgtttgaggaccagaacaccctgaccagcatctgtgagaaggtgattgtgcccaacatggagttccgggcagcagatgaggaggcctttgaggacaacagcgaggagtacatccggcgggacctggagggcagtgacatcgacacccggcggcgggccgcctgtgacctggtgcggggcctgtgcaagttctttgagggccctgtgacaggcatcttcagcggctacgtgaacagcatgctgcaggagtatgccaagaaccccagcgtgaactggaagcacaaggatgctgccatctacctggtgaccagcctggccagcaaggcccagacccagaagcacggcatcacccaggccaatgagctggtgaacctgacagagttctttgtgaaccacatcctgcctgacctgaagagcgccaacgtgaatgagttccctgtgctgaaggcagatggcatcaagtacatcatgatcttcaggaaccaggtgcccaaggagcacctgctggtgtccatccccctgctgatcaaccacctgcaggccgagagcatcgtggtgcacacctatgctgcccacgccctggagcggctcttcaccatgaggggccccaacaatgccaccctcttcaccgctgctgagatcgccccctttgtggagatcctgctgaccaacctcttcaaggccctgaccctgcccggcagcagtgaaaatgagtacatcatgaaggccatcatgaggagcttcagcctgctgcaggaggccatcatcccctacatccccaccctcatcacccagctgacccagaagctgctggccgtgtccaagaaccccagcaagccccacttcaaccactacatgtttgaggccatctgcctgagcatccgcatcacctgcaaggccaacccagctgctgtggtgaactttgaggaggccctcttcctggtgttcacagagatcctgcagaatgatgtgcaggagttcatcccctacgtgttccaggtgatgagcctgctgctggagacccacaagaatgacatccccagcagctacatggccctcttcccccacctgctgcagcctgtgctgtgggagaggactggaaacatcccagccctggtgcggctgctgcaggccttcctggagcggggcagcaacaccatcgccagcgctgctgctgacaagatccctggcctgctgggcgtcttccagaagctgattgccagcaaggccaatgaccaccagggcttctacctgctgaacagcatcatcgagcacatgcctcctgagagcgtggaccagtacaggaagcagatcttcatcctgctcttccagaggctgcagaacagcaagaccaccaagttcatcaagagcttcctggtgttcatcaacctgtactgcatcaagtacggggccctggccctgcaggagatctttgatggcatccagcccaagatgtttggcatggtgctggagaagatcatcatccctgagatccagaaggtgtctggaaatgtggagaagaagatctgtgctgtgggcatcaccaagctgctgacagaatgtcctcccatgatggacacagagtacaccaagctgtggacccccctgctgcagagcctcatcggcctgtttgagctgcctgaagatgacaccatcccagatgaggagcacttcatcgacatcgaggacaccccaggctaccagacagccttcagccagctggcctttgctgggaagaaggagcatgaccctgtgggccagatggtgaacaaccccaagatccacctggcccagagcctgcacaagctgagcacagcctgccccggccgggtgcccagcatggtgtccaccagcctgaatgctgaggccctgcagtacctgcagggctacctgcaggccgcctctgtgaccctgctgtag

SEQ ID NO: 148627 - DNA, 888 bp, Artificial Sequence; identical to SEQ ID NO: 143967
  Description of Artificial Sequence: Synthetic coding sequence

SEQ ID NO: 148628 - DNA, 1353 bp, Artificial Sequence
  Description of Artificial Sequence: Synthetic coding sequence
atgtctgccatccaggccgcctggcccagcggcacagaatgtattgccaagtacaacttccatggaacagctgagcaggacctgcccttctgcaagggagatgtgctgaccatcgtggccgtgaccaaggaccccaactggtacaaggccaagaacaaggtgggccgggagggcatcatcccagccaactacgtgcagaagcgggagggcgtgaaggccggcaccaagctgagcctgatgccctggttccacggcaagatcacccgggagcaggccgagcggctgctgtacccacctgagaccggcctcttcctggtgcgggagagcaccaactacccaggggactacaccctgtgtgtgtcctgtgatggcaaggtggagcactaccgcatcatgtaccacgccagcaagctgagcattgatgaggaggtgtactttgagaacctgatgcagctggtggagcactacaccagtgatgctgatggcctgtgcaccaggctcatcaagcccaaggtgatggagggcaccgtggccgcccaggatgagttctaccgcagcggctgggccctgaacatgaaggagctgaagctgctgcagaccatcggcaaaggagaatttggagatgtgatgctgggggactaccggggcaacaaggtggccgtgaagtgcatcaagaatgatgccacagcccaggccttcctggccgaggcctctgtgatgacccagctgcggcacagcaacctggtgcagctgctgggcgtgattgtggaggagaagggcggcctgtacatcgtgacagagtacatggccaagggcagcctggtggactacctgcggagccggggccgctctgtgctgggcggggactgcctgctgaagttcagcctggatgtgtgtgaggccatggagtacctggagggcaacaactttgtgcaccgggacctggccgccagaaatgtgctggtgtctgaggacaacgtggccaaggtgtctgactttggcctgaccaaggaggccagcagcacccaggacaccgggaagctgcctgtgaagtggacagcccctgaggccctgcgggagaagaagttcagcaccaagagtgatgtgtggagctttggcatcctgctgtgggagatctacagctttggccgggtgccctacccccgcatccccctgaaggatgtggtgccccgggtggagaagggctacaagatggatgccccagatggctgccccccagctgtgtatgaggtgatgaagaactgctggcacctggatgctgccatgaggcccagcttcctgcagctgcgggagcagctggagcacatcaagacccatgagctgcacctgtag

SEQ ID NO: 148629 - DNA, 1353 bp, Artificial Sequence; identical to SEQ ID NO: 148628
  Description of Artificial Sequence: Synthetic coding sequence

SEQ ID NO: 148630 - DNA, 1200 bp, Artificial Sequence
  Description of Artificial Sequence: Synthetic coding sequence
atgtctgccatccaggccgcctggcccagcggcacagaatgtattgccaagtacaacttccatggaacagctgagcaggacctgcccttctgcaagggagatgtgctgaccatcgtggccgtgaccaaggaccccaactggtacaaggccaagaacaaggtgggccgggagggcatcatcccagccaactacgtgcagaagcgggagggcgtgaaggccggcaccaagctgagcctgatgccctggttccacggcaagctgagcattgatgaggaggtgtactttgagaacctgatgcagctggtggagcactacaccagtgatgctgatggcctgtgcaccaggctcatcaagcccaaggtgatggagggcaccgtggccgcccaggatgagttctacagaagtggctgggccctgaacatgaaggagctgaagctgctgcagaccatcggcaagggggagtttggagatgtgatgctgggggactaccggggcaacaaggtggccgtgaagtgcatcaagaatgatgccacagcccaggccttcctggccgaggcctctgtgatgacccagctgcggcacagcaacctggtgcagctgctgggcgtcatcgtggaggagaagggcggcctgtacatcgtgacagagtacatggccaagggcagcctggtggactacctgcggagccggggccgctctgtgctgggcggggactgcctgctgaagttcagcctggatgtgtgtgaggccatggagtacctggagggcaacaactttgtgcaccgggacctggccgccagaaatgtgctggtgtctgaagataatgtggccaaggtgtctgactttggcctgaccaaggaggccagcagcacccaggacaccgggaagctgcctgtgaagtggacagcccctgaggccctgcgggagaagaagttcagcaccaagagtgatgtgtggagctttggcatcctgctgtgggagatctacagctttggccgggtgccctacccccgcatccccctgaaggatgtggtgccccgggtggagaagggctacaagatggatgccccagatggctgccccccagctgtgtatgaggtgatgaagaactgctggcacctggatgctgccatgaggcccagcttcctgcagctgcgggagcagctggagcacatcaagacccatgagctgcacctgtag

SEQ ID NO: 148631 - DNA, 783 bp, Artificial Sequence
  Description of Artificial Sequence: Synthetic coding sequence
atggtggccgccccctgggccacccaggagcaggaggagggccggggcatccagcccggggacagaggagaccagaagtctgctgccagccagaagcccaggagccggggcatcctgcacagcctcttctgctgcgtgtgcagagatgatggagaggccctgcctgcccacagcggggcccccctgctggtggaggagaatggagccatccccaagacccctgtgcagtacctgctgcctgaggccaaggcccaggacagcgacaagatctgtgtggtgattgacctggatgagaccctggtgcacagcagcttcaagcctgtgaacaatgctgacttcatcatccctgtggagattgatggagtggtgcaccaggtgtatgtgctgaagaggcctcatgtggatgagttcctgcagaggatgggagagctgtttgaatgtgtgctcttcaccgccagcctggccaagtatgctgaccctgtggccgacctgctggacaagtggggcgccttccgggcccggctcttccgggagagctgtgtgttccaccggggcaactacgtgaaggacctgagccggctgggccgggacctgcggcgggtgctgatcctggacaacagccctgccagctatgtgttccacccagacaatgctgtgcctgtggcctcctggtttgacaacatgtctgacacagagctgcatgacctgctgcccttctttgagcagctgagccgggtggatgatgtgtacagcgtgctgcggcagccccggcccggcagctag

SEQ ID NO: 148632 - DNA, 2604 bp, Artificial Sequence
  Description of Artificial Sequence: Synthetic coding sequence
atggaggtgcctgctgctggccgggtgcctgctgagggcgcccccacagctgctgtggccgaggtgcgctgccccggccctgcccccctgcggctgctggagtggagggtggccgccggggctgctgtgagaattggctctgtgctggccgtgtttgaggccgccgccagcgcccagagcagcggggccagccagagccgggtggccagcggcggctgtgtgcggcctgcccggcctgagcggcggctgcggtctgagcgggccggcgtggtgcgggagctgtgtgcccagcccggccaggtggtggcccctggagctgtgctggtgcggctggagggctgcagccaccctgtggtgatgaagggcctgtgtgccgagtgtggccaggacctgacccagctgcagagcaagaatggcaagcagcaggtgcccctgagcacagccaccgtgtccatggtgcacagcgtgcctgagctgatggtgtcctctgagcaggccgagcagctgggccgggaggaccagcagaggctgcacaggaacaggaagctggtgctgatggtggacctggaccagaccctcatccacaccacagagcagcactgccagcagatgagcaacaagggcatcttccacttccagctgggccgcggggagcccatgctgcacacccggctgcggccccactgcaaggacttcctggagaagatcgccaagctgtatgagctgcacgtgttcaccttcggcagccggctgtatgcccacaccatcgccggcttcctggaccctgagaagaagctgttcagccaccgcatcctgagcagagatgagtgcatcgaccccttcagcaagacaggcaacctgaggaacctcttcccctgtggggacagcatggtgtgcatcattgatgacagagaagatgtgtggaagtttgcccccaacctgatcaccgtgaagaagtatgtgtacttccagggcaccggggacatgaatgcccctcctggcagccgggagagccagaccaggaagaaggtgaaccacagccggggcacagaggtgtctgagcccagcccccctgtgcgggaccctgagggcgtgacccaggcccctggggtggagcccagcaatggcctggagaagccagcccgggagctgaatggaagtgaagctgccaccccccgggacagccccaggcctgggaagccagatgagcgggacatctggcccccagcccaggcccccaccagcagccaggagctggccggggcccctgagccccagggcagctgtgcccagggcggccgggtggcccctggccagaggcctgcccagggcgccaccggcacagacctggactttgacctgagcagtgacagcgagagcagcagcgagagcgagggcaccaagagcagcagcagcgccagtgatggagagagcgagggcaagaggggccggcagaagcccaaggccgcccctgagggcgctggggccctggcccagggcagcagcctggagcccggccggcctgctgcccccagcctgcccggggaggccgagcccggggcccacgccccagacaaggagcctgagctgggcggccaggaggagggggagagagatggcctgtgtggcctgggcaatggctgtgccgacaggaaggaggccgagacagagagccagaacagcgagctgagcggcgtgacagctggggagagcctggaccagagcatggaggaggaggaggaggaggacacagatgaagatgaccacctgatctacctggaggagatcctggtgcgggtgcacacagactactatgccaagtatgaccgctacctgaacaaggagattgaggaggccccagacatcaggaagatcgtgcctgagctgaagagcaaggtgctggctgatgtggccatcatcttcagcggcctgcaccccaccaacttccccatcgagaagacccgggagcactaccacgccacagccctgggcgccaagatcctgacccggctggtgctgagcccagatgccccagaccgggccacccacctgattgctgcccgggccggcacagagaaggtgctgcaggcccaggagtgtggccacctgcacgtggtgaacccagactggctgtggagctgcctggagcgctgggacaaggtggaggagcagctgttccccctgagagatgaccacaccaaggcccagcgggagaacagccctgctgccttcccagaccgggagggcgtgcccccaacagccctcttccaccccatgcctgtgctgcccaaggcccagcccggccctgaggtgcgcatctatgacagcaacacaggcaagctgatcagaactggagcccggggccccccagcccccagcagcagcctgcccatccggcaggagcccagcagcttccgctggaccaccagcctggagaaggccgccaccacagccacagccaggagaggaggcctgcggagcagaagaagaagccccagccctggcagccagggccctgctggcagcggccgcagcggccacctgcggcctgcccggggggcccggcagggcgctgggggccctgaggccacccggggcagctag

SEQ ID NO: 148633 - DNA, 2886 bp, Artificial Sequence
  Description of Artificial Sequence: Synthetic coding sequence
atggaggtgcctgctgctggccgggtgcctgctgagggcgcccccacagctgctgtggccgaggtgcgctgccccggccctgcccccctgcggctgctggagtggagggtggccgccggggctgctgtgagaattggctctgtgctggccgtgtttgaggccgccgccagcgcccagagcagcggggccagccagagccgggtggccagcggcggctgtgtgcggcctgcccggcctgagcggcggctgcggtctgagcgggccggcgtggtgcgggagctgtgtgcccagcccggccaggtggtggcccctggagctgtgctggtgcggctggagggctgcagccaccctgtggtgatgaagggcctgtgtgccgagtgtggccaggacctgacccagctgcagagcaagaatggcaagcagcaggtgcccctgagcacagccaccgtgtccatggtgcacagcgtgcctgagctgatggtgtcctctgagcaggccgagcagctgggccgggaggaccagcagaggctgcacaggaacaggaagctggtgctgatggtggacctggaccagaccctcatccacaccacagagcagcactgccagcagatgagcaacaagggcatcttccacttccagctgggccgcggggagcccatgctgcacacccggctgcggccccactgcaaggacttcctggagaagatcgccaagctgtatgagctgcacgtgttcaccttcggcagccggctgtatgcccacaccatcgccggcttcctggaccctgagaagaagctgttcagccaccgcatcctgagcagagatgagtgcatcgaccccttcagcaagacaggcaacctgaggaacctcttcccctgtggggacagcatggtgtgcatcattgatgacagagaagatgtgtggaagtttgcccccaacctgatcaccgtgaagaagtatgtgtacttccagggcaccggggacatgaatgcccctcctggcagccgggagagccagaccaggaagaaggtgaaccacagccggggcacagaggtgtctgagcccagcccccctgtgcgggaccctgagggcgtgacccaggcccctggggtggagcccagcaatggcctggagaagccagcccgggagctgaatggaagtgaagctgccaccccccgggacagccccaggcctgggaagccagatgagcgggacatctggcccccagcccaggcccccaccagcagccaggagctggccggggcccctgagccccagggcagctgtgcccagggcggccgggtggcccctggccagaggcctgcccagggcgccaccggcacagacctggactttgacctgagcagtgacagcgagagcagcagcgagagcgagggcaccaagagcagcagcagcgccagtgatggagagagcgagggcaagaggggccggcagaagcccaaggccgcccctgagggcgctggggccctggcccagggcagcagcctggagcccggccggcctgctgcccccagcctgcccggggaggccgagcccggggcccacgccccagacaaggagcctgagctgggcggccaggaggagggggagagagatggcctgtgtggcctgggcaatggctgtgccgacaggaaggaggccgagacagagagccagaacagcgagctgagcggcgtgacagctggggagagcctggaccagagcatggaggaggaggaggaggaggacacagatgaagatgaccacctgatctacctggaggagatcctggtgcgggtgcacacagactactatgccaagtatgaccgctacctgaacaaggagattgaggaggccccagacatcaggaagatcgtgcctgagctgaagagcaaggtgctggctgatgtggccatcatcttcagcggcctgcaccccaccaacttccccatcgagaagacccgggagcactaccacgccacagccctgggcgccaagatcctgacccggctggtgctgagcccagatgccccagaccgggccacccacctgattgctgcccgggccggcacagagaaggtgctgcaggcccaggagtgtggccacctgcacgtggtgaacccagactggctgtggagctgcctggagcgctgggacaaggtggaggagcagctgttccccctgagagatgaccacaccaaggcccagcgggagaacagccctgctgccttcccagaccgggagggcgtgcccccaacagccctcttccaccccatgcctgtgctgcccaaggcccagcccggccctgaggtgcgcatctatgacagcaacacaggcaagctgatcagaactggagcccggggccccccagcccccagcagcagcctgcccatccggcaggagcccagcagcttccgggctgtgcccccaccccagccccagatgtttggagaggagctgcctgatgcccaggatggagagcagcccggccccagcaggaggaagaggcagcccagcatgtctgagaccatgcccctgtacaccctgtgcaaggaggacctggagagcatggacaaggaggtggatgacatcctgggggagggcagtgatgacagcgacagcgagaagagaagacctgaggagcaggaggaggagccccagcccaggaagccaggcacccggcgggagaggaccctgggcgccccagccagcagcgagaggtctgctgctgggggccggggcccccggggccacaagaggaagctgaatgaagaagatgctgccagcgagagcagccgggagagcagcaatgaagatgagggcagcagcagcgaggctgatgagatggccaaggccctggaggccgagctgaatgacctgatgtag

SEQ ID NO: 148634 - DNA, 786 bp, Artificial Sequence
  Description of Artificial Sequence: Synthetic coding sequence
atggacagcagcgctgtgatcacccagatcagcaaggaggaggcccggggccccctgcggggcaagggggaccagaagtctgctgccagccagaagcccaggagccggggcatcctgcacagcctcttctgctgcgtgtgcagagatgatggagaggccctgcctgcccacagcggggcccccctgctggtggaggagaatggagccatccccaagcagacccctgtgcagtacctgctgcctgaggccaaggcccaggacagcgacaagatctgtgtggtgattgacctggatgagaccctggtgcacagcagcttcaagcctgtgaacaatgctgacttcatcatccctgtggagattgatggagtggtgcaccaggtgtatgtgctgaagaggccccacgtggatgagttcctgcagaggatgggagagctgtttgaatgtgtgctcttcaccgccagcctggccaagtatgctgaccctgtggccgacctgctggacaagtggggcgccttccgggcccggctcttccgggagagctgtgtgttccaccggggcaactacgtgaaggacctgagccggctgggccgggacctgcggcgggtgctgatcctggacaacagccctgccagctatgtgttccacccagacaatgctgtgcctgtggcctcctggtttgacaacatgtctgacacagagctgcatgacctgctgcccttctttgagcagctgagccgggtggatgatgtgtacagcgtgctgcggcagcccaggcctggcagctag

SEQ ID NO: 148635 - DNA, 2928 bp, Artificial Sequence
  Description of Artificial Sequence: Synthetic coding sequence
atggaggactatgagcaggagctgtgtggggtggaggatgacttccacaaccagtttgctgctgagctggaggtgctggccgagctggagggcgccagcacccccagccccagcggcgtgcccctcttcaccgctggccggccccccaggacctttgaggaggccctggcccggggagatgctgccagcagccctgccccagctgcctctgtgggcagcagccagggcggggccaggaagaggcaggtggatgctgacctgcagcctgctggcagcctgccccacgccccccgcatcaagaggccccggctgcaggtggtgaagaggctgaacttccgctctgaggagatggaggagcccccacctccagacagcagccccacagacatcaccccaccacccagccctgaggacctggccgagctgtggggccatggagtgtctgaggccgctgctgatgtgggcctgacccgggccagccctgctgccaggaaccctgtgctgcggcggccccccatcctggaggactatgtgcacgtgaccagcacagaaggagtgcgggcctacctggtgctgcgggctgaccccatggcccctggggtgcagggcagcctgctgcacgtgccctggaggggcggcggccagctggacctgctgggcgtgtccctggccagcctgaagaagcaggtggatggagagcggcgggagcggctgctgcaggaggcccagaagctgagtgacaccctgcacagcctgcggagcggggaggaggaggccgcccagcccctgggcgcccctgaggaggagcccacagatggccaggatgccagcagccactgcctgtgggtggatgaatttgcccccaggcactacacagagctgctgagtgatgacttcaccaaccgctgcctgctgaagtggctgaagctgtgggacctggtggtgtttggccacgagcggcccagcaggaagccccggcccagcgtggagcccgcccgggtgtccaaggaggccacagcccctgggaagtggaagagccatgagcaggtgctggaggagatgctggaggccggcctggaccccagccagaggcccaagcagaaggtggccctgctgtgtggccccccaggcctgggcaagaccaccctggcccacgtgattgcccggcatgctggctacagcgtggtggagatgaatgccagtgatgacaggagccctgaggtgttccgcaccagaattgaagctgccacccagatggagagcgtgctgggcgccggcggcaagcccaactgcctggtgattgatgaaattgatggagcccctgtggccgccatcaacgtgctgctgagcatcctgaacaggaagggcccccaggaggtgggcccccagggccctgctgtgcccagcggcggcggcagaagaagaagagctgagggcggcctgctgatgaggcccatcatctgcatctgcaatgaccagtttgcccccagcctgcggcagctgaagcagcaggccttcctgctgcacttcccccccaccctgcccagccggctggtgcagaggctgcaggaggtgtccctgcggcagggcatgagagctgaccccggggtgctggccgccctgtgtgagaagacagacaatgacatccgggcctgcatcaacaccctgcagttcctgtacagccggggccagcgggagctgtctgtgagagatgtgcaggccaccagggtgggcctgaaggaccagaggcggggcctcttctctgtgtggcaggaggtgttccagctgccccgggcccagaggcggcgggtgggccaggaccctgccctgcctgctgacaccctgctgctgggagatggagatgctggcagcctgaccagcgccagccagcgcttctacagagtgctgcacgccgccgccagcgctggggagcacgagaaggtggtgcagggcctgtttgacaacttcctgcggctgcggctgcgggacagcagcctgggcgctgtgtgtgtggccctggactggctggcctttgatgacctgctggccggggccgcccaccacagccagagcttccagctgctgcgctacccacccttcctgcctgtggccttccacgtgctgtttgccagcagccacaccccccgcatcaccttccccagcagccagcaggaggcccagaacaggatgagccagatgaggaacctgatccagaccctggtgtctggcatcgccccagccaccaggagccgggccaccccccaggccctgctgctggatgccctgtgcctgctgctggacatcctggcccccaagctgcggcctgtgtccacccagctgtacagcacccgggagaagcagcagctggccagcctggtgggcaccatgctggcctacagcctgacctaccggcaggagaggaccccagatggccagtacatctaccgcctggagcccaacgtggaggagctgtgccgcttccctgagctgcctgccaggaagcccctgacctaccagaccaagcagctgattgcccgggagattgaggtggagaagatgagaagagctgaggccagcgcccgggtggagaacagcccccaggtggatggcagccccccaggcctggagggcctgctgggcggcatcggggagaagggcgtgcacaggcctgcccccagaaatcatgagcagaggctggagcacatcatgaggcgggccgcccgggaggagcagcctgagaaggacttcttcggccgggtggtggtgcgcagcacagctgtgcccagcgctggggacacagcccctgagcaggacagcgtggagaggaggatgggcacagctgtgggccgctctgaggtgtggttccgcttcaatgaaggagtgtccaatgctgtgcggcgcagcctgtacatccgggacctgctgtag

SEQ ID NO: 148636 - DNA, 3555 bp, Artificial Sequence
  Description of Artificial Sequence: Synthetic coding sequence
atgcacgtgaatgccagcgcccggcgctggggccggggcggggccgccgccctgcccggccctgctgccagcccccggcggcctgcccccaggacaggccctgtgggccggcccaccctggcccccagccccagccgggcccacgcccacgccaagaccaacctgctgcccggccgggctgtgcaggccccagatgctgtgcctggggccggcagcagccgggccccagcccgctggaggccccgggaccccggcagcagcgccccagatgcctggcagcgcttccggcctgcccccctgcgggcccagccccggcccccacccaggcctgcccctggccccccaccacccaggaaaggaggctgcggcggccagtggagggccccccaggacaggacccggggcctgcggagcaggaacagcccccggccccccctggcccagccccggctgcggcatgccaaccagtggagggcccctcctggcaccccagctgctgactggaggaggcctgcccggagcggccgggctgtgagagatggcggcggcggggccggcggcagcgagcgggagctgggcctggctgatggcatggaggactatgagcaggagctgtgtggggtggaggatgacttccacaaccagtttgctgctgagctggaggtgctggccgagctggagggcgccagcacccccagccccagcggcgtgcccctcttcaccgctggccggccccccaggacctttgaggaggccctggcccggggagatgctgccagcagccctgccccagctgcctctgtgggcagcagccagggcggggccaggaagaggcaggtggatgctgacctgcagcctgctggcagcctgccccacgccccccgcatcaagaggccccggctgcaggtggtgaagaggctgaacttccgctctgaggagatggaggagcccccacctccagacagcagccccacagacatcaccccaccacccagccctgaggacctggccgagctgtggggccacggcttcagcgaggccgctgctgatgtgggcctgacccgggccagccctgctgccagaaatcctgtgctgcggcggccccccatcctggaggactatgtgcacgtgaccagcacagagggcgtgcgggcctacctggtgctgcgggctgaccccatggcccctggggtgcagggcagcctgctgcacgtgccctggaggggcggcggccagctggacctgctgggcgtgtccctggccagcctgaagaagcaggtggatggagagcggcgggagcggctgctgcaggaggcccagaagctgagtgacaccctgcacaggtctggagaggaggaggccgcccagcccctgggcgcccctgaggaggagcccacagatggccaggatgccagcagccactgcctgtgggtggatgaatttgcccccaggcactacacagagctgctgagtgatgacttcaccaaccgctgcctgctgaagtggctgaagctgtgggacctggtggtgtttggacatgagcggcccagcaggaagccccggcccagcgtggagcccgcccgggtgtccaaggaggccacagcccctgggaagtggaagagccatgagcaggtgctggaggagatgctggaggccggcctggaccccagccagaggcccaagcagaaggtggccctgctgtgtggccccccaggcctgggcaagaccaccctggcccacgtgattgcccggcatgctggctacagcgtggtggagatgaatgccagtgatgacaggagccctgaggtgttccgcacccgcatcgaggccgccacccagatggagagcgtgctgggcgctgggggcaagcccaactgcctggtgattgatgaaattgatggagcccctgtggccgccatcaacgtgctgctgagcatcctgaacaggaagggcccccaggaggtgggcccccagggccctgctgtgcccagcggcggcggcagaagaagaagagctgagggcggcctgctgatgaggcccatcatctgcatctgcaatgaccagtttgcccccagcctgcggcagctgaagcagcaggccttcctgctgcacttcccccccaccctgcccagccggctggtgcagaggctgcaggagggcatgagagctgaccccggggtgctggccgccctgtgtgagaagacagacaatgacatccgggcctgcatcaacaccctgcagttcctgtacagccggggccagcgggagctgtctgtgagagatgtgcaggccaccagggtgggcctgaaggaccagaggcggggcctcttctctgtgtggcaggaggtgttccagctgccccgggcccagaggagcagccagcacgtgtctgtgctgacctgccacggcaccccaggagatgctggcctggtggtgctgcaggacatgggagatgctggcctgggcctgtgggatgtgctgctgctggcctggacccggcggggcaccttccctggccgcttctacagagtgctgcatgctgctgccagcgctggggagcacgagaaggtggtgcagggcctgtttgacaacttcctgcggctgcggctgcgggacagcagcctgggcgctgtgtgtgtggccctggactggctggcctttgatgacctgctggccggggccgcccaccacagccagagcttccagctgctgcgctacccacccttcctgcctgtggccttccacgtgctgtttgccagcagccacaccccccgcatcaccttccccagcagccagcaggaggcccagaacaggatgagccagatgaggaacctgatccagaccctggtgtctggaattgccccagccaccaggagccgggccaccccccaggccctgctgctggatgccctgtgcctgctgctggacatcctggcccccaagctgcggcctgtgtccacccagctgtacagcacccgggagaagcagcagctggccagcctggtgggcaccatgctggcctacagcctgacctaccggcaggagaggaccccagatggccagtacatctaccgcctggagcccaacgtggaggagctgtgccgcttccctgagctgcctgccaggaagcccctgacctaccagaccaagcagctgattgcccgggagattgaggtggagaagatgagaagagctgaggccagcgcccgggtggagaacagcccccaggtggatggcagccccccaggcctggagggcctgctgggcggcattggagagaagggcgtgcacaggcctgcccccaggaaccacgagcagaggctggagcacatcatgagaagagctgcccgggaggagcagcctgagaaggacttcttcggccgggtggtggtgcgcagcacagctgtgcccagcgctggggacacagcccctgagcaggacagcgtggagaggaggatgggcacagctgtgggccgctctgaggtgtggttccgcttcaatgaaggagtgtccaatgctgtgagaagaagcctgtacatccgggacctgctgtag

SEQ ID NO: 148637 - DNA, 3012 bp, Artificial Sequence
  Description of Artificial Sequence: Synthetic coding sequence
atggaggactatgagcaggagctgtgtggggtggaggatgacttccacaaccagtttgctgctgagctggaggtgctggccgagctggagggcgccagcacccccagccccagcggcgtgcccctcttcaccgctggccggccccccaggacctttgaggaggccctggcccggggagatgctgccagcagccctgccccagctgcctctgtgggcagcagccagggcggggccaggaagaggcaggtggatgctgacctgcagcctgctggcagcctgccccacggccgcctggccgccctgccccagggcctgcggagcggccgggaggccgaggaggccagcggcagcctgcacgtgagccccccagccccccgcatcaagaggccccggctgcaggtggtgaagaggctgaacttccgctctgaggagatggaggagcccccacctccagacagcagccccacagacatcaccccaccacccagccctgaggacctggccgagctgtggggccatggagtgtctgaggccgctgctgatgtgggcctgacccgggccagccctgctgccaggaaccctgtgctgcggcggccccccatcctggaggactatgtgcacgtgaccagcacagaaggagtgcgggcctacctggtgctgcgggctgaccccatggcccctggggtgcagggcagcctgctgcacgtgccctggaggggcggcggccagctggacctgctgggcgtgtccctggccagcctgaagaagcaggtggatggagagcggcgggagcggctgctgcaggaggcccagaagctgagtgacaccctgcacagcctgcggagcggggaggaggaggccgcccagcccctgggcgcccctgaggaggagcccacagatggccaggatgccagcagccactgcctgtgggtggatgaatttgcccccaggcactacacagagctgctgagtgatgacttcaccaaccgctgcctgctgaagtggctgaagctgtgggacctggtggtgtttggccacgagcggcccagcaggaagccccggcccagcgtggagcccgcccgggtgtccaaggaggccacagcccctgggaagtggaagagccatgagcaggtgctggaggagatgctggaggccggcctggaccccagccagaggcccaagcagaaggtggccctgctgtgtggccccccaggcctgggcaagaccaccctggcccacgtgattgcccggcatgctggctacagcgtggtggagatgaatgccagtgatgacaggagccctgaggtgttccgcaccagaattgaagctgccacccagatggagagcgtgctgggcgccggcggcaagcccaactgcctggtgattgatgaaattgatggagcccctgtggccgccatcaacgtgctgctgagcatcctgaacaggaagggcccccaggaggtgggcccccagggccctgctgtgcccagcggcggcggcagaagaagaagagctgagggcggcctgctgatgaggcccatcatctgcatctgcaatgaccagtttgcccccagcctgcggcagctgaagcagcaggccttcctgctgcacttcccccccaccctgcccagccggctggtgcagaggctgcaggaggtgtccctgcggcagggcatgagagctgaccccggggtgctggccgccctgtgtgagaagacagacaatgacatccgggcctgcatcaacaccctgcagttcctgtacagccggggccagcgggagctgtctgtgagagatgtgcaggccaccagggtgggcctgaaggaccagaggcggggcctcttctctgtgtggcaggaggtgttccagctgccccgggcccagaggcggcgggtgggccaggaccctgccctgcctgctgacaccctgctgctgggagatggagatgctggcagcctgaccagcgccagccagcgcttctacagagtgctgcacgccgccgccagcgctggggagcacgagaaggtggtgcagggcctgtttgacaacttcctgcggctgcggctgcgggacagcagcctgggcgctgtgtgtgtggccctggactggctggcctttgatgacctgctggccggggccgcccaccacagccagagcttccagctgctgcgctacccacccttcctgcctgtggccttccacgtgctgtttgccagcagccacaccccccgcatcaccttccccagcagccagcaggaggcccagaacaggatgagccagatgaggaacctgatccagaccctggtgtctggcatcgccccagccaccaggagccgggccaccccccaggccctgctgctggatgccctgtgcctgctgctggacatcctggcccccaagctgcggcctgtgtccacccagctgtacagcacccgggagaagcagcagctggccagcctggtgggcaccatgctggcctacagcctgacctaccggcaggagaggaccccagatggccagtacatctaccgcctggagcccaacgtggaggagctgtgccgcttccctgagctgcctgccaggaagcccctgacctaccagaccaagcagctgattgcccgggagattgaggtggagaagatgagaagagctgaggccagcgcccgggtggagaacagcccccaggtggatggcagccccccaggcctggagggcctgctgggcggcatcggggagaagggcgtgcacaggcctgcccccagaaatcatgagcagaggctggagcacatcatgaggcgggccgcccgggaggagcagcctgagaaggacttcttcggccgggtggtggtgcgcagcacagctgtgcccagcgctggggacacagcccctgagcaggacagcgtggagaggaggatgggcacagctgtgggccgctctgaggtgtggttccgcttcaatgaaggagtgtccaatgctgtgcggcgcagcctgtacatccgggacctgctgtag

SEQ ID NO: 148638 - DNA, 1575 bp, Artificial Sequence
  Description of Artificial Sequence: Synthetic coding sequence
atgaaggagccccgcatcttcccccgggagcggcccaccccctggacccgggcccccctgcccccccggggccgcctggatggcagcctgggcccccagggcggccctgtgctgaacacaggccaccccctgggcgtgaacagcgaccccttcctgatggctgctggcagcctgggcggcaacctgacccccttccccaggaaccccagccccttccctgccagcagcggcagcctggccagcaacccagcccccttccctgctggggcccgggaccccagcatggccagcttcccccggggcatgaaccccactggaactggagctgtgtccttccccaggcctgggggcctgctgggccctggccctggccctggccccaccctgaaccccaggactggagccctgcccggccctggccccctgagcaacccccggctgggcggcctgcccggccctggccccatgagcaaccccagggctgggggcctgctgggcgccggccctgacccccggggcggcggccccatgggccctggcagcggccccaacctgcgggccggcgtgctgctgaccagcggaaatggaccacccaaccccaggcctgtgggcctgggccctggccccaaccccaacctgcggagcggcttcctgggcaccaacccagcccccaggtctggagtcttccctggccctggcctgggccccaacccccggcccagcggcctgggccctggccccaacctggatgcccgggccggcggcctgctgggcactggaagtggcctgaacctgaggatggccggcccccagggcctggacctggcccccatcctgcgggccgccggcctgctgggcgccaacagcgccagcttcagccaggccagcggcaacatgggcaccagccccagctccatggcccgggtgcccggccccatgggccccaacagcggccccagcagccggggcatcggcctgcccggccccaaccccagccccatgagccgggcccctggccccatcggccccaacagcgcccacttcagcaggcctgtgggccccatgggcgtgaatgccaaccccttccccaggggggccggcagcagcgccttcagccagagcagcggcaccctggccagcaacccagccaccttccagaggtctgctggcctgcagggcagcaaccccaccatcttcccccgggccagcggccccctgggccccaacccagccaacttcccccgggccaccggcctgcagggccccagccccaccaccttccccaggagcacaggccccctgggccctggccaggtgaccttccccaggcctgctgctggccacctgggccccagccctgctggccctgtgggcatcaacccagcccccttcacccggcccaccggcaccctgggcctgaacccagccagcttccccaggatgaatggacctgctgggaagagctttgtgcccttcccccgggtgggcagcctgcccggcaccaacccagctgccttccccaggcctgggggccccatggccgccatgtacccaaatggcatgctgcccccatag

SEQ ID NO: 148639 - DNA, 366 bp, Artificial Sequence
  Description of Artificial Sequence: Synthetic coding sequence
atggtgcagatcgtcatcagcagcgcccgggccggcggcctggccgagtgggtgctgatggagctgcagggcgagattgaggcccgctacagcacaggcctggccggcaacctgctgggggacctgcactacaccacagagggcatccctgtgctgattgtgggccaccacatcctgtatggcaagatcatccacctggagaagccctttgctgtgctggtgaagcacacccctggggaccaggactgtgatgagctgggccgggagaccggcacccgctacctggtgacagccctgatcaaggacaagatcctcttcaagacccggcccaagcccatcatcacctctgtgcccaagaaggtgtag

SEQ ID NO: 148640 - DNA, 366 bp, Artificial Sequence; identical to SEQ ID NO: 148639
  Description of Artificial Sequence: Synthetic coding sequence

SEQ ID NO: 148641 - DNA, 1776 bp, Artificial Sequence
  Description of Artificial Sequence: Synthetic coding sequence
atgaagtacatcctggtgactggaggagtcatcagcggcatcggcaagggcatcatcgccagctctgtgggcaccatcctgaagagctgtggcctgcacgtgaccagcatcaagattgacccctacatcaacattgatgctggcaccttcagcccctatgaacatggagaggtgtttgtgctggatgatggaggagaggtggacctggacctgggcaactatgagcgcttcctggacatccggctgaccaaggacaacaacctgaccaccgggaagatctaccagtatgtgatcaacaaggagaggaaaggagactacctgggcaagacagtgcaggtggtgccccacatcacagatgccatccaggagtgggtgatgaggcaggccctgatccctgtggatgaagatggcctggagccccaggtgtgtgtgattgagctgggcggcaccgtgggggacatcgagagcatgcccttcatcgaggccttccggcagttccagttcaaggtgaagcgggagaacttctgcaacatccacgtgtccctggtgccccagcccagcagcactggagagcagaagaccaagcccacccagaacagcgtgcgggagctgcggggcctgggcctgagcccagacctggtggtgtgccgctgcagcaaccccctggacacctctgtgaaggagaagatctccatgttctgccacgtggagcctgagcaggtgatctgtgtgcatgatgtgagcagcatctacagagtgcccctgctgctggaggagcagggcgtggtggactacttcctgcggcggctggacctgcccatcgagcggcagcccaggaagatgctgatgaagtggaaggagatggctgacagatatgaccggctgctggagacctgcagcatcgccctggtgggcaagtacaccaagttcagtgacagctatgccagcgtcatcaaggccctggagcacagcgccctggccatcaaccacaagctggagatcaagtacattgattctgctgacctggagcccatcaccagccaggaggagcctgtgcgctaccacgaggcctggcagaagctgtgcagcgcccatggagtgctggtgcctgggggctttggagtgcggggcacagagggcaagatccaggccatcgcctgggccaggaaccagaagaagcccttcctgggcgtgtgcctgggcatgcagctggccgtggtggagttcagcagaaatgtgctgggctggcaggatgccaacagcacagaatttgaccccaccaccagccaccctgtggtggtggacatgcctgagcacaaccctggccagatgggcggcaccatgaggctgggcaagaggaggaccctcttccagaccaagaacagcgtgatgaggaagctgtatggagatgctgactacctggaggagcggcaccgccacagatttgaggtgaaccctgtgtggaagaagtgcctggaggagcagggcctgaagtttgtgggccaggatgtggagggggagaggatggagatcgtggagctggaggaccaccccttctttgtgggcgtgcagtaccaccctgagttcctgagccggcccatcaagcccagccccccctacttcggcctgctgctggcctctgtgggccgcctgagccactacctgcagaagggctgccgcctgagcccccgggacacctacagcgacagaagtggcagcagcagcccagacagcgagatcacagagctgaagttccccagcatcaaccacgactag

SEQ ID NO: 148642 - DNA, 1776 bp, Artificial Sequence; identical to SEQ ID NO: 148641
  Description of Artificial Sequence: Synthetic coding sequence

SEQ ID NO: 148643 - DNA, 1083 bp, Artificial Sequence
  Description of Artificial Sequence: Synthetic coding sequence
atgttctgccacgtggagcctgagcaggtgatctgtgtgcatgatgtgagcagcatctacagagtgcccctgctgctggaggagcagggcgtggtggactacttcctgcggcggctggacctgcccatcgagcggcagcccaggaagatgctgatgaagtggaaggagatggctgacagatatgaccggctgctggagacctgcagcatcgccctggtgggcaagtacaccaagttcagtgacagctatgccagcgtcatcaaggccctggagcacagcgccctggccatcaaccacaagctggagatcaagtacatcgacagcgctgacctggagcccatcaccagccaggaggagcctgtgcgctaccacgaggcctggcagaagctgtgcagcgcccacggcgtgctggtgcctgggggcttcggcgtgcggggcacagagggcaagatccaggccatcgcctgggccaggaaccagaagaagcccttcctgggcgtgtgcctgggcatgcagctggccgtggtggagttcagcagaaatgtgctgggctggcaggatgccaacagcacagaatttgaccccaccaccagccaccctgtggtggtggacatgcctgagcacaaccctggccagatgggcggcaccatgaggctgggcaagaggaggaccctcttccagaccaagaacagcgtgatgaggaagctgtatggagatgctgactacctggaggagcggcaccgccacagatttgaggtgaaccctgtgtggaagaagtgcctggaggagcagggcctgaagtttgtgggccaggatgtggagggggagaggatggagatcgtggagctggaggaccaccccttctttgtgggcgtgcagtaccaccctgagttcctgagccggcccatcaagcccagccccccctacttcggcctgctgctggcctctgtgggccgcctgagccactacctgcagaagggctgccgcctgagcccccgggacacctacagcgacaggagcggcagcagcagcccagattctgagatcacagagctgaagttccccagcatcaaccacgactag

SEQ ID NO: 148644 - DNA, 945 bp, Artificial Sequence
  Description of Artificial Sequence: Synthetic coding sequence
atgcccaagagcaagagcaagatgaagtacatcctggtgactggaggagtcatctctggaattggcaagggcatcatcgccagctctgtgggcaccatcctgaagagctgtggcctgcacgtgaccagcatcaagattgacccctacatcaacattgatgctggcaccttcagcccctatgagcacggggaggtgtttgtgctggatgatggaggagaggtggacctggacctgggcaactatgagcgcttcctggacatccggctgaccaaggacaacaacctgaccaccgggaagatctaccagtatgtgatcaacaaggagaggaagggggactacctgggcaagacagtgcaggtggtgccccacatcacagatgccatccaggagtgggtgatgaggcaggccctgatccctgtggatgaagatggcctggagccccaggtgtgtgtgattgagctgggcggcaccgtgggggacattgaatccatgcccttcatcgaggccttccggcagttccagttcaaggtgaagcgggagaacttctgcaacatccacgtgtccctggtgccccagcccagcagcactggagagcagaagaccaagcccacccagaacagcgtgcgggagctgcggggcctgggcctgagcccagacctggtggtgtgccgctgcagcaaccccctggacacctctgtgaaggagaagatctccatgttctgccacgtggagcctgagcaggtgatctgtgtgcatgatgtgagcagcatctacagagtgcccctgctgctggaggagcagggcgtggtggactacttcctgcggcggctggacctgcccatcgagcggcagcccaggaagatgctgatgaagtggaaggagatggctgacagatttgcctgcaatgaggagctgggcgtgctggccagcttcaccctgctgtag

SEQ ID NO: 148645 - DNA, 1761 bp, Artificial Sequence
  Description of Artificial Sequence: Synthetic coding sequence
atgaagtacatcctggtgactggaggagtcatcagcggcatcggcaagggcatcatcgccagcagcatcggcaccatcctgaagagctgtggcctgcgggtgacagccatcaagattgacccctacatcaacattgatgctggcaccttcagcccctatgaacatggagaggtgtttgtgctgaatgatggaggagaggtggacctggacctgggcaactatgagcgcttcctggacatcaacctgtacaaggacaacaacatcaccaccgggaagatctaccagcacgtgatcaacaaggagcggcggggggactacctgggcaagacagtgcaggtggtgccccacatcacagatgctgtgcaggagtgggtgatgaaccaggccaaggtgcctgtggatggcaacaaggaggagccccagatctgtgtgattgagctgggcggcaccatcggggacatcgagggcatgccctttgtggaggccttccggcagttccagttcaaggccaagcgggagaacttctgcaacatccacgtgtccctggtgccccagctgagcgccactggagagcagaagaccaagcccacccagaacagcgtgcgggccctgcggggcctgggcctgagcccagacctgattgtgtgccgcagcagcacccccatcgagatggctgtgaaggagaagatctccatgttctgccacgtgaaccctgagcaggtgatctgcatccatgatgtgagcagcacctacagagtgcctgtgctgctggaggagcagagcatcgtgaagtacttcaaggagcggctgcacctgcccatcggggacagcgccagcaacctgctcttcaagtggaggaacatggctgacagatatgaaaggctgcagaagatctgcagcatcgccctggtgggcaagtacaccaagctgcgggactgctacgccagcgtcttcaaggccctggagcacagcgccctggccatcaaccacaagctgaacctgatgtacatcgacagcattgacctggagaagatcacagaaacagaagatcctgtgaagttccacgaggcctggcagaagctgtgcaaggcagatggcatcctggtgcctgggggcttcggcatccggggcaccctgggcaagctgcaggccatctcctgggcccggaccaagaagatccccttcctgggcgtgtgcctgggcatgcagctggccgtgattgaatttgccaggaactgcctgaacctgaaggatgctgacagcacagagttccggcccaatgcccctgtgcccctggtgattgacatgcctgagcacaaccctggcaacctgggcggcaccatgaggctgggcatcagaagaacagtgttcaagacagagaacagcatcctgaggaagctgtatggagatgtgcccttcatcgaggagcggcaccgccacagatttgaggtgaaccccaacctgatcaagcagtttgagcagaatgacctgagctttgtgggccaggatgtggatggagacaggatggagatcatcgagctggccaaccacccctactttgtgggcgtgcagttccaccctgagttcagcagccggcccatgaagcccagccccccctacctgggcctgctgctggccgccaccggcaacctgaatgcctacctgcagcagggctgcaagctgagcagcagtgaccgctacagtgatgccagtgatgacagcttcagcgagcccagaattgctgagctggagatctcctag

SEQ ID NO: 148646 - DNA, 531 bp, Artificial Sequence
  Description of Artificial Sequence: Synthetic coding sequence
atgtacatcgacagcattgacctggagaagatcacagaaacagaagatcctgtgaagttccacgaggcctggcagaagctgtgcaaggcagatggcatcctggtgcctgggggcttcggcatccggggcaccctgggcaagctgcaggccatctcctgggcccggaccaagaagatccccttcctgggcgtgtgcctgggcatgcagctggccgtgattgaatttgccaggaactgcctgaacctgaaggatgctgacagcacagagttccggcccaatgcccctgtgcccctggtgattgacatgcctgagcacaaccctggcaacctgggcggcaccatgaggctgggcatcagaagaacagtgttcaagacagagaacagcatcctgatcagcctgagcctgggcctggcctctgtggagcacacagagtgccccagcgcctttgacctgcgggacagcctcttcatcggcctcttctgtgagctgcccatgctgctggagatgaacctggactgggacctggactag

SEQ ID NO: 148647 - DNA, 1761 bp, Artificial Sequence; identical to SEQ ID NO: 148645
  Description of Artificial Sequence: Synthetic coding sequence

SEQ ID NO: 148648 - DNA, 1761 bp, Artificial Sequence; identical to SEQ ID NO: 148645
  Description of Artificial Sequence: Synthetic coding sequence

SEQ ID NO: 148649 - DNA, 399 bp, Artificial Sequence
  Description of Artificial Sequence: Synthetic coding sequence
tgaggaaagctgcaggccatctcctgggcccggaccaagaagatccccttcctgggcgtgtgcctgggcatgcagctggccgtgattgaatttgccaggaactgcctgaacctgaaggatgctgacagcacagagttccggcccaatgcccctgtgcccctggtgattgacatgcctgagcacaaccctggcaacctgggcggcaccatgaggctgggcatcagaagaacagtgttcaagacagagaacagcatcctgatcagcctgagcctgggcctggcctctgtggagcacacagagtgccccagcgcctttgacctgcgggacagcctcttcatcggcctcttctgtgagctgcccatgctgctggagatgaacctggactgggacctggactag

SEQ ID NO: 148650 - DNA, 3654 bp, Artificial Sequence
  Description of Artificial Sequence: Synthetic coding sequence
atggctgctggccgggcccaggtgcccagcagcgagcaggcctggctggaggatgcccaggtgttcatccagaagaccctgtgcccagctgtgaaggagcccaacgtgcagctgacccccctggtgattgactgtgtgaagacagtgtggctgagccagggcaggaaccagggcagcaccctgcccctgagctacagctttgtgtctgtgcaggacctgaagacccaccagaggctgccctgctgcagccacctgtcctggagcagcagcgcctaccaggcctgggcccaggaggccggccccaacggcaaccccctgccccgggagcagctgctgctgctgggcaccctgacagacctgtctgctgacctggagcaggagtgcagaaatggcagcctgtatgtgcgggacaacacaggagtgctgagctgtgagctgattgacctggacctgtcctggctgggccacctgttcctgttcccccgctggagctacctgcccccagcccgctggaacagcagcggggagggccacctggagctgtgggatgcccctgtgcctgtgttccccctgaccatcagccctggccctgtgacccccatccctgtgctgtacccagagagcgccagctgcctgctgcggctgaggaacaagctgcggggcgtgcagaggaacctggccggcagcctggtgcggctgagcgccctggtgaagagcaagcagaaggcctacttcatcctgagcctgggccgcagccaccctgctgtgacccacgtgtccatcatcgtgcaggtgcctgcccagctggtgtggcaccgggccctgcggcctggaacagcctacgtgctgacagagctgcgggtgtccaagatccggggccagaggcagcacgtgtggatgaccagccagagcagccggctgctgctgctgaagccagaatgtgtgcaggagctggagctggagctggagggccccctgctggaggccgaccccaagcccctgcccatgcccagcaacagcgaggacaagaaggaccctgagagcctggtgcgctacagccggctgctgagctacagcggggctgtgactggagtgctgaatgaacctgctggcctgtatgagctggatggccagctgggcctgtgcctggcctaccagcagttccggggcctgcggcgggtgatgaggcctggggtgtgcctgcagctgcaggatgtgcacctgctgcagagcgtgggcggcggcaccaggaggcctgtgctggccccctgcctgcggggagctgtgctgctgcagagcttcagccggcagaagccaggggcccacagcagccggcaggcctacggggccagcctgtatgagcagctggtgtgggagcggcagctgggcctgcccctgtacctgtgggccaccaaggccctggaggagctggcctgcaagctgtgcccccacgtgctgcggcaccaccagttcctgcagcacagcagccctggcagccccagcctgggcctgcagctgctggcccccaccctggacctgctggcccctcctggcagccctgtgagaaatgcccacaatgagatcctggaggagccccaccactgccccctgcagaagtacacccggctgcagacccccagcagcttccccaccctggccaccctgaaggaggagggccagaggaaggcctgggccagctttgaccccaaggccctgctgcccctgcctgaggccagctacctgcccagctgccagctgaacagaaggctggcctggagctggctgtgcctgctgcccagcgccttctgcccagcccaggtgctgctgggcgtgctggtggccagcagccacaagggctgcctgcagctgcgggaccagagcggcagcctgccctgcctgctgctggccaagcacagccagcccctgagtgaccccaggctcatcggctgcctggtgcgggcagagcgcttccagctgattgtggagagagatgtgcgcagcagcttccccagctggaaggagctgtccatgcctggcttcatccagaagcagcaggcccgggtgtatgtgcagttcttcctggctgatgccctgatcctgcctgtgccccggccctgcctgcacagcgccacccccagcaccccccagacagaccccaccggccctgagggcccccacctgggccagagccgcctcttcctgctgtgccacaaggaggccctgatgaagaggaacttctgtgtgcccccaggggccagccctgaggtgcccaagccagccctgtccttctacgtgctgggctcctggctgggcggcacccagaggaaggagggcaccggctggggcctgcctgagccccagggcaatgatgacaatgaccagaaggtgcacctgatcttcttcggcagctctgtgcgctggtttgagttcctgcaccctggccaggtgtaccgcctcatcgcccctggccctgccacccccatgctgtttgagaaggatggcagcagctgcatcagccggcggcccctggagctggccggctgtgccagctgcctgactgtgcaggacaactggaccctggagctggagagcagccaggacatccaggatgtgctggatgccaacaagagcctgcctgagagcagcctgacagacctgctgagtgacaacttcacagacagcctggtgtccttctctgctgagatcctgagcaggaccctgtgtgagcccctggtggccagcctgtggatgaagctgggcaacacaggagccatgaggcgctgtgtgaagctgactgtggccctggagacagcagaatgtgagttccccccccacctggatgtgtacatcgaggacccccacctgccccccagcctgggcctgctgcccggggcccgggtgcacttcagccagctggagaagagggtgagccgcagccacaacgtgtactgctgcttccgcagcagcacctacgtgcaggtgctgtccttccccccagagaccaccatcagcatccccctgccccacatctacctggccgagctgctgcagggcggccagagccccttccaggccacagccagctgccacatcgtgtctgtgttcagcctgcagctgttctgggtgtgtgcctactgcaccagcatctgccggcagggcaagtgcacccggctgggcagcacctgccccacccagacagccatcagccaggccatcatccggctgctggtggaggatggaacagctgaggccgtggtgacctgcaggaaccaccacgtggccgccgccctgggcctgtgcccccgggagtgggccagcctgctggactttgtgcaggtgcccggccgggtggtgctgcagtttgctggccctggggcccagctggagagcagcgcccgggtggatgagcccatgaccatgttcctgtggaccctgtgcaccagccccagcgtgctgcggcccatcgtgctgagctttgagctggagaggaagcccagcaagatcgtgcccctggagcccccccggctgcagcgcttccagtgtggggagctgcccttcctgacccacgtgaacccccggctgcggctgagctgcctgagcatccgggagagcgagtacagcagcagcctgggcatcctggccagcagctgctag

SEQ ID NO: 148651 - DNA, 3096 bp, Artificial Sequence
  Description of Artificial Sequence: Synthetic coding sequence
atggctgctggccgggcccaggtgcccagcagcgagcaggcctggctggaggatgcccaggtgttcatccagaagaccctgtgcccagctgtgaaggagcccaacgtgcagctgacccccctggtgattgactgtgtgaagacagtgtggctgagccagggcaggaaccagggcagcaccctgcccctgagctacagctttgtgtctgtgcaggacctgaagacccaccagaggctgccctgctgcagccacctgtcctggagcagcagcgcctaccaggcctgggcccaggaggccggccccaacggcaaccccctgccccgggagcagctgctgctgctgggcaccctgacagacctgtctgctgacctggagcaggagtgcagaaatggcagcctgtatgtgcgggacaacacaggagtgctgagctgtgagctgattgacctggacctgtcctggctgggccacctgttcctgttcccccgctggagctacctgcccccagcccgctggaacagcagcggggagggccacctggagctgtgggatgcccctgtgcctgtgttccccctgaccatcagccctggccctgtgacccccatccctgtgctgtacccagagagcgccagctgcctgctgcggctgcggagccaccctgctgtgacccacgtgtccatcatcgtgcaggtgcctgcccagctggtgtggcaccgggccctgcggcccggcacagcctacgtgctgacagagctgcgggtgtccaagatccggggccagaggcagcacgtgtggatgaccagccagagcagccggctgctgctgctgaagccagaatgtgtgcaggagctggagctggagctggagggccccctgctggaggccgaccccaagcccctgcccatgcccagcaacagcgaggacaagaaggaccctgagagcctggtgcgctacagccggctgctgagctacagcggggctgtgactggagtgctgaatgaacctgctggcctgtatgagctggatggccagctgggcctgtgcctggcctaccagcagttccggggcctgcggcgggtgatgaggcctggggtgtgcctgcagctgcaggatgtgcacctgctgcagagcgtgggcggcggcacccggcggcctgtgctggccccctgcctgcggggagctgtgctgctgcagagcttcagccggcagaagccaggggcccacagcagccggcaggcctatggagccagcctgtatgagcagctggtgtgggagcggcagctgggcctgcccctgtacctgtgggccaccaaggccctggaggagctggcctgcaagctgtgcccccacgtgctgcggcaccaccagttcctgcagcacagcagccctggcagccccagcctgggcctgcagctgctggcccccaccctggacctgctggcccctcctggcagccctgtgagaaatgcccacaatgagatcctggaggagccccaccactgccccctgcagaagtacacccggctgcagacccccagcagcttccccaccctggccaccctgaaggaggagggccagaggaaggcctgggccagctttgaccccaaggccctgctgcccctgcctgaggccagctacctgcccagctgccagctgaacagaaggctggcctggagctggctgtgcctgctgcccagcgccttctgcccagcccaggtgctgctgggcgtgctggtggccagcagccacaagggctgcctgcagctgcgggaccagagcggcagcctgccctgcctgctgctggccaagcacagccagcccctgagtgacccccggctgattggctgcctggtgcgggcagagcgcttccagctgattgtggagagagatgtgcgcagcagcttccccagctggaaggagctgtccatgcctggcttcatccagaagcagcaggcccgggtgtatgtgcagttcttcctggctgatgccctgatcctgcctgtgccccggccctgcctgcacagcgccacccccagcaccccccagacagaccccactggacctgagggcccccacctgggccagagccgcctcttcctgctgtgccacaaggaggccctgatgaagaggaacttctgtgtgcccccaggggccagccctgaggtgcccaagccagccctgtccttctacgtgctgggctcctggctgggcggcacccagaggaaggagggcaccggctggggcctgcctgagccccagggcaatgatgacaatgaccagaaggtgcacctgatcttcttcggcagctctgtgcgctggtttgagttcctgcaccctggccaggtgtaccgcctgattgcccctggccctgccacccccatgctgtttgagaaggatggcagcagctgcatcagcagaagacccctggagctggccggctgtgccagctgcctgactgtgcaggacaactggaccctggagctggagagcagccaggacatccaggatgtgctggatgccaacaagagcctgcctgagagcagcctgacagacctgctgagtgacaacttcacagacagcctggtgtccttctctgctgagatcctgagcaggaccctgtgtgagcccctggtggccagcctgtggatgaagctgggcaacacaggagccatgagaagatgtgtgaagctgactgtggccctggagacagcagaatgtgagttccccccccacctggatgtgtacatcgaggacccccacctgccccccagcctgggcctgctgcccggggcccgggtgcacttcagccagctggagaagagggtgagccgcagccacaacgtgtactgctgcttccgcagcagcacctacgtgcaggtgctgtccttccccccagagaccaccatcagcatccccctgccccacatctacctggccgagctgctgcagggcggccagagccccttccaggccacagccagctgccacatcgtgtctgtgttcagcctgcagctgttctgggtgtgtgcctactgcaccagcatctgccggcaggcccctgggggcggctgggactgccgcagcagaggagacctgtag

SEQ ID NO: 148652 - DNA, 843 bp, Artificial Sequence
  Description of Artificial Sequence: Synthetic coding sequence
atgcaggccaagtacagcagcacccgggacatgctggatgatgatggagacaccaccatgagcctgcacagccagggcagcgccaccaccaggcaccctgagcccaggagaacagagcaccgggcccccagcagcacctggaggcctgtggccctgaccctgctgaccctgtgcctggtgctgctgattggcctggccgccctgggcctgctcttcttccagtactaccagctgagcaacacaggccaggacaccatcagccagatggaggagcggctgggcaacaccagccaggagctgcagagcctgcaggtgcagaacatcaagctggccggcagcctgcagcacgtggccgagaagctgtgccgggagctgtacaacaaggccggggcccaccgctgcagcccctgcacagagcagtggaagtggcacggggacaactgctaccagttctacaaggacagcaagtcctgggaggactgcaagtacttctgcctgtctgagaacagcaccatgctgaagatcaacaagcaggaggacctggagtttgctgccagccagagctacagcgagttcttctacagctactggacaggcctgctgcggccagattctgggaaggcctggctgtggatggatggcacccccttcaccagcgagctgttccacatcatcattgatgtgaccagccccaggagccgggactgtgtggccatcctgaatggcatgatcttcagcaaggactgcaaggagctgaagagatgtgtgtgtgaaagaagagctggcatggtgaagccagagagcctgcacgtgcccccagagaccctgggggagggggactag

SEQ ID NO: 148653 - DNA, 213 bp, Artificial Sequence
  Description of Artificial Sequence: Synthetic coding sequence
atgcaggccaagtacagcagcacccgggacatgctggatgatgatggagacaccaccatgagcctgcacagccagggcagcgccaccaccaggcaccctgagcccaggagaacagagcaccgggcccccagcagcacctggaggcctgtggccctgaccctgctgaccctgtgcctggtgctgctgattggcctggccgccctgggcctgtag

SEQ ID NO: 148654 - DNA, 879 bp, Artificial Sequence
  Description of Artificial Sequence: Synthetic coding sequence
atgaccaggacctatgagaacttccagtacctggagaacaaggtgaaggtgcagggcttcaagaatggccccctgcccctgcagagcctgctgcagaggctgtgcagcggcccctgccacctgctgctgagcctgggcctgggcctgctgctgctggtgatcatctgtgtggtgggcttccagaacagcaagttccagagggacctggtgaccctgaggacagacttcagcaacttcaccagcaacacagtggccgagatccaggccctgaccagccagggcagcagcctggaggagaccatcgccagcctgaaggccgaggtggagggcttcaagcaggagcggcaggccgtgcacagcgagatgctgctgcgggtgcagcagctggtgcaggacctgaagaagctgacctgccaggtggccaccctgaacaacaacggggaggaggccagcacagagggcacctgctgccctgtgaactgggtggagcaccaggacagctgctactggttcagccacagcggcatgtcctgggccgaggccgagaagtactgccagctgaagaatgcccacctggtggtgatcaacagccgggaggagcagaactttgtgcagaagtacctgggcagcgcctacacctggatgggcctgagtgaccctgagggcgcctggaagtgggtggatggaacagattatgccaccggcttccagaactggaagccaggccagccagatgactggcagggccacggcctgggcggcggggaggactgtgcccacttccacccagatggccgctggaatgatgatgtgtgccagaggccctaccactgggtgtgtgaggccggcctgggccagaccagccaggagagccactag

SEQ ID NO: 148655 - DNA, 951 bp, Artificial Sequence
  Description of Artificial Sequence: Synthetic coding sequence
atgaccaggacctatgagaacttccagtacctggagaacaaggtgaaggtgcagggcttcaagaatggccccctgcccctgcagagcctgctgcagaggctgtgcagcggcccctgccacctgctgctgagcctgggcctgggcctgctgctgctggtgatcatctgtgtggtgggcttccagaacagcaagttccagagggacctggtgaccctgaggacagacttcagcaacttcaccagcaacacagtggccgagatccaggccctgaccagccagggcagcagcctggaggagaccatcgccagcctgaaggccgaggtggagggcttcaagcaggagcggcaggccggcgtgtctgagctgcaggagcacaccacccagaaggcccacctgggccactgcccccactgccccagcgtgtgtgtgcctgtgcacagcgagatgctgctgcgggtgcagcagctggtgcaggacctgaagaagctgacctgccaggtggccaccctgaacaacaatgccagcacagagggcacctgctgccctgtgaactgggtggagcaccaggacagctgctactggttcagccacagcggcatgtcctgggccgaggccgagaagtactgccagctgaagaatgcccacctggtggtgatcaacagccgggaggagcagaactttgtgcagaagtacctgggcagcgcctacacctggatgggcctgagtgaccctgagggcgcctggaagtgggtggatggaacagattatgccaccggcttccagaactggaagccaggccagccagatgactggcagggccacggcctgggcggcggggaggactgtgcccacttccacccagatggccgctggaatgatgatgtgtgccagaggccctaccactgggtgtgtgaggccggcctgggccagaccagccaggagagccactag

SEQ ID NO: 148656 - DNA, 879 bp, Artificial Sequence; identical to SEQ ID NO: 148654
  Description of Artificial Sequence: Synthetic coding sequence

SEQ ID NO: 148657 - DNA, 798 bp, Artificial Sequence
  Description of Artificial Sequence: Synthetic coding sequence
atgtctgaggaggtgacctacgccgacctgcagttccagaacagcagcgagatggagaagatccctgagatcggcaagtttggagagaaggcccccccagcccccagccacgtgtggaggcctgctgccctcttcctgaccctgctgtgcctgctgctgctgattggcctgggcgtgctggcctccatgtttcatgtgaccctgaagattgagatgaagaagatgaacaagctgcagaacatcagcgaggagctgcagaggaacatcagcctgcagctgatgagcaacatgaacatcagcaacaagatccggaacctgagcaccaccctgcagaccatcgccaccaagctgtgccgggagctgtacagcaaggagcaggagcacaagtgcaagccctgcccccggcgctggatctggcacaaggacagctgctacttcctgagtgatgatgtgcagacctggcaggagagcaagatggcctgtgccgcccagaatgccagcctgctgaagatcaacaacaagaatgccctggagttcatcaagagccagagccgctcctatgactactggctgggcctgagccctgaggaggacagcacccggggcatgagggtggacaacatcatcaacagcagcgcctgggtgatcagaaatgccccagacctgaacaacatgtactgcggctacatcaaccggctgtatgtgcagtactaccactgcacctacaagaagaggatgatctgtgagaagatggccaaccctgtgcagctgggcagcacctacttccgggaggcctag

SEQ ID NO: 148658 - DNA, 699 bp, Artificial Sequence
  Description of Artificial Sequence: Synthetic coding sequence
atgtctgaggaggtgacctacgccgacctgcagttccagaacagcagcgagatggagaagatccctgagatcggcaagtttggagagaaggtgcacgtgaccctgaagattgagatgaagaagatgaacaagctgcagaacatcagcgaggagctgcagaggaacatcagcctgcagctgatgagcaacatgaacatcagcaacaagatccggaacctgagcaccaccctgcagaccatcgccaccaagctgtgccgggagctgtacagcaaggagcaggagcacaagtgcaagccctgcccccggcgctggatctggcacaaggacagctgctacttcctgagtgatgatgtgcagacctggcaggagagcaagatggcctgtgccgcccagaatgccagcctgctgaagatcaacaacaagaatgccctggagttcatcaagagccagagccgctcctatgactactggctgggcctgagccctgaggaggacagcacccggggcatgagggtggacaacatcatcaacagcagcgcctgggtgatcagaaatgccccagacctgaacaacatgtactgcggctacatcaaccggctgtatgtgcagtactaccactgcacctacaagaagaggatgatctgtgagaagatggccaaccctgtgcagctgggcagcacctacttccgggaggcctag

SEQ ID NO: 148659 - DNA, 828 bp, Artificial Sequence
  Description of Artificial Sequence: Synthetic coding sequence
atgtggattgacttcttcacctacagctccatgtctgaggaggtgacctacgccgacctgcagttccagaacagcagcgagatggagaagatccctgagatcggcaagtttggagagaaggcccccccagcccccagccacgtgtggaggcctgctgccctcttcctgaccctgctgtgcctgctgctgctgattggcctgggcgtgctggcctccatgtttcatgtgaccctgaagattgagatgaagaagatgaacaagctgcagaacatcagcgaggagctgcagaggaacatcagcctgcagctgatgagcaacatgaacatcagcaacaagatccggaacctgagcaccaccctgcagaccatcgccaccaagctgtgccgggagctgtacagcaaggagcaggagcacaagtgcaagccctgcccccggcgctggatctggcacaaggacagctgctacttcctgagtgatgatgtgcagacctggcaggagagcaagatggcctgtgccgcccagaatgccagcctgctgaagatcaacaacaagaatgccctggagttcatcaagagccagagccgctcctatgactactggctgggcctgagccctgaggaggacagcacccggggcatgagggtggacaacatcatcaacagcagcgcctgggtgatcagaaatgccccagacctgaacaacatgtactgcggctacatcaaccggctgtatgtgcagtactaccactgcacctacaagaagaggatgatctgtgagaagatggccaaccctgtgcagctgggcagcacctacttccgggaggcctag

SEQ ID NO: 148660 - DNA, 264 bp, Artificial Sequence
  Description of Artificial Sequence: Synthetic coding sequence
cacaagtgcaagccctgcccccggcgctggatctggcacaaggacagctgctacttcctgagtgatgatgtgcagacctggcaggagagcaagatggcctgtgccgcccagaatgccagcctgctgaagatcaacaacaagaacatcttcagcgtcatcaagaagaagacagagaagttcttctggctgggcctgtcctgggacagcagcggccgctcctggttctgggaggatggctctgtgcccagccccagcctgtactag

SEQ ID NO: 148661 - DNA, 498 bp, Artificial Sequence
  Description of Artificial Sequence: Synthetic coding sequence
atgtctgaggaggtgacctacgccgacctgcagttccagaacagcagcgagatggagaagatccctgagatcggcaagtttggagagaaggcccccccagcccccagccacgtgtggaggcctgctgccctcttcctgaccctgctgtgcctgctgctgctgattggcctgggcgtgctggcctccatgtttcatgtgaccctgaagattgagatgaagaagatgaacaagctgcagaacatcagcgaggagctgcagaggaacatcagcctgcagctgatgagcaacatgaacatcagcaacaagatccggaacctgagcaccaccctgcagaccatcgccaccaagctgtgccgggagctgtacagcaaggagcaggagcacaagtgcaagccctgcccccggcgctggatctggcacaaggacagctgctacttcctgagtgatgatgtgcagacctggcaggagagcaagatggcctgtgccgcccagaactag

SEQ ID NO: 148662 - DNA, 642 bp, Artificial Sequence
  Description of Artificial Sequence: Synthetic coding sequence
atgtctgaggaggtgacctacgccgacctgcagttccagaacagcagcgagatggagaagatccctgagatcggcaagtttggagagaaggcccccccagcccccagccacgtgtggaggcctgctgccctcttcctgaccctgctgtgcctgctgctgctgattggcctgggcgtgctggcctccatgtttcatgtgaccctgaagattgagatgaagaagatgaacaagctgcagaacatcagcgaggagctgcagaggaacatcagcctgcagctgatgagcaacatgaacatcagcaacaagatccggaacctgagcaccaccctgcagaccatcgccaccaagctgtgccgggagctgtacagcaaggagcaggagcacaagtgcaagccctgcccccggcgctggatctggcacaaggacagctgctacttcctgagtgatgatgtgcagacctggcaggagagcaagatggcctgtgccgcccagaatgccagcctgctgaagatcaacaacaagaatgccctggagttcatcaagagccagagccgctcctatgactactggctgggcctgagccctgaggaggacagcacccggggcatgagggtggacaacatcatcaacagcagcgcctag

SEQ ID NO: 148663 - DNA, 423 bp, Artificial Sequence
  Description of Artificial Sequence: Synthetic coding sequence
atggccgccaccggcttcagcgcccccaacggcagctgccacggcaccagcaggacagtgaacagtgatgcccccatgagccctgagctgcccaagccccacctgcctgaccagctggtgattgtgaatgaaacagaagctgacagcaagcccagcaagaatgtggcccggtctgctgctgtggagacagccagcctgagccccagcctggtgcctgcccggcagcccaccatcagcctgctgtgtgaggacacagctgacaccctgtctgtggagagcctgaccctggtgccccctgtggacccccacagcctgcggagcctgaccggcatgccacccctgagcaccccagctgctgcctgcacagagcctgtgggggaggaggccgcctgtgccgagcctgtgggcacagcagaagattag

SEQ ID NO: 148664 - DNA, 2721 bp, Artificial Sequence
  Description of Artificial Sequence: Synthetic coding sequence
atgtttggccgcagccgctcctgggtgggcggcggccacggcaagaccagcaggaacatccacagcctggaccacctgaagtacctgtaccacgtgctgaccaagaacaccaccgtgacagagcagaacagaaacctgctggtggagaccatccgcagcatcacagagatcctgatctggggagaccagaatgacagctctgtgtttgacttcttcctggagaagaacatgtttgtgttcttcctgaacatcctgcggcagaagagcggccgctacgtgtgtgtgcagctgctgcagaccctgaacatcctgtttgagaacatcagccatgagaccagcctgtactacctgctgagcaacaactacgtgaacagcatcatcgtgcacaagtttgacttcagtgatgaggagatcatggcctactacatctccttcctgaagaccctgagcctgaagctgaacaaccacacagtgcacttcttctacaatgagcacaccaatgactttgccctgtacacagaggccatcaagttcttcaaccaccctgagagcatggtgagaattgctgtgaggaccatcaccctgaatgtgtacaaggtggacaaccaggccatgctgcactacatccgggacaagacagctgtgccctacttcagcaacctggtgtggttcatcggcagccacgtgattgagctggatgactgtgtgcagacagatgaggagcacaggaacagaggcaagctgagtgacctggtggccgagcacctggaccacctgcactacctgaatgacatcctgatcatcaactgtgagttcctgaatgatgtgctgacagaccacctgctgaacagactcttcctgcccctgtatgtgtacagcctggagaaccaggacaagggcggggagcggcccaagatcagcctgcctgtgtccctgtacctgctgagccaggtgttcctgatcatccaccacgcccccctggtgaacagcctggccgaggtgatcctgaatggagacctgtctgagatgtatgccaagacagagcaggacatccagaggagcagcgccaagcccagcatccgctgcttcatcaagcccacagagaccctggagaggagcctggagatgaacaagcacaagggcaagagaagagtgcagaagaggcccaactacaagaatgtgggggaggaggaggatgaggagaagggccccacagaagatgcccaggaggatgctgagaaggccaaggagattgagatggtgatcatggagaggagcaagctgtctgagctggccgccagcacctctgtgcaggagcagaacaccacagatgaggagaagtctgctgctgccacctgcagcgagagcacccagtggagccggcccttcctggacatggtgtaccacgccctggacagcccagatgatgactaccacgccctgtttgtgctgtgcctgctgtatgccatgagccacaacaagggcatggaccctgagaagctggagcgcatccagctgcctgtgcccaatgctgctgagaagaccacctacaaccaccccctggccgagcggctcatccgcatcatgaacaatgctgcccagccagatggcaagatccggctggccaccctggagctgagctgcctgctgctgaagcagcaggtgctgatgtctgctggctgcatcatgaaggatgtgcacctggcctgcctggagggcgcccgggaggagagcgtgcacctggtgcgccacttctacaagggggaggacatcttcctggacatgtttgaagatgagtaccgctccatgaccatgaagcccatgaatgtggagtacctgatgatggatgccagcatcctgctgccccccaccggcacccccctgactggaattgactttgtgaagaggctgccctgtggagatgtggagaagacccggcgggccatccgggtcttcttcatgctgcggagcctgagcctgcagctgcggggggagcctgagacccagctgcccctgacccgggaggaggacctgatcaagacagatgatgtgctggacctgaacaacagcgacctgattgcctgcaccgtcatcaccaaggatggcggcatggtgcagcgcttcctggccgtggacatctaccagatgagcctggtggagccagatgtgtcccggctgggctggggcgtggtgaagtttgctggcctgctgcaggacatgcaggtgactggagtggaggatgacagccgggccctgaacatcaccatccacaagccagccagcagcccccacagcaagcccttccccatcctgcaggccaccttcatcttcagtgaccacatccgctgcatcatcgccaagcagaggctggccaagggccgcatccaggcccggaggatgaagatgcagagaattgctgccctgctggacctgcccatccagcccaccacagaggtgctgggcttcggcctgggcagcagcaccagcacccagcacctgcccttccgcttctatgaccagggccggcggggcagcagtgaccccaccgtgcagaggtctgtgtttgcctctgtggacaaggtgcctggagagcccgcccccaggcctgccccccagctggtgcaccacggcggccgcagccgctccttcagcctgtggagcctgtgtgagctgcccttcctgagccagaagccccggcggctggccgccccagccagctag

SEQ ID NO: 148665 - DNA, 3162 bp, Artificial Sequence
  Description of Artificial Sequence: Synthetic coding sequence
atgtttggccgcagccgctcctgggtgggcggcggccacggcaagaccagcaggaacatccacagcctggaccacctgaagtacctgtaccacgtgctgaccaagaacaccaccgtgacagagcagaacagaaacctgctggtggagaccatccgcagcatcacagagatcctgatctggggagaccagaatgacagctctgtgtttgacttcttcctggagaagaacatgtttgtgttcttcctgaacatcctgcggcagaagagcggccgctacgtgtgtgtgcagctgctgcagaccctgaacatcctgtttgagaacatcagccatgagaccagcctgtactacctgctgagcaacaactacgtgaacagcatcatcgtgcacaagtttgacttcagtgatgaggagatcatggcctactacatctccttcctgaagaccctgagcctgaagctgaacaaccacacagtgcacttcttctacaatgagcacaccaatgactttgccctgtacacagaggccatcaagttcttcaaccaccctgagagcatggtgagaattgctgtgaggaccatcaccctgaatgtgtacaaggtgtccctggacaaccaggccatgctgcactacatccgggacaagacagctgtgccctacttcagcaacctggtgtggttcatcggcagccacgtgattgagctggatgactgtgtgcagacagatgaggagcacaggaacagaggcaagctgagtgacctggtggccgagcacctggaccacctgcactacctgaatgacatcctgatcatcaactgtgagttcctgaatgatgtgctgacagaccacctgctgaacagactcttcctgcccctgtatgtgtacagcctggagaaccaggacaagggcggggagcggcccaagatcagcctgcctgtgtccctgtacctgctgagccaggtgttcctgatcatccaccacgcccccctggtgaacagcctggccgaggtgatcctgaatggagacctgtctgagatgtatgccaagacagagcaggacatccagaggagcagcgccaagcccagcatccgctgcttcatcaagcccacagagaccctggagaggagcctggagatgaacaagcacaagggcaagagaagagtgcagaagaggcccaactacaagaatgtgggggaggaggaggatgaggagaagggccccacagaagatgcccaggaggatgctgagaaggccaagggcacagagggcggcagcaagggcatcaagaccagcggggagagcgaggagattgagatggtgatcatggagaggagcaagctgtctgagctggccgccagcacctctgtgcaggagcagaacaccacagatgaggagaagtctgctgctgccacctgcagcgagagcacccagtggagccggcccttcctggacatggtgtaccacgccctggacagcccagatgatgactaccacgccctgtttgtgctgtgcctgctgtatgccatgagccacaacaagggcatggaccctgagaagctggagcgcatccagctgcctgtgcccaatgctgctgagaagaccacctacaaccaccccctggccgagcggctcatccgcatcatgaacaatgctgcccagccagatggcaagatccggctggccaccctggagctgagctgcctgctgctgaagcagcaggtgctgatgtctgctggctgcatcatgaaggatgtgcacctggcctgcctggagggcgcccgggaggagagcgtgcacctggtgcgccacttctacaagggggaggacatcttcctggacatgtttgaagatgagtaccgctccatgaccatgaagcccatgaatgtggagtacctgatgatggatgccagcatcctgctgccccccaccggcacccccctgactggaattgactttgtgaagaggctgccctgtggagatgtggagaagacccggcgggccatccgggtcttcttcatgctgcggagcctgagcctgcagctgcggggggagcctgagacccagctgcccctgacccgggaggaggacctgatcaagacagatgatgtgctggacctgaacaacagcgacctgattgcctgcaccgtcatcaccaaggatggcggcatggtgcagcgcttcctggccgtggacatctaccagatgagcctggtggagccagatgtgtcccggctgggctggggcgtggtgaagtttgctggcctgctgcaggacatgcaggtgactggagtggaggatgacagccgggccctgaacatcaccatccacaagccagccagcagcccccacagcaagcccttccccatcctgcaggccaccttcatcttcagtgaccacatccgctgcatcatcgccaagcagaggctggccaagggccgcatccaggcccggaggatgaagatgcagagaattgctgccctgctggacctgcccatccagcccaccacagaggtgctgggcttcggcctgggcagcagcaccagcacccagcacctgcccttccgcttctatgaccagggccggcggggcagcagtgaccccaccgtgcagaggtctgtgtttgcctctgtggacaaggtgcccggctttgctgtggcccagtgcatcaaccagcacagcagccccagcctgagcagccagagccccccatctgccagcggcagccccagcggcagcggcagcaccagccactgtgacagcggcggcaccagcagcagcagcacccccagcacagcccagagccctgcagatgcccccatgagccctgagctgcccaagccccacctgcctgaccagctggtgattgtgaatgaaacagaggccgacagcaagcccagcaagaatgtggcccggtctgctgctgtggagacagccagcctgagccccagcctggtgcctgcccggcagcccaccatcagcctgctgtgtgaggacacagctgacaccctgtctgtggagagcctgaccctggtgccccctgtggacccccacagcctgcggagcctgaccggcatgccacccctgagcaccccagctgctgcctgcacagagcctgtgggggaggaggccgcctgtgccgagcctgtgggcacagctgaggactag

SEQ ID NO: 148666 - DNA, 3162 bp, Artificial Sequence
  Description of Artificial Sequence: Synthetic coding sequence
atgtttggccgcagccgctcctgggtgggcggcggccacggcaagaccagcaggaacatccacagcctggaccacctgaagtacctgtaccacgtgctgaccaagaacaccaccgtgacagagcagaacagaaacctgctggtggagaccatccgcagcatcacagagatcctgatctggggagaccagaatgacagctctgtgtttgacttcttcctggagaagaacatgtttgtgttcttcctgaacatcctgcggcagaagagcggccgctacgtgtgtgtgcagctgctgcagaccctgaacatcctgtttgagaacatcagccatgagaccagcctgtactacctgctgagcaacaactacgtgaacagcatcatcgtgcacaagtttgacttcagtgatgaggagatcatggcctactacatctccttcctgaagaccctgagcctgaagctgaacaaccacacagtgcacttcttctacaatgagcacaccaatgactttgccctgtacacagaggccatcaagttcttcaaccaccctgagagcatggtgagaattgctgtgaggaccatcaccctgaatgtgtacaaggtgtctgtggacaaccaggccatgctgcactacatccgggacaagacagctgtgccctacttcagcaacctggtgtggttcatcggcagccacgtgattgagctggatgactgtgtgcagacagatgaggagcacaggaacagaggcaagctgagtgacctggtggccgagcacctggaccacctgcactacctgaatgacatcctgatcatcaactgtgagttcctgaatgatgtgctgacagaccacctgctgaacagactcttcctgcccctgtatgtgtacagcctggagaaccaggacaagggcggggagcggcccaagatcagcctgcctgtgtccctgtacctgctgagccaggtgttcctgatcatccaccacgcccccctggtgaacagcctggccgaggtgatcctgaatggagacctgtctgagatgtatgccaagacagagcaggacatccagaggagcagcgccaagcccagcatccgctgcttcatcaagcccacagagaccctggagaggagcctggagatgaacaagcacaagggcaagagaagagtgcagaagaggcccaactacaagaatgtgggggaggaggaggatgaggagaagggccccacagaagatgcccaggaggatgctgagaaggccaagggcacagagggcggcagcaagggcatcaagaccagcggggagagcgaggagattgagatggtgatcatggagaggagcaagctgtctgagctggccgccagcacctctgtgcaggagcagaacaccacagatgaggagaagtctgctgctgccacctgcagcgagagcacccagtggagccggcccttcctggacatggtgtaccacgccctggacagcccagatgatgactaccacgccctgtttgtgctgtgcctgctgtatgccatgagccacaacaagggcatggaccctgagaagctggagcgcatccagctgcctgtgcccaatgctgctgagaagaccacctacaaccaccccctggccgagcggctcatccgcatcatgaacaatgctgcccagccagatggcaagatccggctggccaccctggagctgagctgcctgctgctgaagcagcaggtgctgatgtctgctggctgcatcatgaaggatgtgcacctggcctgcctggagggcgcccgggaggagagcgtgcacctggtgcgccacttctacaagggggaggacatcttcctggacatgtttgaagatgagtaccgctccatgaccatgaagcccatgaatgtggagtacctgatgatggatgccagcatcctgctgccccccaccggcacccccctgactggaattgactttgtgaagaggctgccctgtggagatgtggagaagacccggcgggccatccgggtcttcttcatgctgcggagcctgagcctgcagctgcggggggagcctgagacccagctgcccctgacccgggaggaggacctgatcaagacagatgatgtgctggacctgaacaacagcgacctgattgcctgcaccgtcatcaccaaggatggcggcatggtgcagcgcttcctggccgtggacatctaccagatgagcctggtggagccagatgtgtcccggctgggctggggcgtggtgaagtttgctggcctgctgcaggacatgcaggtgactggagtggaggatgacagccgggccctgaacatcaccatccacaagccagccagcagcccccacagcaagcccttccccatcctgcaggccaccttcatcttcagtgaccacatccgctgcatcatcgccaagcagaggctggccaagggccgcatccaggcccggaggatgaagatgcagagaattgctgccctgctggacctgcccatccagcccaccacagaggtgctgggcttcggcctgggcagcagcaccagcacccagcacctgcccttccgcttctatgaccagggccggcggggcagcagtgaccccaccgtgcagaggtctgtgtttgcctctgtggacaaggtgcccggctttgctgtggcccagtgcatcaaccagcacagcagccccagcctgagcagccagagccccccatctgccagcggcagccccagcggcagcggcagcaccagccactgtgacagcggcggcaccagcagcagcagcacccccagcacagcccagagccctgcagatgcccccatgagccctgagctgcccaagccccacctgcctgaccagctggtgattgtgaatgaaacagaggccgacagcaagcccagcaagaatgtggcccggtctgctgctgtggagacagccagcctgagccccagcctggtgcctgcccggcagcccaccatcagcctgctgtgtgaggacacagctgacaccctgtctgtggagagcctgaccctggtgccccctgtggacccccacagcctgcggagcctgaccggcatgccacccctgagcaccccagctgctgcctgcacagagcctgtgggggaggaggccgcctgtgccgagcctgtgggcacagctgaggactag

SEQ ID NO: 148667 - DNA, 288 bp, Artificial Sequence
  Description of Artificial Sequence: Synthetic coding sequence
atgcatgacagcaacaacgtggagaaggacatcacccccagcgagctgcctgccaacccagccatccgggccaactgccaccaggagcccagcgtgtgcctgcaggccgcctgcccagagagctggattggcttccagaggaagtgcttctacttcagtgatgacaccaagaactggaccagcagccagcgcttctgtgacagccaggatgctgacctggcccaggtggagagcttccaggagctggtgtcctacccaggcagcagaagagtgtgcctgtttgaatag

SEQ ID NO: 148668 - DNA, 525 bp, Artificial Sequence
  Description of Artificial Sequence: Synthetic coding sequence
atgatcaaccctgagctgagagatggccgggcagatggcttcatccaccgcatcgtgcccaagctgatccagaactggaagattggcctgatgtgcttcctgagcatcatcatcaccaccgtgtgcatcatcatgattgccacctggagcaagcacgccaagcctgtggcctgcagcggggactggctgggcgtgcgggacaagtgcttctacttcagtgatgacaccaggaactggacagccagcaagatcttctgcagcctgcagaaggccgagctggcccagattgacacccaggaggacatggagttcctgaagagatatgccggcacagacatgcactggattggcctgagcaggaagcagggcgacagctggaagtggaccaacggcaccaccttcaacggctggtttgagatcattggaaatggcagctttgccttcctgtctgcagatggagtgcacagcagccggggcttcatcgacatcaagtggatctgcagcaagcccaagtacttcctgtag

SEQ ID NO: 148669 - DNA, 2406 bp, Artificial Sequence
  Description of Artificial Sequence: Synthetic coding sequence
atgcaccacaggatgaatgagatgaacctgagccctgtgggcatggagcagctgaccagcagctctgtgtccaatgccctgcctgtgtctggcagccacctgggcctggccgccagccccacccacagcgccatcccagcccctggcctgcctgtggccatccccaacctgggccccagcctgagcagcctgcccagcgccctgagcctgatgctgcccatgggcatcggggaccggggcgtgatgtgtggcctgcctgagaggaactacaccctgcccccaccaccctacccccacctggagagcagctacttccgcaccatcctgcccggcatcctgagctacctggccgaccggcccccaccccagtacatccaccccaacagcatcaacgtggatggcaacacagccctgagcatcaccaacaaccccagcgccctggacccctaccagagcaatggaaatgtgggcctggagcccggcatcgtgtccattgacagccgctctgtgaacacccatggagcccagagcctgcaccccagtgatggccacgaggtggccctggacacagccatcaccatggagaatgtgtcccgggtgaccagccccatcagcacagatggcatggccgaggagctgaccatggatggagtggccggggagcacagccagatccccaacggcagccgcagccatgagcccctgtctgtggacagcgtgagcaacaacctggccgcagatgctgtgggccatggaggagtcatccccatgcacggcaatggcctggagctgcctgtggtgatggagacagaccacatcgccagccgggtgaatggcatgtctgattctgccctgagtgacagcatccacacagtggccatgagcaccaacagcgtgtctgtggccctgagcaccagccacaacctggccagcctggagagcgtgtccctgcacgaggtgggcctgagcctggagcctgtggccgtgagcagcatcacccaggaggtggccatgggcaccggccacgtggatgtgtccagtgacagcctgagctttgtgagccccagcctgcagatggaggacagcaacagcaacaaggagaacatggccaccctcttcaccatctggtgcaccctgtgtgaccgggcctaccccagcgactgcccagagcacggccctgtgacctttgtgcctgacacccccatcgagagccgggcccggctgagcctgcccaagcagctggtgctgcggcagagcatcgtgggcgctgaggtgggcgtgtggacaggagagaccatccctgtgaggacctgcttcggccccctgattggccagcagagccacagcatggaggtggccgagtggacagacaaggctgtgaaccacatctggaagatctaccacaatggagtgctggagttctgcatcatcaccacagatgaaaatgaatgcaactggatgatgtttgtgaggaaggccaggaaccgggaggagcagaacctggtggcctacccccatgatggcaagatcttcttctgcaccagccaggacatccccccagaaaatgagctgctcttctactacagccgggactatgcccagcagatcggcgtgcctgagcacccagatgtgcacctgtgcaactgtgggaaggagtgcaacagctacacagagttcaaggcccacctgaccagccacatccacaaccacctgcccacccagggccacagcggcagccacggccccagccacagcaaggagaggaagtggaagtgcagcatgtgcccccaggccttcatcagccccagcaagctgcacgtgcacttcatgggccacatgggcatgaagccccacaagtgtgacttctgcagcaaggccttcagtgaccccagcaacctgcggacccacctgaagatccacacaggccagaagaactaccgctgcaccctgtgtgacaagagcttcacccagaaggcccacctggagagccacatggtgatccacactggagagaagaacctgaagtgtgactactgtgacaagctgttcatgaggcggcaggacctgaagcagcacgtgctgatccacacccaggagcggcagatcaagtgccccaagtgtgacaagctgttcctgcggaccaaccacctgaagaagcacctgaacagccatgagggcaagagggactatgtgtgtgagaagtgcaccaaggcctacctgaccaagtaccacctgaccaggcacctgaagacctgcaagggccccaccagcagcagcagcgcccctgaggaggaggaggaggatgacagcgaggaggaggacctggccgacagcgtgggcacagaggactgccgcatcaacagcgctgtgtacagcgcagatgagagcctgagcgcccacaagtag

SEQ ID NO: 148670 - DNA, 465 bp, Artificial Sequence
  Description of Artificial Sequence: Synthetic coding sequence
atgcatgacagcaacaacgtggagaaggacatcacccccagcgagctgcctgccaacccagccatccgggccaactgccaccaggagcccagcgtgtgcctgcaggccgcctgcccagagagctggattggcttccagaggaagtgcttctacttcagtgatgacaccaagaactggaccagcagccagcgcttctgtgacagccaggatgctgacctggcccaggtggagagcttccaggagctgaacttcctgctgcgctacaagggccccagcgaccactggattggcctgagccgggagcagggccagccctggaagtggatcaatggaacagagtggacccggcagttccccatcctgggcgctggagaatgtgcctacctgaatgacaagggggccagcagcgcccggcactacacagagaggaagtggatctgcagcaagagtgacatccacgtgtag

SEQ ID NO: 148671 - DNA, 585 bp, Artificial Sequence
  Description of Artificial Sequence: Synthetic coding sequence
atgcatgacagcaacaacgtggagaaggacatcacccccagcgagctgcctgccaaccctggctgcctgcacagcaaggagcacagcatcaaggccaccctcatctggaggctcttcttcctgatcatgttcctgaccatcatcgtgtgtggcatggtggccgccctgagcgccatccgggccaactgccaccaggagcccagcgtgtgcctgcaggccgcctgcccagagagctggattggcttccagaggaagtgcttctacttcagtgatgacaccaagaactggaccagcagccagcgcttctgtgacagccaggatgctgacctggcccaggtggagagcttccaggagctgaacttcctgctgcgctacaagggccccagcgaccactggattggcctgagccgggagcagggccagccctggaagtggatcaatggaacagagtggacccggcagctggtgatgaaggaggatggagccaacctgtatgtggccaaggtgtcccaggtgcccaggatgaaccccaggcctgtgatggtgtcctacccaggcagccggcgggtgtgcctgtttgaatag

SEQ ID NO: 148672 - DNA, 576 bp, Artificial Sequence
  Description of Artificial Sequence: Synthetic coding sequence
atgcatgacagcaacaacgtggagaaggacatcacccccagcgagctgcctgccaaccctggctgcctgcacagcaaggagcacagcatcaaggccaccctcatctggaggctcttcttcctgatcatgttcctgaccatcatcgtgtgtggcatggtggccgccctgagcgccatccgggccaactgccaccaggagcccagcgtgtgcctgcaggccgcctgcccagagagctggattggcttccagaggaagtgcttctacttcagtgatgacaccaagaactggaccagcagccagcgcttctgtgacagccaggatgctgacctggcccaggtggagagcttccaggagctgaacttcctgctgcgctacaagggccccagcgaccactggattggcctgagccgggagcagggccagccctggaagtggatcaatggaacagagtggacccggcagttccccatcctgggcgctggggagtgtgcctacctgaatgacaagggggccagcagcgcccggcactacacagagaggaagtggatctgcagcaagagtgacatccacgtgtag

SEQ ID NO: 148673 - DNA, 399 bp, Artificial Sequence
  Description of Artificial Sequence: Synthetic coding sequence
atgcatgacagcaacaacgtggagaaggacatcacccccagcgagctgcctgccaaccctggctgcctgcacagcaaggagcacagcatcaaggccaccctcatctggaggctcttcttcctgatcatgttcctgaccatcatcgtgtgtggcatggtggccgccctgagcgccatccgggccaactgccaccaggagcccagcgtgtgcctgcaggccgcctgcccagagagctggattggcttccagaggaagtgcttctacttcagtgatgacaccaagaactggaccagcagccagcgcttctgtgacagccaggatgctgacctggcccaggtggagagcttccaggagctggtgtcctacccaggcagccggcgggtgtgcctgtttgaatag

SEQ ID NO: 148674 - DNA, 891 bp, Artificial Sequence
  Description of Artificial Sequence: Synthetic coding sequence
atgtctgacagcaaggagccccgggtgcagcagctgggcctgctgggctgcctgggccacggggccctggtgctgcagctgctgtccttcatgctgctggccggcgtgctggtggccatcctggtgcaggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagctgcctgctgtgctggagcagtggaggacccagcagtag

SEQ ID NO: 148675 - DNA, 2379 bp, Artificial Sequence
  Description of Artificial Sequence: Synthetic coding sequence
atggccgcccccagcctgctgaactggaggagagtgagcagcttcaccggccctgtgccccgggcccggcacggccacagagctgtggccatccgggagctgatgatcatctttggaggcggcaatgaaggaattgctgatgagctgcacgtgtacaacacagccaccaaccagtggttcctgcctgctgtgcggggggacatccccccaggctgtgccgcccacggctttgtgtgtgatggcacccgcatcctggtgtttggaggcatggtggagtatggccgctacagcaatgagctgtatgagctgcaggccagccgctggctgtggaagaaggtgaagccccaccccccacccagcggcctgcccccctgcccccggctgggccacagcttcagcctgtatggcaacaagtgctacctgtttggaggcctggccaatgaaagtgaggacagcaacaacaacgtgccccgctacctgaatgacttctatgagctggagctgcagcacggcagcggcgtggtgggctggagcatccctgtgaccaagggcgtggtgcccagcccccgggagagccacacagctgtgatctactgcaagaaggacagcggcagccccaagatgtatgtgtttggaggcatgtgtggggcccggctggatgacctgtggcagctggacctggagaccatgtcctggagcaagccagagaccaagggcaccgtgcccctgcccaggagcctgcacacagcctctgtgattggcaacaagatgtacatctttggaggctgggtgccccacaagggagaaaatacagagaccagcccccatgactgtgagtggcgctgcaccagcagcttctcctacctgaacctggacaccacagagtggaccaccctggtgtctgacagccaggaggacaagaagaacagccggccccggccccgggccggccactgtgctgtggccatcggcacccggctgtacttctggagcggcagagatggctacaagaaggccctgaacagccaggtgtgctgcaaggacctgtggtacctggacacagagaagcccccagcccccagccaggtgcagctgatcaaggccaccaccaacagcttccacgtgaagtgggatgaggtgtccacagtggagggctacctgctgcagctgagcacagacctgccctaccaggccgccagcagtgacagcagcgctgcccccaacatgcagggcgtgaggatggacccccaccggcagggcagcaacaacatcgtgcccaacagcatcaatgacaccatcaacagcaccaagacagagcagcctgccaccaaggagacctccatgaagaacaagccagacttcaaggccctgacagacagcaatgccatcctgtaccccagcctggccagcaatgccagcaaccacaacagccacgtggtggacatgctgaggaagaatgaaggcccccacaccagcgccaacgtgggcgtgctgagcagctgcctggatgtgaggacagtcatccctgagacctctgtgagcagcacagtgagcagcacccagaccatggtgacccagcagaccatcaagacagagagcagcagcaccaatggagctgtggtgaaggatgagaccagcctgaccaccttcagcaccaagtctgaggtggatgagacctacgccctgcctgccaccaagatcagccgggtggagacccacgccacagccacccccttcagcaaggagacccccagcaaccctgtggccaccgtgaaggccggggagcggcagtggtgtgatgtgggcatcttcaagaacaacacagccctggtgtcccagttctacctgctgcccaagggcaagcagagcatcagcaaggtgggcaatgctgatgtgcctgactacagcctgctgaagaagcaggacctggtgcccggcaccggctaccgcttccgggtggccgccatcaatggctgcggcatcggccccttcagcaagatcagcgagttcaagacctgcatccctggcttccctggggcccccagcgctgtgcgcatcagcaagaatgtggagggcatccacctgtcctgggagccccccaccagccccagcggcaacatcctggagtacagcgcctacctggccatcagaacagcccagatccaggacaaccccagccagctggtgttcatgaggatctactgcggcctgaagaccagctgcatcgtgacagctggccagctggccaatgcccacatcgactacaccagcaggcctgccatcgtgttccgcatcagcgccaagaatgagaagggctacggccctgccacccaggtgcgctggctgcagggcaacaacaagaaggcccccctgaactag

SEQ ID NO: 148676 - DNA, 498 bp, Artificial Sequence
  Description of Artificial Sequence: Synthetic coding sequence
atgaccagcgagatcacctacgccgaggtgcgcttcaagaatgagttcaagagcagcggcatcaacacagccagcagcgctgagacagcctggagctgctgccccaagaactggaagagcttcagcagcaactgctacttcatcagcacagagagcgcctcctggcaggacagcgagaaggactgtgccaggatggaggcccacctgctggtgatcaacacccaggaggagcaggacttcatcttccagaacctgcaggaggagagcgcctactttgtgggcctgagtgaccctgagggccagaggcactggcagtgggtggaccagaccccctacaatgaaagcagcaccttctggcacccccgggagcccagcgaccccaatgaaagatgtgtggtgctgaacttcaggaagagccccaagcgctggggctggaatgatgtgaactgcctgggcccccagaggtctgtgtgtgagatgatgaagatccacctgtag

SEQ ID NO: 148677 - DNA, 615 bp, Artificial Sequence
  Description of Artificial Sequence: Synthetic coding sequence
atgaccagcgagatcacctacgccgaggtgcgcttcaagaatgagttcaagagcagcggcatcaacacagccagcagcgctgccagcaaggagaggacagccccccacaagagcaacacaggcttccccaagctgctgtgtgccagcctgctgatcttcttcctgctgctggccatctccttcttcatcgcctttgtgaagacagcctggagctgctgccccaagaactggaagagcttcagcagcaactgctacttcatcagcacagaaagtgcctcctggcaggacagcgagaaggactgtgccaggatggaggcccacctgctggtgatcaacacccaggaggagcaggacttcatcttccagaacctgcaggaggagagcgcctactttgtgggcctgagtgaccctgagggccagaggcactggcagtgggtggaccagaccccctacaatgaaagcagcaccttctggcacccccgggagcccagcgaccccaatgaaagatgtgtggtgctgaacttcaggaagagccccaagcgctggggctggaatgatgtgaactgcctgggcccccagaggtctgtgtgtgagatgatgaagatccacctgtag

SEQ ID NO: 148678 - DNA, 597 bp, Artificial Sequence
  Description of Artificial Sequence: Synthetic coding sequence
atgaccagcgagatcacctacgccgaggtgcgcttcaagaatgagttcaagagcagcggcatcaacacagccagcagcgctgtgttcttccagaagtacagccagctgctggagaagaagaccaccaaggagctggtgcacaccaccctggagtgtgtgaagaagaacatgcctgtggaggagacagcctggagctgctgccccaagaactggaagagcttcagcagcaactgctacttcatcagcacagaaagtgcctcctggcaggacagcgagaaggactgtgccaggatggaggcccacctgctggtgatcaacacccaggaggagcaggacttcatcttccagaacctgcaggaggagagcgcctactttgtgggcctgagtgaccctgagggccagaggcactggcagtgggtggaccagaccccctacaatgaaagcagcaccttctggcacccccgggagcccagcgaccccaatgaaagatgtgtggtgctgaacttcaggaagagccccaagcgctggggctggaatgatgtgaactgcctgggcccccagaggtctgtgtgtgagatgatgaagatccacctgtag

SEQ ID NO: 148679 - DNA, 549 bp, Artificial Sequence
  Description of Artificial Sequence: Synthetic coding sequence
atggtgcctgaggaggagccccaggacagagtgccccacaacttcatgtacagcaagacagtgaagaggctgagcaagctgcgggagtaccagcagtaccaccccagcctgacctgtgtgatggagggcaaggacatcgaggactggagctgctgccccaccccctggaccagcttccagagcagctgctacttcatcagcacaggcatgcagagctggaccaagagccagaagaactgcagcgtgatgggcgctgacctggtggtgatcaacacccgggaggagcaggacttcatcatccagaacctgaagaggaacagcagctacttcctgggcctgagtgaccccggcggcagaagacactggcagtgggtggaccagaccccctacaatgaaaatgtgaccttctggcacagcggggagcccaacaacctggatgagcgctgtgccatcatcaacttccgcagcagcgaggagtggggctggaatgacatccactgccacgtgccccagaagagcatctgcaagatgaagaagatctacatctag

SEQ ID NO: 148680 - DNA, 642 bp, Artificial Sequence
  Description of Artificial Sequence: Synthetic coding sequence
atggtgcctgaggaggagccccaggaccgggagaagggcctgtggtggttccagctgaaggtgtggagcatggctgtggtgtccatcctgctgctgtctgtgtgcttcaccgtgtcctctgtggtgccccacaacttcatgtacagcaagacagtgaagaggctgagcaagctgcgggagtaccagcagtaccaccccagcctgacctgtgtgatggagggcaaggacatcgaggactggagctgctgccccaccccctggaccagcttccagagcagctgctacttcatcagcacaggcatgcagagctggaccaagagccagaagaactgcagcgtgatgggcgctgacctggtggtgatcaacacccgggaggagcaggacttcatcatccagaacctgaagaggaacagcagctacttcctgggcctgagtgaccccggcggccgccgccactggcagtgggtggaccagaccccctacaatgaaaatgtgaccttctggcacagcggggagcccaacaacctggatgagcgctgtgccatcatcaacttccgcagcagcgaggagtggggctggaatgacatccactgccacgtgccccagaagagcatctgcaagatgaagaagatctacatctag

SEQ ID NO: 148681 - DNA, 549 bp, Artificial Sequence; identical to SEQ ID NO: 148679
  Description of Artificial Sequence: Synthetic coding sequence

SEQ ID NO: 148682 - DNA, 642 bp, Artificial Sequence; identical to SEQ ID NO: 148680
  Description of Artificial Sequence: Synthetic coding sequence

SEQ ID NO: 148683 - DNA, 648 bp, Artificial Sequence
  Description of Artificial Sequence: Synthetic coding sequence
atgggcctggagaagccccagagcaagctggagggcggcatgcacccccagctgatccccagcgtgattgctgtggtgttcatcctgctgctgtctgtgtgcttcatcgccagctgcctggtgacccaccacaacttcagccgctgcaagaggggcactggagtgcacaagctggagcaccacgccaagctgaagtgcatcaaggagaagtctgagctgaagtctgctgagggcagcacctggaactgctgccccatcgactggagggccttccagagcaactgctacttccccctgacagacaacaagacctgggccgagagcgagaggaactgcagcggcatgggcgcccacctgatgaccatcagcacagaggccgagcagaacttcatcatccagttcctggaccggcggctgagctacttcctgggcctgagagatgaaaatgccaagggccagtggcgctgggtggaccagacccccttcaaccccaggagggtcttctggcacaagaatgaaccagacaacagccagggcgagaactgtgtggtgctggtgtacaaccaggacaagtgggcctggaatgatgtgccctgcaactttgaggccagccgcatctgcaagatccctggcaccaccctgaactag

SEQ ID NO: 148684 - DNA, 435 bp, Artificial Sequence
  Description of Artificial Sequence: Synthetic coding sequence
atgggcctggagaagccccagagcaagctggagggcggcatgcacccccagctgatccccagcgtgattgctgtggtgttcatcctgctgctgtctgtgtgcttcatcgccagctgcctggtgacccaccacaacttcagccgctgcaagaggggcactggagtgcacaagctggagcaccacgccaagctgaagtgcatcaaggagaagtctgagctgaagtctgctgagggcagcacctggaactgctgccccatcgactggagggccttccagagcaactgctacttccccctgacagacaacaagacctgggccgagagcgagaggaactgcagcggcatgggcgcccacctgatgaccatcagcacagaggccgagcagaacttcatcatccagttcctggaccggcggctgagctacttcctgggctag

SEQ ID NO: 148685 - DNA, 660 bp, Artificial Sequence
  Description of Artificial Sequence: Synthetic coding sequence
atgaacagcagcaagagcagcgagacccagtgcacagagcggggctgcttcagcagccagatgttcctgtggacagtggccggcatccccatcctcttcctgagcgcctgcttcatcacccgctgtgtggtgaccttccgcatcttccagacctgtgatgagaagaagttccagctgcctgagaacttcacagagctgagctgctacaactacggcagcggctctgtgaagaactgctgccccctgaactgggagtacttccagagcagctgctacttcttcagcacagacaccatctcctgggccctgagcctgaagaactgcagcgccatgggcgcccacctggtggtgatcaacagccaggaggagcaggagttcctgagctacaagaagcccaagatgagggagttcttcatcggcctgagtgaccaggtggtggagggccagtggcagtgggtggatggcacccccctgaccaagagcctgtccttctgggatgtgggggagcccaacaacatcgccaccctggaggactgtgccaccatgagggacagcagcaacccccggcagaactggaatgatgtgacctgcttcctgaactacttccgcatctgtgagatggtgggcatcaaccccctgaacaagggcaagagcctgtag

SEQ ID NO: 148686 - DNA, 1134 bp, Artificial Sequence
  Description of Artificial Sequence: Synthetic coding sequence
atgtctgacagcaaggagccccgggtgcagcagctgggcctgctggaggaggaccccaccaccagcggcatccgcctcttcccccgggacttccagttccagcagatccacggccacaagagcagcacaggctgcctgggccacggggccctggtgctgcagctgctgtccttcatgctgctggccggcgtgctggtggccatcctggtgcaggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtggtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagaacttcctgcagctgcagaccagccgcagcaaccgcttctcctggatgggcctgagtgacctgaaccaggagggcacctggcagtgggtggatggcagccccctgagccccagcttccagcgctactggaacagcggggagcccaacaacagcggaaatgaagactgtgccgagttcagcggcagcggctggaatgacaacagatgtgatgtggacaactactggatctgcaagaagccagctgcctgcttcagagatgaatag

SEQ ID NO: 148687 - DNA, 1200 bp, Artificial Sequence
  Description of Artificial Sequence: Synthetic coding sequence
atgtctgacagcaaggagccccgggtgcagcagctgggcctgctggaggaggaccccaccaccagcggcatccgcctcttcccccgggacttccagttccagcagatccacggccacaagagcagcacaggctgcctgggccacggggccctggtgctgcagctgctgtccttcatgctgctggccggcgtgctggtggccatcctggtgcaggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagaacttcctgcagctgcagaccagccgcagcaaccgcttctcctggatgggcctgagtgacctgaaccaggagggcacctggcagtgggtggatggcagccccctgagccccagcttccagcgctactggaacagcggggagcccaacaacagcggaaatgaagactgtgccgagttcagcggcagcggctggaatgacaacagatgtgatgtggacaactactggatctgcaagaagccagctgcctgcttcagagatgaatag

SEQ ID NO: 148688 - DNA, 1047 bp, Artificial Sequence
  Description of Artificial Sequence: Synthetic coding sequence
atgtctgacagcaaggagccccgggtgcagcagctgggcctgctgggctgcctgggccacggggccctggtgctgcagctgctgtccttcatgctgctggccggcgtgctggtggccatcctggtgcaggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgattctgtgacagcctgccaggaggtgcgggcccagctggtggtgatcaagacagctgaggagcagaacttcctgcagctgcagaccagccgcagcaaccgcttctcctggatgggcctgagtgacctgaaccaggagggcacctggcagtgggtggatggcagccccctgagccccagcttccagcgctactggaacagcggggagcccaacaacagcggaaatgaagactgtgccgagttcagcggcagcggctggaatgacaacagatgtgatgtggacaactactggatctgcaagaagccagctgcctgcttcagagatgaatag

SEQ ID NO: 148689 - DNA, 975 bp, Artificial Sequence
  Description of Artificial Sequence: Synthetic coding sequence
atgtctgacagcaaggagccccgggtgcagcagctgggcctgctggaggaggaccccaccaccagcggcatccgcctcttcccccgggacttccagttccagcagatccacggccacaagagcagcacaggctgcctgggccacggggccctggtgctgcagctgctgtccttcatgctgctggccggcgtgctggtggccatcctggtgcaggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagctgcctgctgtgctggagcagtggaggacccagcagtag

SEQ ID NO: 148690 - DNA, 771 bp, Artificial Sequence
  Description of Artificial Sequence: Synthetic coding sequence
atgtctgacagcaaggagccccgggtgcagcagctgggcctgctggtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagtag

SEQ ID NO: 148691 - DNA, 999 bp, Artificial Sequence
  Description of Artificial Sequence: Synthetic coding sequence
atgtctgacagcaaggagccccgggtgcagcagctgggcctgctggaggaggaccccaccaccagcggcatccgcctcttcccccgggacttccagttccagcagatccacggccacaagagcagcacagtgcccttcctgctgggccctgtgtccaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtggagcggctgtgccgccactgccccaaggactggaccttcttccagggcaactgctacttcatgagcaacagccagaggaactggcatgattctgtgacagcctgccaggaggtgcgggcccagctggtggtgatcaagacagctgaggagcagaacttcctgcagctgcagaccagccgcagcaaccgcttctcctggatgggcctgagtgacctgaaccaggagggcacctggcagtgggtggatggcagccccctgagccccagcttccagcgctactggaacagcggggagcccaacaacagcggaaatgaagactgtgccgagttcagcggcagcggctggaatgacaacagatgtgatgtggacaactactggatctgcaagaagccagctgcctgcttcagagatgaatag

SEQ ID NO: 148692 - DNA, 1164 bp, Artificial Sequence
  Description of Artificial Sequence: Synthetic coding sequence
atgtctgacagcaaggagccccgggtgcagcagctgggcctgctggaggaggaccccaccaccaacttccagttccagcagatccacggccacaagagcagcacaggctgcctgggccacggggccctggtgctgcagctgctgtccttcatgctgctggccggcgtgctgccccggctgagcaaggtgcccagcagcctgagccaggagcagagcgagcaggatgccatctaccagaacctgacccagctgaaggctgctgtgggggagctgtctgagaagagcaagctgcaggagatctaccaggagctgacccagctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacccggctgaaggctgctgtgggggagctgcctgagaagagcaagctgcaggagatctaccaggagctgacagagctgaaggctgctgtgggggagctgcctgagaagagcaagctgcaggagatctaccaggagctgacccagctgaaggctgctgtgggggagctgcctgaccagagcaagcagcagcagatctaccaggagctgacagacctgaagacagcctttgagcggctgtgccgccactgccccaaggactggaccttcttccagggcaactgctacttcatgagcaacagccagaggaactggcatgacagcgtgacagcctgccaggaggtgcgggcccagctggtggtgatcaagacagctgaggagcagaacttcctgcagctgcagaccagccgcagcaaccgcttctcctggatgggcctgagtgacctgaaccaggagggcacctggcagtgggtggatggcagccccctgagccccagcttccagcgctactggaacagcggggagcccaacaacagcggaaatgaagactgtgccgagttcagcggcagcggctggaatgacaacagatgtgatgtggacaactactggatctgcaagaagccagctgcctgcttcagagatgaatag

SEQ ID NO: 148693 - DNA, 567 bp, Artificial Sequence
  Description of Artificial Sequence: Synthetic coding sequence
atgaactggcacatgatcatcagcggcctgattgtggtggtgctgaaggtggtgggcatgaccctcttcctgctgtacttcccccagatcttcaacaagagcaatgatggcttcaccaccaccaggagctatggcaccgtgtcccagatcttcggcagcagcagccccagccccaacggcttcatcaccaccaggagctatggaacagtgtgccccaaggactgggagttctaccaggcccgctgcttcttcctgagcaccagcgagagctcctggaatgaaagccgggacttctgcaagggcaagggcagcaccctggccatcgtgaacaccccagagaagctgaagttcctgcaggacatcacagatgctgagaagtacttcatcggcctcatctaccaccgggaggagaagcgctggcgctggatcaacaacagcgtcttcaatggaaatgtgaccaaccagaaccagaacttcaactgtgccaccatcggcctgaccaagacctttgatgctgccagctgtgacatctcctaccgccgcatctgtgagaagaatgccaagtag

SEQ ID NO: 148694 - DNA, 630 bp, Artificial Sequence
  Description of Artificial Sequence: Synthetic coding sequence
atgatgcaggagcagcagccccagagcacagagaagaggggctggctgagcctgcggctgtggagcgtggccggcatcagcatcgccctgctgagcgcctgcttcatcgtgtcctgtgtggtgacctaccacttcacctatggagagaccgggaagaggctgtctgagctgcacagctaccacagcagcctgacctgcttcagcgagggcaccaaggtgcctgcctggggctgctgcccagcctcctggaagagctttggcagcagctgctacttcatcagcagcgaggagaaggtgtggagcaagtctgagcagaactgtgtggagatgggcgcccacctggtggtgttcaacacagaagctgagcagaacttcatcgtgcagcagctgaatgaaagcttctcctacttcctgggcctgagtgacccccagggcaacaacaactggcagtggattgacaagaccccctatgagaagaatgtgcgcttctggcacctgggggagcccaaccacagcgctgagcagtgtgccagcatcgtgttctggaagcccaccggctggggctggaatgatgtgatctgtgagaccaggaggaacagcatctgtgagatgaacaagatctacctgtag

SEQ ID NO: 148695 - DNA, 432 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatgggcgtgctgagcagcccctgcccccccaactggatcatctatgagaagagctgctacctgttctccatgagcctgaacagctgggatggcagcaagaggcagtgctggcagctgggcagcaacctgctgaagattgacagcagcaatgagctgatcagtgaccagaaccacagctaccccaggaagcccatcagcaagctgtgcatggacagccgggtgagccacctgtag

SEQ ID NO: 148696 - DNA, 744 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatggccatctggaggagcaacagcggcagcaacaccctggagaatggctacttcctgagcaggaacaaggagaaccacagccagcccacccagagcagcctggaggacagcgtgacccccaccaaggctgtgaagaccactggagtgctgagcagcccctgcccccccaactggatcatctatgagaagagctgctacctgttctccatgagcctgaacagctgggatggcagcaagaggcagtgctggcagctgggcagcaacctgctgaagattgacagcagcaatgagctgggcttcatcgtgaagcaggtgagcagccagcctgacaacagcttctggattggcctgagccggccccagacagaggtgccctggctgtgggaggatggcagcaccttcagcagcaacctcttccagatccgcaccacagccacccaggagaaccccagccccaactgtgtgtggatccacgtgtctgtcatctatgaccagctgtgcagcgtgcccagctacagcatctgtgagaagaagttctccatgtag

SEQ ID NO: 148697 - DNA, 234 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatggccggcttcaaggctgtggagttcaagggctag

SEQ ID NO: 148698 - DNA, 606 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatgggcgtgctgagcagcccctgcccccccaactggatcatctatgagaagagctgctacctgttctccatgagcctgaacagctgggatggcagcaagaggcagtgctggcagctgggcagcaacctgctgaagattgacagcagcaatgagctgggcttcatcgtgaagcaggtgagcagccagcctgacaacagcttctggattggcctgagccggccccagacagaggtgccctggctgtgggaggatggcagcaccttcagcagcaacctcttccagatccgcaccacagccacccaggagaaccccagccccaactgtgtgtggatccacgtgtctgtcatctatgaccagctgtgcagcgtgcccagctacagcatctgtgagaagaagttctccatgtag

SEQ ID NO: 148699 - DNA, 507 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcgtgctgagcagcccctgcccccccaactggatcatctatgagaagagctgctacctgttctccatgagcctgaacagctgggatggcagcaagaggcagtgctggcagctgggcagcaacctgctgaagattgacagcagcaatgagctgggcttcatcgtgaagcaggtgagcagccagcctgacaacagcttctggattggcctgagccggccccagacagaggtgccctggctgtgggaggatggcagcaccttcagcagcaacctcttccagatccgcaccacagccacccaggagaaccccagccccaactgtgtgtggattcatgtgtctgtcatctatgaccagctgtgcagcgtgcccagctacagcatctgtgagaagaagttctccatgtag

SEQ ID NO: 148700 - DNA, 351 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatgggcaccggccagttcctgaaggacctgtccttcctgaacaacagaaggaagctgtttggagaccccatccaggaggccacccactggaggatggccaccttctaccaggagatcaagaggaccaccgtgaacccccacaaccacctgtag

SEQ ID NO: 148701 - DNA, 744 bp, Artificial Sequence; identical to SEQ ID NO: 148696
  Description of Artificial Sequence: Synthetic coding sequence

SEQ ID NO: 148702 - DNA, 570 bp, Artificial Sequence
  Description of Artificial Sequence: Synthetic coding sequence
atggagtaccacccagacctggagaacctggatgaagatggctacacccagctgcactttgacagccagagcaacaccagaattgctgtggtgtctgagaagggcagctgtgccgccagccccccctggaggctgattgctgtgatcctgggcatcctgtgcctggtgatcctggtgattgctgtggtgctgggcaccatggccatctggaggagcaacagcggcagcaacaccctggagaatggctacttcctgagcaggaacaaggagaaccacagccagcccacccagagcagcctggaggacagcgtgacccccaccaaggctgtgaagaccactggagtgctgagcagcccctgcccccccaactggatcatctatgagaagagctgctacctgttctccatgagcctgaacagctgggatggcagcaagaggcagtgctggcagctgggcagcaacctgctgaagattgacagcagcaatgagctgatcagtgaccagaaccacagctaccccaggaagcccatcagcaagctgtgcatggacagccgggtgagccacctgtag

SEQ ID NO: 148703 - DNA, 10281 bp, Artificial Sequence
  Description of Artificial Sequence: Synthetic coding sequence
gtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttcagccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaagataatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgaaaaaggaggctgtggggaccccggcatcccagcctacggcaagaggacaggcagcagcttcctgcacggggacaccctgacctttgaatgtcctgctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgtcatgaccccggcatccccatcaatggccgccgctttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagtggagtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctcatcggggagtaccacggcacccaggccccccagttcctgatcagcactggaaacttcatgtacctgctcttcaccacagacaacagccgcagcagcatcggcttcctgatccactatgagagcgtgaccctggagagtgacagctgcctggaccccggcatccctgtgaatggccaccgccacggcggggactttggcatccgcagcacagtgaccttcagctgtgaccccggctacaccctgagtgatgatgagcccctggtgtgtgagaggaaccaccagtggaaccacgccctgcccagctgtgatgccctgtgtggcggctacatccagggcaagtctggaacagtgctgagccctggcttcccagacttctaccccaacagcctgaactgcacctggaccatcgaggtgtcccatggaaaaggagtgcagatgatcttccacaccttccacctggagagcagccatgactacctgctgatcacagaagatggcagcttcagcgagcctgtggcccggctgactggatctgtgctgccccacaccatcaaggccggcctgtttggaaacttcaccgcccagctgcgcttcatcagtgacttcagcatctcctatgagggcttcaacatcaccttctctgaatatgacctggagccctgtgatgatcctggggtgcctgccttcagccgccgcatcggcttccactttggagtgggggacagcctgaccttcagctgcttcctgggctaccgcctggagggcgccaccaagctgacctgcctgggcggcggcagaagagtgtggagcgcccccctgccccgctgtgtggccgagtgtggggcctctgtgaagggaaatgaaggcaccctgctgagccccaacttccccagcaactatgacaacaaccacgagtgcatctacaagattgaaacagaagctgggaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaacggcagtgacacagaccagggcttccagctgacctacaccagctttgacctggtgaagtgtgaagatcctggcatccccaactacggctaccgcatcagagatgagggccacttcacagacacagtggtgctgtacagctgcaaccctggctacgccatgcacggcagcaacaccctgacctgcctgagcggggaccggcgggtgtgggacaagcccctgcccagctgcatcgcagaatgtggcggccagatccacgccgccaccagcggccgcatcctgagccctggctacccagccccctatgacaacaacctgcactgcacctggatcattgaagctgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcacccgctacggggacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgactggacctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctgattggcagctaccagggcagccaggcccctgagagaattgagagcagcggcaacagcctcttcctggccttcagaagtgatgcctctgtgggcctgagcggctttgccatcgagttcaaggagaagccccgggaggcctgctttgaccccggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggccgccgcatcggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccaggaccccagcgaccagttctgccacggggctgagctgggcctggagatccatgatggaggagatgtgacagccccccggctgggcagcttcagcggcaccaccgtgcctgccctgctgaacagcaccagcaaccagctgtacctgcacttccagagcgacatctctgtggccgctgctggcttccacctggagtacaagacagtgggcctggccgcctgccaggagcccgccctgcccagcaacagcatcaagattggagaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctacggggcccacatccagttcctgaacttcagcacagaggccaaccacgacttcctggagatccagaatggcccctaccacaccagccccatgattggccagttctctggaacagacctgcctgctgccctgctgagcaccacccatgagaccctcatccacttctacagcgaccacagccagaaccggcagggcttcaagctggcctaccaggcctatgagctgcagaactgcccagaccccccacccttccagaatggctacatgatcaacagcgactacagcgtgggccagagcgtgtcctttgagtgctacccaggctacatcctgattggccaccctgtgctgacctgccagcacggcatcaacagaaactggaactaccccttcccccgctgtgatgccccctgtggctacaacgtgaccagccagaatggcaccatctacagccctggcttcccagatgagtaccccatcctgaaggactgcatctggctgatcaccgtgcccccaggccacggcgtgtacatcaacttcaccctgctgcagacagaagctgtgaatgactacatcgctgtgtgggatggccctgaccagaacagcccccagctgggcgtcttcagcggcaacacagccctggagacagcctacagcagcaccaaccaggtgctgctgaagttccacagcgacttcagcaatggaggcttctttgtgctgaacttccacgccttccagctgaagaagtgccagcccccacctgctgtgccccaggccgagatgctgacagaagatgatgactttgagatcggggactttgtgaagtaccagtgccaccctggctacaccctggtgggcacagacatcctgacctgcaagctgagcagccagctgcagtttgagggcagcctgcccacctgtgaggcccagtgcccagccaatgaggtgaggacaggcagcagtggagtcatcctgagccctggctacccaggcaactacttcaacagccagacctgctcctggagcatcaaggtggagcccaactacaacatcaccatctttgtggacaccttccagagcgagaagcagtttgatgccctggaggtgtttgatggcagcagcggccagagccccctgctggtggtgctgagcggcaaccacacagagcagagcaacttcaccagccgcagcaaccagctgtacctgcgctggagcacagaccacgccaccagcaagaagggcttcaagatccgctatgctgccccctactgcagcctgacccaccccctgaagaatggaggcatcctgaacagaacagctggagctgtgggcagcaaggtgcactacttctgcaagccaggctacaggatggtgggccacagcaatgccacctgcagaagaaaccccctgggcatgtaccagtgggacagcctgacccccctgtgccaggccgtgtcctgtggcatccctgagagccctggaaatggcagcttcaccggaaatgagttcaccctggacagcaaggtggtgtatgagtgccacgagggcttcaagctggagagcagccagcaggccacagctgtgtgccaggaggatggcctgtggagcaacaagggcaagccacccacctgcaagcctgtggcctgccccagcattgaggcccagctgtctgaacatgtgatctggaggctggtgtctggcagcctgaatgaatatggagcccaggtgctgctgagctgcagccctggctactacctggagggctggaggctgctgcgctgccaggccaacggcacctggaacattggagatgagcggcccagctgcagggtcatcagctgtggcagcctgtccttcccccccaacggcaacaagattggcaccctgactgtgtatggagccacagccatcttcacctgcaacacaggctacaccctggtgggcagccacgtgagagaatgtctggccaacggcctgtggagcggcagcgagacccgctgcctggccggccactgcggcagcccagaccccatcgtgaatggccacatctctggagatggcttctcctacagagacacagtggtgtaccagtgcaaccctggcttccggctggtgggcacctctgtgcgcatctgcctgcaggaccacaagtggagcggccagacccctgtgtgtgtgcccatcacctgtggccaccctggcaacccagcccacggcttcaccaacggcagcgagttcaacctgaatgatgtggtgaacttcacctgcaacacaggctacctgctgcagggcgtgtcccgggcccagtgccgcagcaatggccagtggagcagccccctgcccacctgccgggtggtgaactgcagcgaccccggctttgtggagaatgccatccgccacggccagcagaacttccctgagagctttgaatatggcatgagcatcctgtaccactgcaagaagggcttctacctgctgggcagcagcgccctgacctgcatggccaacggcctgtgggacaggagcctgcccaagtgcctggccatcagctgtggccaccctggggtgcctgccaatgctgtgctgactggagagctgttcacctatggagctgtggtgcactacagctgccggggcagcgagagcctgattggaaatgacaccagggtgtgccaggaggacagccactggagcggggccctgccccactgcaccggcaacaaccctggcttctgtggggaccccggcaccccagcccacggcagccggctgggagatgacttcaagaccaagagcctgctgcgcttcagctgtgagatgggccaccagctgcggggcagccctgagaggacctgcctgctgaatggctcctggagcggcctgcagcctgtgtgtgaggccgtgtcctgtggcaaccctggcacccccaccaacggcatgattgtgtccagtgatggcatcctcttcagcagcagcgtcatctatgcctgctgggagggctacaagaccagcggcctgatgaccaggcactgcacagccaacggcacctggacaggaacagccccagactgcaccatcatcagctgtggggaccccggcaccctggccaacggcatccagtttggaacagacttcaccttcaacaagacagtgtcctaccagtgcaaccctggctacgtgatggaggccgtgaccagcgccaccatccgctgcaccaaggatggccgctggaaccccagcaagcctgtgtgcaaggctgtgctgtgcccccagcccccacctgtgcagaatggaacagtggagggcagtgacttccgctggggcagcagcatctcctacagctgcatggatggctaccagctgagccacagcgccatcctgagctgtgagggccggggcgtgtggaagggggagatcccccagtgcctgcccgtcttctgtggggaccccggcatcccagctgagggccgcctgagcggcaagagcttcacctacaagtctgaggtgttcttccagtgcaagagccccttcatcctggtgggcagcagccggcgggtgtgccaggctgatggcacctggagcggcatccagcccacctgcattgatcctgcccacaacacctgcccagaccccggcaccccccacttcggcatccagaacagcagccggggctatgaggtgggcagcaccgtcttcttccgctgcaggaagggctaccacatccagggcagcaccaccaggacctgcctggccaacctgacctggagcggcatccagacagagtgcatcccccacgcctgccggcagcctgagaccccagcccacgcagatgtgcgggccatcgacctgcccaccttcggctacaccctggtgtacacctgccaccctggcttcttcctggccggcggcagcgagcacaggacctgcaaggctgacatgaagtggacaggcaagagccctgtgtgcaagagcaaaggagtgcgggaggtgaatgaaacagtgaccaagacccctgtgcccagtgatgtgttctttgtgaacagcctgtggaagggctactatgagtacctgggcaagaggcagcctgccaccctgactgtggactggttcaatgccaccagcagcaaggtgaatgccaccttcagcgaggccagccctgtggagctgaagctgaccggcatctacaagaaggaggaggcccacctgctgctgaaggccttccagatcaagggccaggccgacatctttgtgtccaagtttgaaaatgacaactggggcctggatggctacgtgagcagcggcctggagcggggcggcttcaccttccagggcgacatccacggcaaggactttgggaagttcaagctggagcggcaggaccccctgaacccagaccaggacagcagcagccactaccacggcaccagcagcggctctgtggccgccgccatcctggtgcccttctttgccctgatcctgagcggctttgccttctacctgtacaagcacaggacccggcccaaggtgcagtacaacggctacgccggccacgagaacagcaatggccaggccagctttgagaaccccatgtatgacaccaacctgaagcccacagaggccaaggctgtgcgctttgacaccaccctgaacacagtgtgcaccgtggtgtag

SEQ ID NO: 148704 - DNA, 10167 bp, Artificial Sequence
  Description of Artificial Sequence: Synthetic coding sequence
atgacagcctggaggcgcttccagagcctgctgctgctgctgggcctgctggtgctgtgtgcccggctgctgacagctgccaagggccagaactgtggcggcctggtgcagggccccaacggcaccatcgagagccctggcttcccccacggctaccccaactatgccaactgcacctggatcatcatcaccggggagaggaaccgcatccagctgtccttccacacctttgccctggaggaggactttgacatcctgtctgtgtatgatggccagccccagcagggcaacctgaaggtgcggctgagcggcttccagctgcccagcagcatcgtgtccacaggcagcatcctgaccctgtggttcaccacagactttgctgtgtctgcccagggcttcaaggccctgtatgaggtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttcagccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaagataatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgaaaaaggaggctgtggggaccccggcatcccagcctacggcaagaggacaggcagcagcttcctgcacggggacaccctgacctttgaatgtcctgctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgtcatgaccccggcatccccatcaatggccgccgctttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagtggagtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctcatcggggagtaccacggcacccaggccccccagttcctgatcagcactggaaacttcatgtacctgctcttcaccacagacaacagccgcagcagcatcggcttcctgatccactatgagagcgtgaccctggagagtgacagctgcctggaccccggcatccctgtgaatggccaccgccacggcggggactttggcatccgcagcacagtgaccttcagctgtgaccccggctacaccctgagtgatgatgagcccctggtgtgtgagaggaaccaccagtggaaccacgccctgcccagctgtgatgccctgtgtggcggctacatccagggcaagtctggaacagtgctgagccctggcttcccagacttctaccccaacagcctgaactgcacctggaccatcgaggtgtcccatggaaaaggagtgcagatgatcttccacaccttccacctggagagcagccatgactacctgctgatcacagaagatggcagcttcagcgagcctgtggcccggctgactggatctgtgctgccccacaccatcaaggccggcctgtttggaaacttcaccgcccagctgcgcttcatcagtgacttcagcatctcctatgagggcttcaacatcaccttctctgaatatgacctggagccctgtgatgatcctggggtgcctgccttcagccgccgcatcggcttccactttggagtgggggacagcctgaccttcagctgcttcctgggctaccgcctggagggcgccaccaagctgacctgcctgggcggcggcagaagagtgtggagcgcccccctgccccgctgtgtggccgagtgtggggcctctgtgaagggaaatgaaggcaccctgctgagccccaacttccccagcaactatgacaacaaccacgagtgcatctacaagattgaaacagaagctgggaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaacggcagtgacacagaccagggcttccagctgacctacaccagctttgacctggtgaagtgtgaagatcctggcatccccaactacggctaccgcatcagagatgagggccacttcacagacacagtggtgctgtacagctgcaaccctggctacgccatgcacggcagcaacaccctgacctgcctgagcggggaccggcgggtgtgggacaagcccctgcccagctgcatcgcagaatgtggcggccagatccacgccgccaccagcggccgcatcctgagccctggctacccagccccctatgacaacaacctgcactgcacctggatcattgaagctgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcacccgctacggggacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgactggacctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctgattggcagctaccagggcagccaggcccctgagagaattgagagcagcggcaacagcctcttcctggccttcagaagtgatgcctctgtgggcctgagcggctttgccatcgagttcaaggagaagccccgggaggcctgctttgaccccggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggccgccgcatcggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccagatccaggtgatcagctttgccacagagcagaactgggacagcctggagatccatgatggaggagatgtgacagccccccggctgggcagcttcagcggcaccaccgtgcctgccctgctgaacagcaccagcaaccagctgtacctgcacttccagagcgacatctctgtggccgccgccggcttccacctggagtacaagacagtgggcctggccgcctgccaggagcccgccctgcccagcaacagcatcaagatcggggaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctatggagcccacatccagttcctgaacttcagcacagaggccaaccacgacttcctggagatccagaatggcccctaccacaccagccccatgattggccagttcagcggcacagacctgcctgctgccctgctgagcaccacccatgagaccctcatccacttctacagcgaccacagccagaaccggcagggcttcaagctggcctaccaggcctatgagctgcagaactgcccagaccccccacccttccagaatggctacatgatcaacagcgactacagcgtgggccagagcgtgtcctttgagtgctacccaggctacatcctgattggccaccctgtgctgacctgccagcacggcatcaacagaaactggaactaccccttcccccgctgtgatgccccctgtggctacaacgtgaccagccagaatggcaccatctacagccctggcttcccagatgagtaccccatcctgaaggactgcatctggctgatcaccgtgcccccaggccatggagtgtacatcaacttcaccctgctgcagacagaggccgtgaatgactacatcgctgtgtgggatggccctgaccagaacagcccccagctgggcgtcttcagcggcaacacagccctggagacagcctacagcagcaccaaccaggtgctgctgaagttccacagcgacttcagcaatggaggcttctttgtgctgaacttccacgccttccagctgaagaagtgccagcccccacctgctgtgccccaggccgagatgctgacagaagatgatgactttgaaattggagactttgtgaagtaccagtgccaccctggctacaccctggtgggcacagacatcctgacctgcaagctgagcagccagctgcagtttgagggcagcctgcccacctgtgaggcccagtgcccagccaatgaggtgaggacaggcagcagcggggtcatcctgagccctggctacccaggcaactacttcaacagccagacctgctcctggagcatcaaggtggagcccaactacaacatcaccatctttgtggacaccttccagagcgagaagcagtttgatgccctggaggtgtttgatggcagcagcggccagagccccctgctggtggtgctgagcggcaaccacacagagcagagcaacttcaccagccgcagcaaccagctgtacctgcgctggagcacagaccacgccaccagcaagaagggcttcaagatccgctatgctgccccctactgcagcctgacccaccccctgaagaatggaggcatcctgaacagaacagctggagctgtgggcagcaaggtgcactacttctgcaagccaggctacaggatggtgggccacagcaatgccacctgcagaagaaaccccctgggcatgtaccagtgggacagcctgacccccctgtgccaggccgtgtcctgtggcatccctgagagccctggaaatggcagcttcaccggaaatgagttcaccctggacagcaaggtggtgtatgaatgtcatgagggcttcaagctggagagcagccagcaggccacagctgtgtgccaggaggatggcctgtggagcaacaagggcaagccacccacctgcaagcctgtggcctgccccagcattgaggcccagctgtctgagcacgtgatctggaggctggtgtctggcagcctgaatgaatatggagcccaggtgctgctgagctgcagccctggctactacctggagggctggaggctgctgcgctgccaggccaacggcacctggaacattggagatgagcggcccagctgccgggccggccactgcggcagcccagaccccatcgtgaatggccacatctctggagatggcttctcctacagagacacagtggtgtaccagtgcaaccctggcttccggctggtgggcacctctgtgcgcatctgcctgcaggaccacaagtggagcggccagacccctgtgtgtgtgcccatcacctgtggccaccctggcaacccagcccacggcttcaccaatggaagtgagttcaacctgaatgatgtggtgaacttcacctgcaacacaggctacctgctgcagggcgtgtcccgggcccagtgccgcagcaatggccagtggagcagccccctgcccacctgccgggtggtgaactgcagcgaccccggctttgtggagaatgccatcagacatggccagcagaacttccctgagagctttgaatatggcatgagcatcctgtaccactgcaagaagggcttctacctgctgggcagcagcgccctgacctgcatggccaacggcctgtgggacaggagcctgcccaagtgcctggccatcagctgtggccaccctggggtgcctgccaatgctgtgctgaccggggagctgttcacctacggggctgtggtgcactacagctgccggggcagcgagagcctgattggaaatgacaccagggtgtgccaggaggacagccactggagcggggccctgccccactgcaccggcaacaaccctggcttctgtggggaccccggcaccccagcccacggcagccggctgggagatgacttcaagaccaagagcctgctgcgcttcagctgtgagatgggccaccagctgcggggcagccctgagaggacctgcctgctgaatggctcctggagcggcctgcagcctgtgtgtgaggccgtgctgtgcccccagcccccacctgtgcagaatggaacagtggagggcagtgacttccgctggggcagcagcatctcctacagctgcatggatggctaccagctgagccacagcgccatcctgagctgtgagggccggggcgtgtggaagggggagatcccccagtgcctgcccgtcttctgtggggaccccggcatcccagctgagggccgcctgagcggcaagagcttcacctacaagtctgaggtgttcttccagtgcaagagccccttcatcctggtgggcagcagccggcgggtgtgccaggctgatggcacctggagcggcatccagcccacctgcattgatcctgcccacaacacctgcccagaccccggcaccccccacttcggcatccagaacagcagccggggctatgaggtgggcagcaccgtcttcttccgctgcaggaagggctaccacatccagggcagcaccaccaggacctgcctggccaacctgacctggagcggcatccagacagagtgcatcccccacgcctgccggcagcctgagaccccagcccacgcagatgtgcgggccatcgacctgcccaccttcggctacaccctggtgtacacctgccaccctggcttcttcctggccggcggcagcgagcacaggacctgcaaggctgacatgaagtggacaggcaagagccctgtgtgcaagagcaaaggagtgcgggaggtgaatgaaacagtgaccaagacccctgtgcccagtgatgtgttctttgtgaacagcctgtggaagggctactatgagtacctgggcaagaggcagcctgccaccctgactgtggactggttcaatgccaccagcagcaaggtgaatgccaccttcagcgaggccagccctgtggagctgaagctgaccggcatctacaagaaggaggaggcccacctgctgctgaaggccttccagatcaagggccaggccgacatctttgtgtccaagtttgaaaatgacaactggggcctggatggctacgtgagcagcggcctggagcggggcggcttcaccttccagggcgacatccacggcaaggactttgggaagttcaagctggagcggcaggaccccctgaacccagaccaggacagcagcagccactaccacggcaccagcagcggctctgtggccgccgccatcctggtgcccttctttgccctgatcctgagcggctttgccttctacctgtacaagcacaggacccggcccaaggtgcagtacaacggctacgccggccacgagaacagcaatggccaggccagctttgagaaccccatgtatgacaccaacctgaagcccacagaggccaaggctgtgcgctttgacaccaccctgaacacagtgtgcaccgtggtgtag

SEQ ID NO: 148705 - DNA, 10698 bp, Artificial Sequence
  Description of Artificial Sequence: Synthetic coding sequence
atgacagcctggaggcgcttccagagcctgctgctgctgctgggcctgctggtgctgtgtgcccggctgctgacagctgccaagggccagaactgtggcggcctggtgcagggccccaacggcaccatcgagagccctggcttcccccacggctaccccaactatgccaactgcacctggatcatcatcaccggggagaggaaccgcatccagctgtccttccacacctttgccctggaggaggactttgacatcctgtctgtgtatgatggccagccccagcagggcaacctgaaggtgcggctgagcggcttccagctgcccagcagcatcgtgtccacaggcagcatcctgaccctgtggttcaccacagactttgctgtgtctgcccagggcttcaaggccctgtatgaggtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttcagccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaagataatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgaaaaaggaggctgtggggaccccggcatcccagcctacggcaagaggacaggcagcagcttcctgcacggggacaccctgacctttgaatgtcctgctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgtcatgaccccggcatccccatcaatggccgccgctttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagtggagtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctcatcggggagtaccacggcacccaggccccccagttcctgatcagcactggaaacttcatgtacctgctcttcaccacagacaacagccgcagcagcatcggcttcctgatccactatgagagcgtgaccctggagagtgacagctgcctggaccccggcatccctgtgaatggccaccgccacggcggggactttggcatccgcagcacagtgaccttcagctgtgaccccggctacaccctgagtgatgatgagcccctggtgtgtgagaggaaccaccagtggaaccacgccctgcccagctgtgatgccctgtgtggcggctacatccagggcaagtctggaacagtgctgagccctggcttcccagacttctaccccaacagcctgaactgcacctggaccatcgaggtgtcccatggaaaaggagtgcagatgatcttccacaccttccacctggagagcagccatgactacctgctgatcacagaagatggcagcttcagcgagcctgtggcccggctgactggatctgtgctgccccacaccatcaaggccggcctgtttggaaacttcaccgcccagctgcgcttcatcagtgacttcagcatctcctatgagggcttcaacatcaccttctctgaatatgacctggagccctgtgatgatcctggggtgcctgccttcagccgccgcatcggcttccactttggagtgggggacagcctgaccttcagctgcttcctgggctaccgcctggagggcgccaccaagctgacctgcctgggcggcggcagaagagtgtggagcgcccccctgccccgctgtgtggccgagtgtggggcctctgtgaagggaaatgaaggcaccctgctgagccccaacttccccagcaactatgacaacaaccacgagtgcatctacaagattgaaacagaagctgggaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaacggcagtgacacagaccagggcttccagctgacctacaccagctttgacctggtgaagtgtgaagatcctggcatccccaactacggctaccgcatcagagatgagggccacttcacagacacagtggtgctgtacagctgcaaccctggctacgccatgcacggcagcaacaccctgacctgcctgagcggggaccggcgggtgtgggacaagcccctgcccagctgcatcgcagaatgtggcggccagatccacgccgccaccagcggccgcatcctgagccctggctacccagccccctatgacaacaacctgcactgcacctggatcattgaagctgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcacccgctacggggacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgactggacctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctgattggcagctaccagggcagccaggcccctgagagaattgagagcagcggcaacagcctcttcctggccttcagaagtgatgcctctgtgggcctgagcggctttgccatcgagttcaaggagaagccccgggaggcctgctttgaccccggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggccgccgcatcggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccagatccaggtgatcagctttgccacagagcagaactgggacagcctggagatccatgatggaggagatgtgacagccccccggctgggcagcttcagcggcaccaccgtgcctgccctgctgaacagcaccagcaaccagctgtacctgcacttccagagcgacatctctgtggccgccgccggcttccacctggagtacaagacagtgggcctggccgcctgccaggagcccgccctgcccagcaacagcatcaagatcggggaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctatggagcccacatccagttcctgaacttcagcacagaggccaaccacgacttcctggagatccagaatggcccctaccacaccagccccatgattggccagttcagcggcacagacctgcctgctgccctgctgagcaccacccatgagaccctcatccacttctacagcgaccacagccagaaccggcagggcttcaagctggcctaccaggcctatgagctgcagaactgcccagaccccccacccttccagaatggctacatgatcaacagcgactacagcgtgggccagagcgtgtcctttgagtgctacccaggctacatcctgattggccaccctgtgctgacctgccagcacggcatcaacagaaactggaactaccccttcccccgctgtgatgccccctgtggctacaacgtgaccagccagaatggcaccatctacagccctggcttcccagatgagtaccccatcctgaaggactgcatctggctgatcaccgtgcccccaggccatggagtgtacatcaacttcaccctgctgcagacagaggccgtgaatgactacatcgctgtgtgggatggccctgaccagaacagcccccagctgggcgtcttcagcggcaacacagccctggagacagcctacagcagcaccaaccaggtgctgctgaagttccacagcgacttcagcaatggaggcttctttgtgctgaacttccacgccttccagctgaagaagtgccagcccccacctgctgtgccccaggccgagatgctgacagaagatgatgactttgaaattggagactttgtgaagtaccagtgccaccctggctacaccctggtgggcacagacatcctgacctgcaagctgagcagccagctgcagtttgagggcagcctgcccacctgtgaggcccagtgcccagccaatgaggtgaggacaggcagcagcggggtcatcctgagccctggctacccaggcaactacttcaacagccagacctgctcctggagcatcaaggtggagcccaactacaacatcaccatctttgtggacaccttccagagcgagaagcagtttgatgccctggaggtgtttgatggcagcagcggccagagccccctgctggtggtgctgagcggcaaccacacagagcagagcaacttcaccagccgcagcaaccagctgtacctgcgctggagcacagaccacgccaccagcaagaagggcttcaagatccgctatgctgccccctactgcagcctgacccaccccctgaagaatggaggcatcctgaacagaacagctggagctgtgggcagcaaggtgcactacttctgcaagccaggctacaggatggtgggccacagcaatgccacctgcagaagaaaccccctgggcatgtaccagtgggacagcctgacccccctgtgccaggccgtgtcctgtggcatccctgagagccctggaaatggcagcttcaccggaaatgagttcaccctggacagcaaggtggtgtatgaatgtcatgagggcttcaagctggagagcagccagcaggccacagctgtgtgccaggaggatggcctgtggagcaacaagggcaagccacccacctgcaagcctgtggcctgccccagcattgaggcccagctgtctgagcacgtgatctggaggctggtgtctggcagcctgaatgaatatggagcccaggtgctgctgagctgcagccctggctactacctggagggctggaggctgctgcgctgccaggccaacggcacctggaacattggagatgagcggcccagctgcagggtcatcagctgtggcagcctgtccttccccccaaatggaaacaagattggcaccctgactgtgtatggagccacagccatcttcacctgcaacacaggctacaccctggtgggcagccacgtgcgggagtgcctggccaacggcctgtggagcggcagcgagacccgctgcctggccggccactgcggcagcccagaccccatcgtgaatggccacatctctggagatggcttctcctacagagacacagtggtgtaccagtgcaaccctggcttccggctggtgggcacctctgtgcgcatctgcctgcaggaccacaagtggagcggccagacccctgtgtgtgtgcccatcacctgtggccaccctggcaacccagcccacggcttcaccaatggaagtgagttcaacctgaatgatgtggtgaacttcacctgcaacacaggctacctgctgcagggcgtgtcccgggcccagtgccgcagcaatggccagtggagcagccccctgcccacctgccgggtggtgaactgcagcgaccccggctttgtggagaatgccatcagacatggccagcagaacttccctgagagctttgaatatggcatgagcatcctgtaccactgcaagaagggcttctacctgctgggcagcagcgccctgacctgcatggccaacggcctgtgggacaggagcctgcccaagtgcctggccatcagctgtggccaccctggggtgcctgccaatgctgtgctgaccggggagctgttcacctacggggctgtggtgcactacagctgccggggcagcgagagcctgattggaaatgacaccagggtgtgccaggaggacagccactggagcggggccctgccccactgcaccggcaacaaccctggcttctgtggggaccccggcaccccagcccacggcagccggctgggagatgacttcaagaccaagagcctgctgcgcttcagctgtgagatgggccaccagctgcggggcagccctgagaggacctgcctgctgaatggctcctggagcggcctgcagcctgtgtgtgaggccgtgtcctgtggcaaccctggcacccccaccaacggcatgattgtgtccagtgatggcatcctcttcagcagcagcgtcatctatgcctgctgggagggctacaagaccagcggcctgatgaccaggcactgcacagccaacggcacctggacaggaacagccccagactgcaccatcatcagctgtggggaccccggcaccctggccaacggcatccagtttggaacagacttcaccttcaacaagacagtgtcctaccagtgcaaccctggctacgtgatggaggccgtgaccagcgccaccatccgctgcaccaaggatggccgctggaaccccagcaagcctgtgtgcaaggctgtgctgtgcccccagcccccacctgtgcagaatggcaccgtggagggcagtgacttccgctggggcagcagcatctcctacagctgcatggatggctaccagctgagccacagcgccatcctgagctgtgagggccggggcgtgtggaagggggagatcccccagtgcctgcctgtgttctgtggggaccccggcatcccagctgagggccgcctgagcggcaagagcttcacctacaagtctgaggtgttcttccagtgcaagagccccttcatcctggtgggcagcagcagaagagtgtgccaggctgatggcacctggagcggcatccagcccacctgcatcgaccctgcccacaacacctgcccagaccccggcaccccccacttcggcatccagaacagcagccggggctatgaggtgggcagcacagtgttcttccgctgcaggaagggctaccacatccagggcagcaccaccaggacctgcctggccaacctgacctggagcggcatccagacagagtgcatcccccacgcctgccggcagcctgagaccccagcccatgctgatgtgcgggccatcgacctgcccaccttcggctacaccctggtgtacacctgccaccctggcttcttcctggccggcggcagcgagcacaggacctgcaaggctgacatgaagtggacaggcaagagccctgtgtgcaagagcaagggcgtgcgggaggtgaatgagaccgtgaccaagacccctgtgcccagtgatgtgttctttgtgaacagcctgtggaagggctactatgagtacctgggcaagaggcagcctgccaccctgactgtggactggttcaatgccaccagcagcaaggtgaatgccaccttcagcgaggccagccctgtggagctgaagctgaccggcatctacaagaaggaggaggcccacctgctgctgaaggccttccagatcaagggccaggccgacatctttgtgtccaagtttgaaaatgacaactggggcctggatggctacgtgagcagcggcctggagcggggcggcttcaccttccagggcgacatccacggcaaggactttgggaagttcaagctggagcggcaggaccccctgaacccagaccaggacagcagcagccactaccacggcaccagcagcggctctgtggccgccgccatcctggtgcccttctttgccctgatcctgagcggctttgccttctacctgtacaagcacaggacccggcccaaggtgcagtacaacggctacgccggccacgagaacagcaatggccaggccagctttgagaaccccatgtatgacaccaacctgaagcccacagaggccaaggctgtgcgctttgacaccaccctgaacacagtgtgcaccgtggtgtag

SEQ ID NO: 148706 - DNA, 10695 bp, Artificial Sequence
  Description of Artificial Sequence: Synthetic coding sequence
atgacagcctggaggcgcttccagagcctgctgctgctgctgggcctgctggtgctgtgtgcccggctgctgacagctgccaagggccagaactgtggcggcctggtgcagggccccaacggcaccatcgagagccctggcttcccccacggctaccccaactatgccaactgcacctggatcatcatcaccggggagaggaaccgcatccagctgtccttccacacctttgccctggaggaggactttgacatcctgtctgtgtatgatggccagccccagcagggcaacctgaaggtgcggctgagcggcttccagctgcccagcagcatcgtgtccacaggcagcatcctgaccctgtggttcaccacagactttgctgtgtctgcccagggcttcaaggccctgtatgaggtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaggacaatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgagaagggcggctgtggggaccccggcatcccagcctacggcaagaggacaggcagcagcttcctgcatggagacaccctgacctttgagtgcccagctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgccacgaccccggcatccccatcaatggaagaagatttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagcggggtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctgattggagagtaccacggcacccaggccccccagttcctgatcagcacaggcaacttcatgtacctgctcttcaccacagacaacagccgcagcagcatcggcttcctgatccactatgaatctgtgaccctggagagtgacagctgcctggaccccggcatccctgtgaatggccacagacatggaggagactttggcatccgcagcacagtgaccttcagctgtgaccccggctacaccctgagtgatgatgagcccctggtgtgtgaaagaaaccaccagtggaaccacgccctgcccagctgtgatgccctgtgtggcggctacatccagggcaagagcggcaccgtgctgagccctggcttcccagacttctaccccaacagcctgaactgcacctggaccatcgaggtgagccacggcaagggcgtgcagatgatcttccacaccttccacctggagagcagccatgactacctgctgatcacagaagatggcagcttcagcgagcctgtggcccggctgaccggctctgtgctgccccacaccatcaaggccggcctgtttggaaacttcaccgcccagctgcgcttcatcagtgacttcagcatctcctatgagggcttcaacatcaccttctctgaatatgacctggagccctgtgatgaccccggggtgcctgccttcagcagaagaattggcttccactttggagtgggggacagcctgaccttcagctgcttcctgggctaccgcctggagggcgccaccaagctgacctgcctgggcggcggccggcgggtgtggagcgcccccctgccccgctgtgtggctgaatgtggggcctctgtgaagggaaatgaaggcaccctgctgagccccaacttccccagcaactatgacaacaaccacgagtgcatctacaagattgaaacagaggccggcaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaatggaagtgacacagaccagggcttccagctgacctacaccagctttgacctggtgaagtgtgaggaccccggcatccccaactacggctaccgcatcagagatgagggccacttcacagacacagtggtgctgtacagctgcaaccctggctacgccatgcacggcagcaacaccctgacctgcctgagcggggacagaagagtgtgggacaagcccctgcccagctgcatcgccgagtgtggcggccagatccatgctgccaccagcggccgcatcctgagccctggctacccagccccctatgacaacaacctgcactgcacctggatcatcgaggccgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcaccaggtatggagacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgaccggccctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctcatcggcagctaccagggcagccaggcccctgagcgcatcgagagcagcggcaacagcctcttcctggccttcagaagtgatgcctctgtgggcctgagcggctttgccatcgagttcaaggagaagccccgggaggcctgctttgatcctggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggaagaagaattggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccagatccaggtgatcagctttgccacagagcagaactgggacagcctggagatccatgatggaggagatgtgacagccccccggctgggcagcttcagcggcaccaccgtgcctgccctgctgaacagcaccagcaaccagctgtacctgcacttccagagcgacatctctgtggccgctgctggcttccacctggagtacaagacagtgggcctggccgcctgccaggagcccgccctgcccagcaacagcatcaagattggagaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctacggggcccacatccagttcctgaacttcagcacagaggccaaccacgacttcctggagatccagaatggcccctaccacaccagccccatgattggccagttctctggaacagacctgcctgctgccctgctgagcaccacccatgagaccctcatccacttctacagcgaccacagccagaaccggcagggcttcaagctggcctaccaggcctatgagctgcagaactgcccagaccccccacccttccagaatggctacatgatcaacagcgactacagcgtgggccagagcgtgtcctttgagtgctacccaggctacatcctgattggccaccctgtgctgacctgccagcacggcatcaacagaaactggaactaccccttcccccgctgtgatgccccctgtggctacaacgtgaccagccagaatggcaccatctacagccctggcttcccagatgagtaccccatcctgaaggactgcatctggctgatcaccgtgcccccaggccacggcgtgtacatcaacttcaccctgctgcagacagaagctgtgaatgactacatcgctgtgtgggatggccctgaccagaacagcccccagctgggcgtcttcagcggcaacacagccctggagacagcctacagcagcaccaaccaggtgctgctgaagttccacagcgacttcagcaatggaggcttctttgtgctgaacttccacgccttccagctgaagaagtgccagcccccacctgctgtgccccaggccgagatgctgacagaagatgatgactttgagatcggggactttgtgaagtaccagtgccaccctggctacaccctggtgggcacagacatcctgacctgcaagctgagcagccagctgcagtttgagggcagcctgcccacctgtgaggcccagtgcccagccaatgaggtgaggacaggcagcagtggagtcatcctgagccctggctacccaggcaactacttcaacagccagacctgctcctggagcatcaaggtggagcccaactacaacatcaccatctttgtggacaccttccagagcgagaagcagtttgatgccctggaggtgtttgatggcagcagcggccagagccccctgctggtggtgctgagcggcaaccacacagagcagagcaacttcaccagccgcagcaaccagctgtacctgcgctggagcacagaccacgccaccagcaagaagggcttcaagatccgctatgctgccccctactgcagcctgacccaccccctgaagaatggaggcatcctgaacagaacagctggagctgtgggcagcaaggtgcactacttctgcaagccaggctacaggatggtgggccacagcaatgccacctgcagaagaaaccccctgggcatgtaccagtgggacagcctgacccccctgtgccaggccgtgtcctgtggcatccctgagagccctggaaatggcagcttcaccggaaatgagttcaccctggacagcaaggtggtgtatgagtgccacgagggcttcaagctggagagcagccagcaggccacagctgtgtgccaggaggatggcctgtggagcaacaagggcaagccacccacctgcaagcctgtggcctgccccagcattgaggcccagctgtctgaacatgtgatctggaggctggtgtctggcagcctgaatgaatatggagcccaggtgctgctgagctgcagccctggctactacctggagggctggaggctgctgcgctgccaggccaacggcacctggaacattggagatgagcggcccagctgcagggtcatcagctgtggcagcctgtccttcccccccaacggcaacaagattggcaccctgactgtgtatggagccacagccatcttcacctgcaacacaggctacaccctggtgggcagccacgtgagagaatgtctggccaacggcctgtggagcggcagcgagacccgctgcctggccggccactgcggcagcccagaccccatcgtgaatggccacatctctggagatggcttctcctacagagacacagtggtgtaccagtgcaaccctggcttccggctggtgggcacctctgtgcgcatctgcctgcaggaccacaagtggagcggccagacccctgtgtgtgtgcccatcacctgtggccaccctggcaacccagcccacggcttcaccaacggcagcgagttcaacctgaatgatgtggtgaacttcacctgcaacacaggctacctgctgcagggcgtgtcccgggcccagtgccgcagcaatggccagtggagcagccccctgcccacctgccgggtggtgaactgcagcgaccccggctttgtggagaatgccatccgccacggccagcagaacttccctgagagctttgaatatggcatgagcatcctgtaccactgcaagaagggcttctacctgctgggcagcagcgccctgacctgcatggccaacggcctgtgggacaggagcctgcccaagtgcctggccatcagctgtggccaccctggggtgcctgccaatgctgtgctgactggagagctgttcacctatggagctgtggtgcactacagctgccggggcagcgagagcctgattggaaatgacaccagggtgtgccaggaggacagccactggagcggggccctgccccactgcaccggcaacaaccctggcttctgtggggaccccggcaccccagcccacggcagccggctgggagatgacttcaagaccaagagcctgctgcgcttcagctgtgagatgggccaccagctgcggggcagccctgagaggacctgcctgctgaatggctcctggagcggcctgcagcctgtgtgtgaggccgtgtcctgtggcaaccctggcacccccaccaacggcatgattgtgtccagtgatggcatcctcttcagcagcagcgtcatctatgcctgctgggagggctacaagaccagcggcctgatgaccaggcactgcacagccaacggcacctggacaggaacagccccagactgcaccatcatcagctgtggggaccccggcaccctggccaacggcatccagtttggaacagacttcaccttcaacaagacagtgtcctaccagtgcaaccctggctacgtgatggaggccgtgaccagcgccaccatccgctgcaccaaggatggccgctggaaccccagcaagcctgtgtgcaaggctgtgctgtgcccccagcccccacctgtgcagaatggaacagtggagggcagtgacttccgctggggcagcagcatctcctacagctgcatggatggctaccagctgagccacagcgccatcctgagctgtgagggccggggcgtgtggaagggggagatcccccagtgcctgcccgtcttctgtggggaccccggcatcccagctgagggccgcctgagcggcaagagcttcacctacaagtctgaggtgttcttccagtgcaagagccccttcatcctggtgggcagcagccggcgggtgtgccaggctgatggcacctggagcggcatccagcccacctgcattgatcctgcccacaacacctgcccagaccccggcaccccccacttcggcatccagaacagcagccggggctatgaggtgggcagcaccgtcttcttccgctgcaggaagggctaccacatccagggcagcaccaccaggacctgcctggccaacctgacctggagcggcatccagacagagtgcatcccccacgcctgccggcagcctgagaccccagcccacgcagatgtgcgggccatcgacctgcccaccttcggctacaccctggtgtacacctgccaccctggcttcttcctggccggcggcagcgagcacaggacctgcaaggctgacatgaagtggacaggcaagagccctgtgtgcaagagcaaaggagtgcgggaggtgaatgaaacagtgaccaagacccctgtgcccagtgatgtgttctttgtgaacagcctgtggaagggctactatgagtacctgggcaagaggcagcctgccaccctgactgtggactggttcaatgccaccagcagcaaggtgaatgccaccttcagcgaggccagccctgtggagctgaagctgaccggcatctacaagaaggaggaggcccacctgctgctgaaggccttccagatcaagggccaggccgacatctttgtgtccaagtttgaaaatgacaactggggcctggatggctacgtgagcagcggcctggagcggggcggcttcaccttccagggcgacatccacggcaaggactttgggaagttcaagctggagcggcaggaccccctgaacccagaccaggacagcagcagccactaccacggcaccagcagcggctctgtggccgccgccatcctggtgcccttctttgccctgatcctgagcggctttgccttctacctgtacaagcacaggacccggcccaaggtgcagtacaacggctacgccggccacgagaacagcaatggccaggccagctttgagaaccccatgtatgacaccaacctgaagcccacagaggccaaggctgtgcgctttgacaccaccctgaacacagtgtgcaccgtggtgtag

SEQ ID NO: 148707 - DNA, 6330 bp, Artificial Sequence
  Description of Artificial Sequence: Synthetic coding sequence
atgacagcctggaggcgcttccagagcctgctgctgctgctgggcctgctggtgctgtgtgcccggctgctgacagctgccaagggccagaactgtggcggcctggtgcagggccccaacggcaccatcgagagccctggcttcccccacggctaccccaactatgccaactgcacctggatcatcatcaccggggagaggaaccgcatccagctgtccttccacacctttgccctggaggaggactttgacatcctgtctgtgtatgatggccagccccagcagggcaacctgaaggtgcggctgagcggcttccagctgcccagcagcatcgtgtccacaggcagcatcctgaccctgtggttcaccacagactttgctgtgtctgcccagggcttcaaggccctgtatgaggtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaggacaatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgagaagggcggctgtggggaccccggcatcccagcctacggcaagaggacaggcagcagcttcctgcatggagacaccctgacctttgagtgcccagctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgccacgaccccggcatccccatcaatggaagaagatttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagcggggtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctgattggagagtaccacggcacccaggccccccagttcctgatcagcacaggcaacttcatgtacctgctcttcaccacagacaacagccgcagcagcatcggcttcctgatccactatgaatctgtgaccctggagagtgacagctgcctggaccccggcatccctgtgaatggccacagacatggaggagactttggcatccgcagcacagtgaccttcagctgtgaccccggctacaccctgagtgatgatgagcccctggtgtgtgaaagaaaccaccagtggaaccacgccctgcccagctgtgatgccctgtgtggcggctacatccagggcaagagcggcaccgtgctgagccctggcttcccagacttctaccccaacagcctgaactgcacctggaccatcgaggtgagccacggcaagggcgtgcagatgatcttccacaccttccacctggagagcagccatgactacctgctgatcacagaagatggcagcttcagcgagcctgtggcccggctgaccggctctgtgctgccccacaccatcaaggccggcctgtttggaaacttcaccgcccagctgcgcttcatcagtgacttcagcatctcctatgagggcttcaacatcaccttctctgaatatgacctggagccctgtgatgaccccggggtgcctgccttcagcagaagaattggcttccactttggagtgggggacagcctgaccttcagctgcttcctgggctaccgcctggagggcgccaccaagctgacctgcctgggcggcggccggcgggtgtggagcgcccccctgccccgctgtgtggctgaatgtggggcctctgtgaagggaaatgaaggcaccctgctgagccccaacttccccagcaactatgacaacaaccacgagtgcatctacaagattgaaacagaggccggcaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaatggaagtgacacagaccagggcttccagctgacctacaccagctttgacctggtgaagtgtgaggaccccggcatccccaactacggctaccgcatcagagatgagggccacttcacagacacagtggtgctgtacagctgcaaccctggctacgccatgcacggcagcaacaccctgacctgcctgagcggggacagaagagtgtgggacaagcccctgcccagctgcatcgccgagtgtggcggccagatccatgctgccaccagcggccgcatcctgagccctggctacccagccccctatgacaacaacctgcactgcacctggatcatcgaggccgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcaccaggtatggagacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgaccggccctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctcatcggcagctaccagggcagccaggcccctgagcgcatcgagagcagcggcaacagcctcttcctggccttcagaagtgatgcctctgtgggcctgagcggctttgccatcgagttcaaggagaagccccgggaggcctgctttgatcctggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggaagaagaattggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccagatccaggtgatcagctttgccacagagcagaactgggacagcctggagatccatgatggaggagatgtgacagccccccggctgggcagcttcagcggcaccaccgtgcctgccctgctgaacagcaccagcaaccagctgtacctgcacttccagagcgacatctctgtggccgctgctggcttccacctggagtacaagacagtgggcctggccgcctgccaggagcccgccctgcccagcaacagcatcaagattggagaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctacggggcccacatccagttcctgaacttcagcacagaggccaaccacgacttcctggagatccagaatggcccctaccacaccagccccatgattggccagttctctggaacagacctgcctgctgccctgctgagcaccacccatgagaccctcatccacttctacagcgaccacagccagaaccggcagggcttcaagctggcctaccagggcggcagcggcaacatcggccctgccttcccctgcctggacacccccttccaggcccgctgccagggcgaggagaggaccttcaactag

SEQ ID NO: 148708 - DNA, 10164 bp, Artificial Sequence
  Description of Artificial Sequence: Synthetic coding sequence
atgacagcctggaggcgcttccagagcctgctgctgctgctgggcctgctggtgctgtgtgcccggctgctgacagctgccaagggccagaactgtggcggcctggtgcagggccccaacggcaccatcgagagccctggcttcccccacggctaccccaactatgccaactgcacctggatcatcatcaccggggagaggaaccgcatccagctgtccttccacacctttgccctggaggaggactttgacatcctgtctgtgtatgatggccagccccagcagggcaacctgaaggtgcggctgagcggcttccagctgcccagcagcatcgtgtccacaggcagcatcctgaccctgtggttcaccacagactttgctgtgtctgcccagggcttcaaggccctgtatgaggtgctgcccagccacacctgtggcaaccctggagagatcctgaagggcgtgctgcacggcacccgcttcaacattggagacaagatccgctacagctgcctgcccggctacatcctggagggccacgccatcctgacctgcatcgtgtccccaggaaatggagcctcctgggacttccctgcccccttctgcagagctgagggcgcctgtggcggcaccctgcggggcaccagcagcagcatcagcagcccccacttccccagtgaatatgaaaataatgctgactgcacctggaccatcctggccgagcccggggacaccatcgccctggtgttcacagacttccagctggaggagggctatgacttcctggagatctctggaacagaggcccccagcatctggctgaccggcatgaacctgcccagccctgtgatcagcagcaagaactggctgcggctgcacttcaccagtgacagcaaccacaggaggaagggcttcaatgcccagttccaggtgaagaaggccatcgagctgaagagcagaggagtgaagatgctgcccagcaaggatggcagccacaagaacagcgtgctgagccagggcggcgtggccctggtgtctgacatgtgcccagaccccggcatcccagaaaatggaagaagagctggcagtgacttccgggtgggcgccaacgtgcagttcagctgtgaggacaactacgtgctgcagggcagcaagagcatcacctgccagagggtgacagagaccctggccgcctggagcgaccaccggcccatctgccgggcccggacctgtggcagcaacctgcggggccccagcggggtcatcaccagccccaactaccctgtgcagtatgaggacaatgcccactgtgtgtgggtgatcaccaccacagatcctgacaaggtgatcaagctggcctttgaggagtttgagctggagcggggctatgacaccctgactgtgggagatgctgggaaggtgggggacaccaggtctgtgctgtatgtgctgaccggcagctctgtgcctgacctgattgtgtccatgagcaaccagatgtggctgcacctgcagagtgatgacagcatcggcagccctggcttcaaggctgtgtaccaggagattgagaagggcggctgtggggaccccggcatcccagcctacggcaagaggacaggcagcagcttcctgcatggagacaccctgacctttgagtgcccagctgcctttgagctggtgggggagagggtcatcacctgccagcagaacaaccagtggagcggcaacaagcccagctgtgtgttcagctgcttcttcaacttcaccgccagcagcggcatcatcctgagccccaactacccagaggagtatggcaacaacatgaactgtgtgtggctgatcatcagcgagcccggcagccgcatccacctgatcttcaatgactttgatgtggagccccagtttgacttcctggccgtgaaggatgatggcatcagtgacatcaccgtgctgggcaccttctctggaaatgaggtgcccagccagctggccagcagcggccacatcgtgcggctggagttccagagcgaccacagcaccaccggccggggcttcaacatcacctacaccaccttcggccagaatgaatgccacgaccccggcatccccatcaatggaagaagatttggagaccgcttcctgctgggcagctctgtgtccttccactgtgatgatggctttgtgaagacccagggcagcgagagcatcacctgcatcctgcaggatggaaatgtggtgtggagcagcacagtgccccgctgtgaggccccctgtggcggccacctgacagccagcagcggggtcatcctgcccccaggctggccaggctactacaaggacagcctgcactgtgagtggatcatcgaggccaagccaggccacagcatcaagatcacctttgaccgcttccagacagaggtgaactatgacaccctggaggtgagagatggccctgccagcagcagccccctgattggagagtaccacggcacccaggccccccagttcctgatcagcacaggcaacttcatgtacctgctcttcaccacagacaacagccgcagcagcatcggcttcctgatccactatgaatctgtgaccctggagagtgacagctgcctggaccccggcatccctgtgaatggccacagacatggaggagactttggcatccgcagcacagtgaccttcagctgtgaccccggctacaccctgagtgatgatgagcccctggtgtgtgaaagaaaccaccagtggaaccacgccctgcccagctgtgatgccctgtgtggcggctacatccagggcaagagcggcaccgtgctgagccctggcttcccagacttctaccccaacagcctgaactgcacctggaccatcgaggtgagccacggcaagggcgtgcagatgatcttccacaccttccacctggagagcagccatgactacctgctgatcacagaagatggcagcttcagcgagcctgtggcccggctgaccggctctgtgctgccccacaccatcaaggccggcctgtttggaaacttcaccgcccagctgcgcttcatcagtgacttcagcatctcctatgagggcttcaacatcaccttctctgaatatgacctggagccctgtgatgaccccggggtgcctgccttcagcagaagaattggcttccactttggagtgggggacagcctgaccttcagctgcttcctgggctaccgcctggagggcgccaccaagctgacctgcctgggcggcggccggcgggtgtggagcgcccccctgccccgctgtgtggctgaatgtggggcctctgtgaagggaaatgaaggcaccctgctgagccccaacttccccagcaactatgacaacaaccacgagtgcatctacaagattgaaacagaggccggcaagggcatccacctgcggaccaggagcttccagctgtttgaaggagacaccctgaaggtgtatgatggcaaggacagcagcagccggcccctgggcaccttcaccaagaatgagctgctgggcctcatcctgaacagcaccagcaaccacctgtggctggagttcaacaccaatggaagtgacacagaccagggcttccagctgacctacaccagctttgacctggtgaagtgtgaggaccccggcatccccaactacggctaccgcatcagagatgagggccacttcacagacacagtggtgctgtacagctgcaaccctggctacgccatgcacggcagcaacaccctgacctgcctgagcggggacagaagagtgtgggacaagcccctgcccagctgcatcgccgagtgtggcggccagatccatgctgccaccagcggccgcatcctgagccctggctacccagccccctatgacaacaacctgcactgcacctggatcatcgaggccgaccccgggaagaccatcagcctgcacttcatcgtgtttgacacagagatggcccatgacatcctgaaggtgtgggatggccctgtggacagcgacatcctgctgaaggagtggagcggcagcgccctgcctgaggacatccacagcaccttcaacagcctgaccctgcagtttgacagcgacttcttcatcagcaagagcggcttcagcatccagttcagcaccagcattgctgccacctgcaatgaccccggcatgccccagaatggcaccaggtatggagacagccgggaggccggggacacagtgaccttccagtgtgaccccggctaccagctgcagggccaggccaagatcacctgtgtgcagctgaacaaccgcttcttctggcagcctgacccccccacctgcatcgccgcctgtggcggcaacctgaccggccctgctggggtcatcctgagccccaactacccccagccctacccacctgggaaggaatgtgactggagggtgaaggtgaacccagactttgtgattgccctgatcttcaagagcttcaacatggagcccagctatgacttcctgcacatctatgaaggagaggacagcaacagccccctcatcggcagctaccagggcagccaggcccctgagcgcatcgagagcagcggcaacagcctcttcctggccttcagaagtgatgcctctgtgggcctgagcggctttgccatcgagttcaaggagaagccccgggaggcctgctttgatcctggcaacatcatgaatggcaccagggtgggcacagacttcaagctgggcagcaccatcacctaccagtgtgacagcggctacaagatcctggaccccagcagcatcacctgtgtgattggagcagatggcaagcccagctgggaccaggtgctgcccagctgcaatgccccctgtggcggccagtacacaggcagcgagggcgtggtgctgagccccaactacccccacaactacacagctggccagatctgcctgtacagcatcaccgtgcccaaggagtttgtggtgtttggccagtttgcctacttccagacagccctgaatgacctggccgagctgtttgatggcacccacgcccaggcccggctgctgagcagcctgagcggcagccacagcggggagaccctgcccctggccaccagcaaccagatcctgctgcgcttcagcgccaagagcggggccagcgcccggggcttccactttgtgtaccaggccgtgcccaggaccagtgacacccagtgcagctctgtgcctgagcccaggtatggaagaagaattggcagcgagttctctgctggcagcatcgtgcgctttgagtgcaaccctggctacctgctgcagggcagcacagccctgcactgccagagcgtgcccaatgccctggcccagtggaatgacaccatccccagctgtgtggtgccctgcagcggcaacttcacccagaggcggggcaccatcctgagccctggctacccagagccctacggcaacaacctgaactgcatctggaagatcatcgtgacagagggcagcggcatccagatccaggtgatcagctttgccacagagcagaactgggacagcctggagatccatgatggaggagatgtgacagccccccggctgggcagcttcagcggcaccaccgtgcctgccctgctgaacagcaccagcaaccagctgtacctgcacttccagagcgacatctctgtggccgctgctggcttccacctggagtacaagacagtgggcctggccgcctgccaggagcccgccctgcccagcaacagcatcaagattggagaccgctacatggtgaatgatgtgctgtccttccagtgtgagcccggctacaccctgcagggccgcagccacatcagctgcatgcctggcaccgtgcggcgctggaactaccccagccccctgtgcatcgccacctgtggcggcaccctgagcaccctgggcggcgtcatcctgagccctggcttccctggcagctaccccaacaacctggactgcacctggaggatcagcctgcccatcggctacggggcccacatccagttcctgaacttcagcacagaggccaaccacgacttcctggagatccagaatggcccctaccacaccagccccatgattggccagttctctggaacagacctgcctgctgccctgctgagcaccacccatgagaccctcatccacttctacagcgaccacagccagaaccggcagggcttcaagctggcctaccaggcctatgagctgcagaactgcccagaccccccacccttccagaatggctacatgatcaacagcgactacagcgtgggccagagcgtgtcctttgagtgctacccaggctacatcctgattggccaccctgtgctgacctgccagcacggcatcaacagaaactggaactaccccttcccccgctgtgatgccccctgtggctacaacgtgaccagccagaatggcaccatctacagccctggcttcccagatgagtaccccatcctgaaggactgcatctggctgatcaccgtgcccccaggccacggcgtgtacatcaacttcaccctgctgcagacagaagctgtgaatgactacatcgctgtgtgggatggccctgaccagaacagcccccagctgggcgtcttcagcggcaacacagccctggagacagcctacagcagcaccaaccaggtgctgctgaagttccacagcgacttcagcaatggaggcttctttgtgctgaacttccacgccttccagctgaagaagtgccagcccccacctgctgtgccccaggccgagatgctgacagaagatgatgactttgagatcggggactttgtgaagtaccagtgccaccctggctacaccctggtgggcacagacatcctgacctgcaagctgagcagccagctgcagtttgagggcagcctgcccacctgtgaggcccagtgcccagccaatgaggtgaggacaggcagcagtggagtcatcctgagccctggctacccaggcaactacttcaacagccagacctgctcctggagcatcaaggtggagcccaactacaacatcaccatctttgtggacaccttccagagcgagaagcagtttgatgccctggaggtgtttgatggcagcagcggccagagccccctgctggtggtgctgagcggcaaccacacagagcagagcaacttcaccagccgcagcaaccagctgtacctgcgctggagcacagaccacgccaccagcaagaagggcttcaagatccgctatgctgccccctactgcagcctgacccaccccctgaagaatggaggcatcctgaacagaacagctggagctgtgggcagcaaggtgcactacttctgcaagccaggctacaggatggtgggccacagcaatgccacctgcagaagaaaccccctgggcatgtaccagtgggacagcctgacccccctgtgccaggccgtgtcctgtggcatccctgagagccctggaaatggcagcttcaccggaaatgagttcaccctggacagcaaggtggtgtatgagtgccacgagggcttcaagctggagagcagccagcaggccacagctgtgtgccaggaggatggcctgtggagcaacaagggcaagccacccacctgcaagcctgtggcctgccccagcattgaggcccagctgtctgaacatgtgatctggaggctggtgtctggcagcctgaatgaatatggagcccaggtgctgctgagctgcagccctggctactacctggagggctggaggctgctgcgctgccaggccaacggcacctggaacattggagatgagcggcccagctgcagagctggccactgcggcagcccagaccccatcgtgaatggccacatctctggagatggcttctcctacagagacacagtggtgtaccagtgcaaccctggcttccggctggtgggcacctctgtgcgcatctgcctgcaggaccacaagtggagcggccagacccctgtgtgtgtgcccatcacctgtggccaccctggcaacccagcccacggcttcaccaacggcagcgagttcaacctgaatgatgtggtgaacttcacctgcaacacaggctacctgctgcagggcgtgtcccgggcccagtgccgcagcaatggccagtggagcagccccctgcccacctgccgggtggtgaactgcagcgaccccggctttgtggagaatgccatccgccacggccagcagaacttccctgagagctttgaatatggcatgagcatcctgtaccactgcaagaagggcttctacctgctgggcagcagcgccctgacctgcatggccaacggcctgtgggacaggagcctgcccaagtgcctggccatcagctgtggccaccctggggtgcctgccaatgctgtgctgactggagagctgttcacctatggagctgtggtgcactacagctgccggggcagcgagagcctgattggaaatgacaccagggtgtgccaggaggacagccactggagcggggccctgccccactgcaccggcaacaaccctggcttctgtggggaccccggcaccccagcccacggcagccggctgggagatgacttcaagaccaagagcctgctgcgcttcagctgtgagatgggccaccagctgcggggcagccctgagaggacctgcctgctgaatggctcctggagcggcctgcagcctgtgtgtgaggccgtgctgtgcccccagcccccacctgtgcagaatggcaccgtggagggcagtgacttccgctggggcagcagcatctcctacagctgcatggatggctaccagctgagccacagcgccatcctgagctgtgagggccggggcgtgtggaagggggagatcccccagtgcctgcctgtgttctgtggggaccccggcatcccagctgagggccgcctgagcggcaagagcttcacctacaagtctgaggtgttcttccagtgcaagagccccttcatcctggtgggcagcagcagaagagtgtgccaggctgatggcacctggagcggcatccagcccacctgcatcgaccctgcccacaacacctgcccagaccccggcaccccccacttcggcatccagaacagcagccggggctatgaggtgggcagcacagtgttcttccgctgcaggaagggctaccacatccagggcagcaccaccaggacctgcctggccaacctgacctggagcggcatccagacagagtgcatcccccacgcctgccggcagcctgagaccccagcccatgctgatgtgcgggccatcgacctgcccaccttcggctacaccctggtgtacacctgccaccctggcttcttcctggccggcggcagcgagcacaggacctgcaaggctgacatgaagtggacaggcaagagccctgtgtgcaagagcaagggcgtgcgggaggtgaatgagaccgtgaccaagacccctgtgcccagtgatgtgttctttgtgaacagcctgtggaagggctactatgagtacctgggcaagaggcagcctgccaccctgactgtggactggttcaatgccaccagcagcaaggtgaatgccaccttcagcgaggccagccctgtggagctgaagctgaccggcatctacaagaaggaggaggcccacctgctgctgaaggccttccagatcaagggccaggccgacatctttgtgtccaagtttgaaaatgacaactggggcctggatggctacgtgagcagcggcctggagcggggcggcttcaccttccagggcgacatccacggcaaggactttgggaagttcaagctggagcggcaggaccccctgaacccagaccaggacagcagcagccactaccacggcaccagcagcggctctgtggccgccgccatcctggtgcccttctttgccctgatcctgagcggctttgccttctacctgtacaagcacaggacccggcccaaggtgcagtacaacggctacgccggccacgagaacagcaatggccaggccagctttgagaaccccatgtatgacaccaacctgaagcccacagaggccaaggctgtgcgctttgacaccaccctgaacacagtgtgcaccgtggtgtag

SEQ ID NO: 148709 - DNA, 10464 bp, Artificial Sequence
  Description of Artificial Sequence: Synthetic coding sequence
atgaggctcatcagcatcgcccctggcccccgctggcaggtgcagagccaccaccccaggtctgctggccagaactgcaccttccagctgcacggccccaacggcaccgtggagagccctggcttcccctacggctaccccaactatgccaactgcacctggaccatcacagctgaggagcagcaccgcatccagctggtgttccagagctttgccctggaggaggactttgatgtgctgtctgtgtttgatggccccccccagcctgagaacctgcggacccggctgaccggcttccagctgcctgccaccatcgtgtctgctgccaccaccctgagcctgcggctcatcagtgactatgctgtgtctgcccagggcttccacgccacctatgaggtgctgcccagccacacctgtggcaaccctggccgcctgcccaacggcatccagcagggcagcaccttcaacctgggggacaaggtgcgctacagctgcaacctgggcttcttcctggagggccatgctgtgctgacctgccacgccggcagcgagaacagcgccacctgggacttccccctgcccagctgcagagcagatgatgcctgtggcggcaccctgcggggccagagcggcatcatcagcagcccccacttccccagcgagtaccacaacaatgctgactgcacctggaccatcctggccgagctgggggacaccatcgccctggtgttcatcgacttccagctggaggatggctatgacttcctggaggtgactggaacagagggcagcagcctgtggttcaccggggccagcctgcctgcccctgtgatcagcagcaagaactggctgcggctgcacttcaccagtgatggcaaccaccggcagaggggcttcagcgcccagtaccaggtgaagaagcagatcgagctgaagagcagaggagtgaagctgatgcccagcaaggacaacagccagaagacctctgtgctgacccaggtgggcgtgtcccagggccacaacatgtgcccagaccccggcatccctgagcggggcaagaggctgggcagtgacttccggctgggcagctctgtgcagttcacctgcaatgaaggctatgacctgcagggcagcaagaggatcacctgcatgaaggtgtctgacatgtttgctgcctggagcgaccacaggcctgtgtgccgggccaggatgtgtgatgcccacctgcggggccccagcggcatcatcaccagccccaacttccccatccagtatgacaacaatgcccactgtgtgtggatcatcacagccctgaaccccagcaaggtgatcaagctggcctttgaggagtttgacctggagcggggctatgacaccctgactgtgggagatggcggccaggatggagaccagaagacagtgctgtacatcctgaccggcacctctgtgcctgacctgattgtgtccaccaaccaccagatgtggctgctcttccagacagatggcagcggcagcagcctgggcttcaaggccagctatgaggagattgagcagggcagctgtggggaccccggcatcccagcctatggaagaagagagggcagccgcttccaccacggggacaccctgaagtttgagtgccagcctgcctttgagctggtgggccagaaggccatcacctgccagaagaacaaccagtggagcgccaagaagccaggctgtgtgttcagctgcttcttcaacttcaccagccccagcggcgtggtgctgagccccaactacccagaggactatggcaaccacctgcactgtgtgtggctgatcctggcccggcctgagagccgcatccacctggccttcaatgacattgatgtggagccccagtttgacttcctggtgatcaaggatggagccacagctgaggcccctgtgctgggcaccttcagcggcaaccagctgcccagcagcatcaccagcagcggccacgtggcccggctggagttccagacagaccacagcacaggcaagaggggcttcaacatcaccttcaccaccttccgccacaatgaatgtcctgaccccggggtgcctgtgaatggcaagagatttggagacagcctgcagctgggcagcagcatctccttcctgtgtgatgagggcttcctgggcacccagggcagcgagaccatcacctgtgtgctgaaggagggctctgtggtgtggaacagcgctgtgctgcgctgtgaggccccctgtggcggccacctgaccagccccagcggcaccatcctgagccctggctggccaggcttctacaaggatgccctgagctgtgcctgggtgattgaggcccagcccggctaccccatcaagatcacctttgaccgcttcaagacagaggtgaactatgacaccctggaggtgagagatggccgcacctacagcgcccccctgattggagtgtaccacggcacccaggtgccccagttcctgatcagcaccagcaactacctgtacctgctcttcagcacagacaagagccacagcgacatcggcttccagctgcgctatgagaccatcaccctgcagagcgaccactgcctggaccccggcatccctgtgaatggccagagacatggaaatgacttctacgtgggcgccctggtgaccttcagctgtgacagcggctacaccctgagtgatggagagcccctggagtgtgagcccaacttccagtggagccgggccctgcccagctgtgaggccctgtgtggcggcttcatccagggcagcagcggcaccatcctgagccctggcttcccagacttctaccccaacaacctgaactgcacctggatcatcgagaccagccacggcaagggcgtcttcttcaccttccacaccttccacctggagagcggccatgactacctgctgatcacagaaaatggcagcttcacccagcccctgcggcagctgaccggcagccggctgcctgcccccatctctgctggcctgtatggcaacttcaccgcccaggtgcgcttcatcagtgacttctccatgtcctatgagggcttcaacatcaccttctctgaatatgacctggagccctgtgaggagcctgaggtgcctgcctacagcatcaggaagggcctgcagtttggagtgggggacaccctgaccttcagctgcttccctggctaccgcctggagggcacagcccgcatcacctgcctgggcggcagaagaaggctgtggagcagccccctgccccgctgtgtggctgaatgtggcaacagcgtgacaggcacccagggcaccctgctgagccccaacttccctgtgaactacaacaacaaccacgagtgcatctacagcatccagacccagcccgggaagggcatccagctgaaggcccgggcctttgagctgtctgaaggagatgtgctgaaggtgtatgatggcaacaacaacagcgcccggctgctgggcgtcttcagccacagcgagatgatgggcgtgaccctgaacagcaccagcagcagcctgtggctggacttcatcacagatgctgagaacaccagcaaaggatttgagctgcacttcagcagctttgagctgatcaagtgtgaggaccccggcacccccaagtttggctacaaggtgcatgatgagggccactttgctggcagctctgtgtccttcagctgtgaccccggctacagcctgcggggcagcgaggagctgctgtgcctgagcggggagaggaggacctgggaccggcccctgcccacctgtgtggccgagtgtggcggcaccgtgcggggggaggtgtctggccaggtgctgagccctggctacccagccccctatgagcacaacctgaactgcatctggaccatcgaggccgaggccggctgcaccatcggcctgcacttcctggtgtttgacacagaggaggtgcatgatgtgctgcgcatctgggatggccctgtggagagcggcgtgctgctgaaggagctgagcggccctgccctgcccaaggacctgcacagcaccttcaacagcgtggtgctgcagttcagcacagacttcttcaccagcaagcagggctttgccatccagttctctgtgtccacagccaccagctgcaatgaccccggcatcccccagaatggcagccgcagcggggacagctgggaggccggggacagcacagtgttccagtgtgaccccggctacgccctgcagggcagcgctgagatcagctgtgtgaagattgaaaatcgcttcttctggcagcccagcccccccacctgcatcgccccctgtggcggggacctgaccggccccagcggggtcatcctgagccccaactacccagagccctacccacctgggaaggaatgtgactggaaggtgacagtgtccccagactatgtgattgccctggtgttcaacatcttcaacctggagcccggctatgacttcctgcacatctatgatggccgggacagcctgagccccctcatcggcagcttctacggcagccagctgcccggccgcatcgagagcagcagcaacagcctcttcctggccttcagaagtgatgcctctgtgtccaatgccggcttcgtcatcgactacacagagaacccccgggagagctgctttgatcctggcagcatcaagaatggcaccagggtgggcagtgacctgaagctgggcagctctgtgacctactactgccacggcggctatgaggtggagggcaccagcaccctgagctgcatcctgggcccagatggcaagcctgtgtggaacaaccccaggcctgtgtgcacagccccctgtggcggccagtatgtgggcagtgatggagtggtgctgagccccaactacccccagaactacaccagcggccagatctgcctgtactttgtgacagtgcccaaggactatgtggtgtttggccagtttgccttcttccacacagccctgaatgatgtggtggaggtgcatgatggccacagccagcacagccggctgctgagcagcctgagcggcagccacactggagagagcctgcccctggccaccagcaaccaggtgctgatcaagttcagcgccaagggcctggccccagcccggggcttccactttgtgtaccaggccgtgcccaggaccagcgccacccagtgcagctctgtgcctgagcccaggtatggcaagaggctgggcagtgacttctctgtgggcgccatcgtgcgctttgagtgcaacagcggctacgccctgcagggcagccctgagattgagtgcctgcctgtgcctggggccctggcccagtggaatgtgtctgcccccacctgtgtggtgccctgtggcggcaacctgacagaaagaagaggcaccatcctgagccctggcttccctgagccctacctgaacagcctgaactgtgtgtggaagatcgtggtgcctgagggcgccggcatccagatccaggtggtgtcctttgtgacagagcagaactgggacagcctggaggtgtttgatggagctgacaacacagtgaccatgctgggcagcttcagcggcaccaccgtgcctgccctgctgaacagcaccagcaaccagctgtacctgcacttctacagcgacatctctgtgtctgctgctggcttccacctggagtacaagacagtgggcctgagcagctgcccagagcctgctgtgcccagcaatggagtgaagacaggagagcgctacctggtgaatgatgtggtgtccttccagtgtgagcccggctacgccctgcagggccacgcccacatcagctgcatgcctggcaccgtgcggcgctggaactaccccccacccctgtgcatcgcccagtgtggcggcaccgtggaggagatggagggcgtcatcctgagccctggcttccctggcaactaccccagcaacatggactgctcctggaagatcgccctgcctgtgggctttggagcccacatccagttcctgaacttcagcacagagcccaaccacgactacatcgagatcagaaatggcccctatgagaccagcaggatgatgggccgcttcagcggcagcgagctgcccagcagcctgctgagcaccagccatgagaccaccgtgtacttccacagcgaccacagccagaacagacctggcttcaagctggagtaccaggacctgacctacagccaccagatcagcagcttcctgcggggctttgacctgtctgagctggagaggaccaacagcaccccacctgtggccgccagctatgtgtgggacctggaccccggctgtgaggcctatgagctgcaggagtgcccagaccctgagccctttgccaatggaattgtgagaggagctggctacaacgtgggccagagcgtgacctttgagtgcctgcccggctaccagctgaccggccaccctgtgctgacctgccagcacggcaccaacagaaactgggaccaccccctgcccaagtgtgaggtgccctgtggcggcaacatcaccagcagcaatggcaccgtgtacagccctggcttccccagcccctacagcagcagccaggactgtgtgtggctgatcaccgtgcccatcggccacggcgtgcggctgaacctgagcctgctgcagacagagcccagcggggacttcatcaccatctgggatggcccccagcagacagccccccggctgggcgtcttcaccaggtccatggccaagaagacagtgcagagcagcagcaaccaggtgctgctgaagttccacagagatgctgccaccggcggcatctttgccatcgccttcagcgcctaccccctgaccaagtgccccccacccaccatcctgcccaatgctgaggtggtgacagaaaatgaggagttcaacatcggggacatcgtgcgctaccgctgcctgcccggcttcaccctggtgggcaatgagatcctgacctgcaagctgggcacctacctgcagtttgagggccccccacccatctgtgaggtgcactgccccaccaatgagctgctgacagacagcactggagtcatcctgagccagagctacccaggcagctacccccagttccagacctgctcctggctggtgcgggtggagccagactacaacatcagcctgactgtggagtacttcctgtctgagaagcagtatgatgaatttgagatctttgatggccccagcggccagagccccctgctgaaggccctgagcggcaactacagcgcccccctcatcgtgaccagcagcagcaacagcgtgtacctgcgctggagcagtgaccacgcctacaacaggaagggcttcaagatccgctacagcgccccctactgcagcctgccccgggcccccctgcacggcttcatcctgggccagaccagcacccagcccggcggcagcatccacttcggctgcaatgccggctaccgcctggtgggccacagcatggccatctgcaccaggcacccccagggctaccacctgtggagcgaggccatccccctgtgccaggccctgagctgtggcctgcctgaggcccccaagaatggcatggtgtttgggaaggagtacacagtgggcaccaaggccatgtacagctgcagcgagggctaccacctgcaggccggggctgaggccacagctgagtgcctggacaccggcctgtggagcaacagaaatgtgcccccccagtgtgtgcctgtgacctgcccagatgtgagcagcatctctgtggagcacggccgctggaggctcatctttgagacccagtaccagttccaggcccagctgatgctgatctgtgaccccggctactactacacaggccagagggtcatccgctgccaggccaacgggaagtggagcctgggggacagcacccccacctgccgcatcatcagctgtggggagctgcccatcccccccaacggccaccgcatcggcaccctgtctgtgtatggagccacagccatcttcagctgcaacagcggctacaccctggtgggcagccgggtgcgggagtgcatggccaacggcctgtggagcggcagcgaggtgcgctgcctggccggccactgcggcaccccagagcccatcgtgaatggccacatcaacggggagaactacagctaccggggctctgtggtgtaccagtgcaatgccggcttccggctgattggcatgtctgtgcgcatctgccagcaggaccaccactggagcggcaagacccccttctgtgtgctggtgtcctgtggccaccctggcagccccccccacagccagatgtctggggacagctacacagtgggcgctgtggtgcgctacagctgcatcggcaagaggaccctggtgggcaacagcaccaggatgtgtggcctggatggccactggacaggcagcctgccccactgcagcggcacctctgtgggcgtgtgtggggaccccggcatcccagcccacggcatccggctgggggacagctttgatcctggcaccgtgatgaggttcagctgtgaggccggccacgtgctgcggggcagcagcgagaggacctgccaggccaacggctcctggagcggcagccagccagaatgtggggtcatcagctgtggcaaccctggcacccccagcaatgcccgggtggtgttcagtgatggcctggtgttcagcagcagcatcgtgtatgaatgtcgggagggctactatgccaccggcctgctgagccgccactgcagcgtgaatggcacctggacaggcagtgaccctgagtgcctggtgatcaactgtggggaccccggcatcccagccaacggcctgcggctgggcaatgacttccgctacaacaagacagtgacctaccagtgtgtgcccggctacatgatggagagccaccgggtgtctgtgctgagctgcaccaaggacaggacctggaatggcaccaagcctgtgtgcaaggccctgatgtgcaagcccccacccctcatccccaacgggaaggtggtgggcagtgacttcatgtggggcagctctgtgacctacgcctgcctggagggctaccagctgagcctgcctgctgtgttcacctgtgagggcaatggctcctggacaggagagctgccccagtgcttccctgtgttctgtggggaccccggggtgcccagccggggccggcgggaggaccggggcttctcctaccgcagctctgtgtccttcagctgccacccccccctggtgctggtgggcagcccccggcgcttctgccagagtgatggcacctggagcggcacccagcccagctgcatcgaccccaccctgaccacctgtgccgaccccggggtgccccagtttggcatccagaacaacagccagggctaccaggtgggcagcacagtgctcttccgctgccagaagggctacctgctgcagggcagcaccaccaggacctgcctgcccaacctgacctggagcggcaccccaccagactgtgtgccccaccactgccggcagcctgagacccccacccacgccaacgtgggcgccctggacctgcccagcatgggctacaccctcatctacagctgccaggagggcttcagcctgaagggcggcagcgagcacaggacctgcaaggcagatggctcctggacaggcaagccacccatctgcctggaggtgcggcccagcggccggcccatcaacacagcccgggagccccccctgacccaggccctgatccctggagatgtgtttgccaagaacagcctgtggaagggggcctatgagtaccagggcaagaagcagcctgccatgctgcgggtgacaggcttccaggtggccaacagcaaggtgaatgccaccatgattgaccacagcggcgtggagctgcacctggccggcacctacaagaaggaggacttccacctgctgctgcaggtgtaccagatcactggacctgtggagatcttcatgaacaagttcaaggatgaccactgggccctggatggccacgtgagcagcgagagcagcggggccaccttcatctaccagggctctgtgaagggccagggcttcggccagtttggcttccagaggctggacctgcggctgctggagagtgaccctgagagcatcggccgccactttgccagcaacagcagctctgtggccgccgccatcctggtgcccttcatcgccctgatcatcgccggctttgtgctgtacctgtacaagcacagaagaagacccaaggtgcccttcaacggctacgccggccacgagaacaccaacgtgcgggccacctttgagaaccccatgtatgacaggaacatccagcccacagacatcatggccagcgaggccgagttcaccgtgtccacagtgtgcacagctgtgtag

SEQ ID NO: 148710 - DNA, 678 bp, Artificial Sequence
  Description of Artificial Sequence: Synthetic coding sequence
atgtgtgatgcccacctgcggggccccagcggcatcatcaccagccccaacttccccatccagtatgacaacaatgcccactgtgtgtggatcatcacagccctgaaccccagcaaggccggcggggaccccggcaacatccagtgcaacaaggagggcctgtctgtggagacccagagcctgcggctgaggaacagaagctgcctgctgggcaacagcaaggacaatggctgctgcgtgcccaaccctgtgcatggaacaggcctgcaggtgatcaagctggcctttgaggagtttgacctggagcggggctatgacaccctgactgtgggagatggcggccaggatggagaccagaagacagtgctgtacatcctgaccggcacctctgtgcctgacctgattgtgtccaccaaccaccagatgtggctgctcttccagacagatggcagcggcagcagcctgggcttcaaggccagctatgaggagattgagcagggcagctgtggggaccccggcatcccagcctatggaagaagagagggcagccgcttccaccacggggacaccctgaagtttgagtgccagcctgcctttgagctggtgggccagaaggccatcacctgccagaagaacaaccagtggagcgccaagaagccaggctgtgtgtgcaagtag

SEQ ID NO: 148711 - DNA, 1281 bp, Artificial Sequence
  Description of Artificial Sequence: Synthetic coding sequence
atgctgggcagcttcagcggcaccaccgtgcctgccctgctgaacagcaccagcaaccagctgtacctgcacttctacagcgacatctctgtgtctgctgctggcttccacctggagtacaagacagtgggcctgagcagctgcccagagcctgctgtgcccagcaatggagtgaagacaggagagcgctacctggtgaatgatgtggtgtccttccagtgtgagcccggctacgccctgcagggccacgcccacatcagctgcatgcctggcaccgtgcggcgctggaactaccccccacccctgtgcatcgcccagtgtggcggcaccgtggaggagatggagggcgtcatcctgagccctggcttccctggcaactaccccagcaacatggactgctcctggaagatcgccctgcctgtgggctttggagcccacatccagttcctgaacttcagcacagagcccaaccacgactacatcgagatcagaaatggcccctatgagaccagcaggatgatgggccgcttcagcggcagcgagctgcccagcagcctgctgagcaccagccatgagaccaccgtgtacttccacagcgaccacagccagaaccggcccggcttcaagctggagtaccaggcctatgagctgcaggagtgcccagaccctgagccctttgccaacggcatcgtgcggggggccggctacaacgtgggccagagcgtgacctttgaatgtctgcccggctaccagctgaccggccaccctgtgctgacctgccagcacggcaccaacagaaactgggaccaccccctgcccaagtgtgaggtgccctgtggcggcaacatcaccagcagcaatggaacagtgtacagccctggcttccccagcccctacagcagcagccaggactgtgtgtggctgatcaccgtgcccatcggccatggagtgcggctgaacctgagcctgctgcagacagagcccagcggggacttcatcaccatctgggatggcccccagcagacagccccccggctgggcgtcttcaccaggtccatggccaagaagacagtgcagagcagcagcaaccaggtgctgctgaagttccacagagatgctgccactggaggcatctttgccatcgccttcagtgaccactgccgctacttcaaccagaagagcggcaagctggacttcacccccagcagcaccctgggccagctgtgcaagaccctgcacaggagcctgccccacctgcggctgcagttcctgcacctgtag

SEQ ID NO: 148712 - DNA, 3504 bp, Artificial Sequence
  Description of Artificial Sequence: Synthetic coding sequence
atggtgattgtcatcctcttcccagcagaatgtggcaacagcgtgacaggcacccagggcaccctgctgagccccaacttccctgtgaactacaacaacaaccacgagtgcatctacagcatccagacccagcccgggaagggcatccagctgaaggcccgggcctttgagctgtctgaaggagatgtgctgaaggtgtatgatggcaacaacaacagcgcccggctgctgggcgtcttcagccacagcgagatgatgggcgtgaccctgaacagcaccagcagcagcctgtggctggacttcatcacagatgctgagaacaccagcaagggctttgagctgcacttcagcagctttgagctgatcaagtgtgaagatcctggcacccccaagtttggctacaaggtgcatgatgagggccactttgctggcagctctgtgtccttcagctgtgaccccggctacagcctgcggggcagcgaggagctgctgtgcctgtctggagagaggaggacctgggaccggcccctgcccacctgtgtggctgaatgtggcggcaccgtgcggggggaggtgtctggccaggtgctgagccctggctacccagccccctatgagcacaacctgaactgcatctggaccattgaagctgaggccggctgcaccatcggcctgcacttcctggtgtttgacacagaggaggtgcatgatgtgctgcgcatctgggatggccctgtggagagcggcgtgctgctgaaggagctgagcggccctgccctgcccaaggacctgcacagcaccttcaacagcgtggtgctgcagttcagcacagacttcttcaccagcaagcagggctttgccatccagttctctgtgtccacagccaccagctgcaatgaccccggcatcccccagaatggcagccgcagcggggacagctgggaggccggggacagcaccgtcttccagtgtgaccccggctacgccctgcagggcagcgctgagatcagctgtgtgaagattgagaaccgcttcttctggcagcccagcccccccacctgcatcgccccctgtggcggggacctgaccggccccagcggggtcatcctgagccccaactacccagagccctacccacctgggaaggaatgtgactggaaggtgacagtgtccccagactatgtgattgccctggtgttcaacatcttcaacctggagcccggctatgacttcctgcacatctatgatggccgggacagcctgagccccctgattggcagcttctacggcagccagctgcccggcagaattgagagcagcagcaacagcctcttcctggccttcagaagtgatgcctctgtgtccaatgccggctttgtgattgactacacagagaacccccgggagagctgctttgaccccggcagcatcaagaatggcaccagggtgggcagtgacctgaagctgggcagctctgtgacctactactgccacggcggctatgaggtggagggcaccagcaccctgagctgcatcctgggcccagatggcaagcctgtgtggaacaaccccaggcctgtgtgcacagccccctgtggcggccagtatgtgggcagtgatggagtggtgctgagccccaactacccccagaactacaccagcggccagatctgcctgtactttgtgacagtgcccaaggactatgtggtgtttggccagtttgccttcttccacacagccctgaatgatgtggtggaggtgcatgatggccacagccagcacagccggctgctgagcagcctgagcggcagccacactggagagagcctgcccctggccaccagcaaccaggtgctgatcaagttcagcgccaagggcctggccccagcccggggcttccactttgtgtaccaggccgtgcccaggaccagcgccacccagtgcagctctgtgcctgagcccaggtatggcaagaggctgggcagtgacttctctgtgggcgccatcgtgcgctttgagtgcaacagcggctacgccctgcagggcagccctgagattgaatgtctgcctgtgcctggggccctggcccagtggaatgtgtctgcccccacctgtgtggtgccctgtggcggcaacctgacagagcggcggggcaccatcctgagccctggcttccctgagccctacctgaacagcctgaactgtgtgtggaagatcgtggtgcctgagggcgccggcatccagatccaggtggtgtcctttgtgacagagcagaactgggacagcctggaggtgtttgatggagctgacaacacagtgaccatgctgggcagcttcagcggcaccaccgtgcctgccctgctgaacagcaccagcaaccagctgtacctgcacttctacagcgacatctctgtgtctgctgctggcttccacctggagtacaagacagtgggcctgagcagctgcccagagcctgctgtgcccagcaatggagtgaagacaggagagcgctacctggtgaatgatgtggtgtccttccagtgtgagcccggctacgccctgcagggccacgcccacatcagctgcatgcctggcaccgtgcggcgctggaactaccccccacccctgtgcatcgcccagtgtggcggcaccgtggaggagatggagggcgtcatcctgagccctggcttccctggcaactaccccagcaacatggactgctcctggaagatcgccctgcctgtgggctttggagcccacatccagttcctgaacttcagcacagagcccaaccacgactacatcgagatcagaaatggcccctatgagaccagcaggatgatgggccgcttcagcggcagcgagctgcccagcagcctgctgagcaccagccatgagaccaccgtgtacttccacagcgaccacagccagaaccggcccggcttcaagctggagtaccaggcctatgagctgcaggagtgcccagaccctgagccctttgccaacggcatcgtgcggggggccggctacaacgtgggccagagcgtgacctttgaatgtctgcccggctaccagctgaccggccaccctgtgctgacctgccagcacggcaccaacagaaactgggaccaccccctgcccaagtgtgaggtgccctgtggcggcaacatcaccagcagcaatggaacagtgtacagccctggcttccccagcccctacagcagcagccaggactgtgtgtggctgatcaccgtgcccatcggccatggagtgcggctgaacctgagcctgctgcagacagagcccagcggggacttcatcaccatctgggatggcccccagcagacagccccccggctgggcgtcttcaccaggtccatggccaagaagacagtgcagagcagcagcaaccaggtgctgctgaagttccacagagatgctgccactggaggcatctttgccatcgccttcagcggccacctggccgctgtgtgcaccctgtag

SEQ ID NO: 148713 - DNA, 10896 bp, Artificial Sequence
  Description of Artificial Sequence: Synthetic coding sequence
atgcccaggagccggggccgggagctgggccgctgtggctgcccagctggccgggcccggggggagaccggcatcagcgccctggtgcctggggccggcagccgctggggccggcccccaccacccaccccaccacccctgctgctgctgctgggctgcggcctgctgtctgtgtctgctgctgctggccagaactgcaccttccagctgcacggccccaacggcaccgtggagagccctggcttcccctacggctaccccaactatgccaactgcacctggaccatcacagctgaggagcagcaccgcatccagctggtgttccagagctttgccctggaggaggactttgatgtgctgtctgtgtttgatggccccccccagcctgagaacctgcggacccggctgaccggcttccagctgcctgccaccatcgtgtctgctgccaccaccctgagcctgcggctcatcagtgactatgctgtgtctgcccagggcttccacgccacctatgaggtgctgcccagccacacctgtggcaaccctggccgcctgcccaacggcatccagcagggcagcaccttcaacctgggggacaaggtgcgctacagctgcaacctgggcttcttcctggagggccatgctgtgctgacctgccacgccggcagcgagaacagcgccacctgggacttccccctgcccagctgcagagcagatgatgcctgtggcggcaccctgcggggccagagcggcatcatcagcagcccccacttccccagcgagtaccacaacaatgctgactgcacctggaccatcctggccgagctgggggacaccatcgccctggtgttcatcgacttccagctggaggatggctatgacttcctggaggtgactggaacagagggcagcagcctgtggttcaccggggccagcctgcctgcccctgtgatcagcagcaagaactggctgcggctgcacttcaccagtgatggcaaccaccggcagaggggcttcagcgcccagtaccaggtgaagaagcagatcgagctgaagagcagaggagtgaagctgatgcccagcaaggacaacagccagaagacctctgtgctgacccaggtgggcgtgtcccagggccacaacatgtgcccagaccccggcatccctgagcggggcaagaggctgggcagtgacttccggctgggcagctctgtgcagttcacctgcaatgaaggctatgacctgcagggcagcaagaggatcacctgcatgaaggtgtctgacatgtttgctgcctggagcgaccacaggcctgtgtgccgggccaggatgtgtgatgcccacctgcggggccccagcggcatcatcaccagccccaacttccccatccagtatgacaacaatgcccactgtgtgtggatcatcacagccctgaaccccagcaaggtgatcaagctggcctttgaggagtttgacctggagcggggctatgacaccctgactgtgggagatggcggccaggatggagaccagaagacagtgctgtacatcctgaccggcacctctgtgcctgacctgattgtgtccaccaaccaccagatgtggctgctcttccagacagatggcagcggcagcagcctgggcttcaaggccagctatgaggagattgagcagggcagctgtggggaccccggcatcccagcctatggaagaagagagggcagccgcttccaccacggggacaccctgaagtttgagtgccagcctgcctttgagctggtgggccagaaggccatcacctgccagaagaacaaccagtggagcgccaagaagccaggctgtgtgttcagctgcttcttcaacttcaccagccccagcggcgtggtgctgagccccaactacccagaggactatggcaaccacctgcactgtgtgtggctgatcctggcccggcctgagagccgcatccacctggccttcaatgacattgatgtggagccccagtttgacttcctggtgatcaaggatggagccacagctgaggcccctgtgctgggcaccttcagcggcaaccagctgcccagcagcatcaccagcagcggccacgtggcccggctggagttccagacagaccacagcacaggcaagaggggcttcaacatcaccttcaccaccttccgccacaatgaatgtcctgaccccggggtgcctgtgaatggcaagagatttggagacagcctgcagctgggcagcagcatctccttcctgtgtgatgagggcttcctgggcacccagggcagcgagaccatcacctgtgtgctgaaggagggctctgtggtgtggaacagcgctgtgctgcgctgtgaggccccctgtggcggccacctgaccagccccagcggcaccatcctgagccctggctggccaggcttctacaaggatgccctgagctgtgcctgggtgattgaggcccagcccggctaccccatcaagatcacctttgaccgcttcaagacagaggtgaactatgacaccctggaggtgagagatggccgcacctacagcgcccccctgattggagtgtaccacggcacccaggtgccccagttcctgatcagcaccagcaactacctgtacctgctcttcagcacagacaagagccacagcgacatcggcttccagctgcgctatgagaccatcaccctgcagagcgaccactgcctggaccccggcatccctgtgaatggccagagacatggaaatgacttctacgtgggcgccctggtgaccttcagctgtgacagcggctacaccctgagtgatggagagcccctggagtgtgagcccaacttccagtggagccgggccctgcccagctgtgaggccctgtgtggcggcttcatccagggcagcagcggcaccatcctgagccctggcttcccagacttctaccccaacaacctgaactgcacctggatcatcgagaccagccacggcaagggcgtcttcttcaccttccacaccttccacctggagagcggccatgactacctgctgatcacagaaaatggcagcttcacccagcccctgcggcagctgaccggcagccggctgcctgcccccatctctgctggcctgtatggcaacttcaccgcccaggtgcgcttcatcagtgacttctccatgtcctatgagggcttcaacatcaccttctctgaatatgacctggagccctgtgaggagcctgaggtgcctgcctacagcatcaggaagggcctgcagtttggagtgggggacaccctgaccttcagctgcttccctggctaccgcctggagggcacagcccgcatcacctgcctgggcggcagaagaaggctgtggagcagccccctgccccgctgtgtggctgaatgtggcaacagcgtgacaggcacccagggcaccctgctgagccccaacttccctgtgaactacaacaacaaccacgagtgcatctacagcatccagacccagcccgggaagggcatccagctgaaggcccgggcctttgagctgtctgaaggagatgtgctgaaggtgtatgatggcaacaacaacagcgcccggctgctgggcgtcttcagccacagcgagatgatgggcgtgaccctgaacagcaccagcagcagcctgtggctggacttcatcacagatgctgagaacaccagcaaaggatttgagctgcacttcagcagctttgagctgatcaagtgtgaggaccccggcacccccaagtttggctacaaggtgcatgatgagggccactttgctggcagctctgtgtccttcagctgtgaccccggctacagcctgcggggcagcgaggagctgctgtgcctgagcggggagaggaggacctgggaccggcccctgcccacctgtgtggccgagtgtggcggcaccgtgcggggggaggtgtctggccaggtgctgagccctggctacccagccccctatgagcacaacctgaactgcatctggaccatcgaggccgaggccggctgcaccatcggcctgcacttcctggtgtttgacacagaggaggtgcatgatgtgctgcgcatctgggatggccctgtggagagcggcgtgctgctgaaggagctgagcggccctgccctgcccaaggacctgcacagcaccttcaacagcgtggtgctgcagttcagcacagacttcttcaccagcaagcagggctttgccatccagttctctgtgtccacagccaccagctgcaatgaccccggcatcccccagaatggcagccgcagcggggacagctgggaggccggggacagcacagtgttccagtgtgaccccggctacgccctgcagggcagcgctgagatcagctgtgtgaagattgaaaatcgcttcttctggcagcccagcccccccacctgcatcgccccctgtggcggggacctgaccggccccagcggggtcatcctgagccccaactacccagagccctacccacctgggaaggaatgtgactggaaggtgacagtgtccccagactatgtgattgccctggtgttcaacatcttcaacctggagcccggctatgacttcctgcacatctatgatggccgggacagcctgagccccctcatcggcagcttctacggcagccagctgcccggccgcatcgagagcagcagcaacagcctcttcctggccttcagaagtgatgcctctgtgtccaatgccggcttcgtcatcgactacacagagaacccccgggagagctgctttgatcctggcagcatcaagaatggcaccagggtgggcagtgacctgaagctgggcagctctgtgacctactactgccacggcggctatgaggtggagggcaccagcaccctgagctgcatcctgggcccagatggcaagcctgtgtggaacaaccccaggcctgtgtgcacagccccctgtggcggccagtatgtgggcagtgatggagtggtgctgagccccaactacccccagaactacaccagcggccagatctgcctgtactttgtgacagtgcccaaggactatgtggtgtttggccagtttgccttcttccacacagccctgaatgatgtggtggaggtgcatgatggccacagccagcacagccggctgctgagcagcctgagcggcagccacactggagagagcctgcccctggccaccagcaaccaggtgctgatcaagttcagcgccaagggcctggccccagcccggggcttccactttgtgtaccaggccgtgcccaggaccagcgccacccagtgcagctctgtgcctgagcccaggtatggcaagaggctgggcagtgacttctctgtgggcgccatcgtgcgctttgagtgcaacagcggctacgccctgcagggcagccctgagattgagtgcctgcctgtgcctggggccctggcccagtggaatgtgtctgcccccacctgtgtggtgccctgtggcggcaacctgacagaaagaagaggcaccatcctgagccctggcttccctgagccctacctgaacagcctgaactgtgtgtggaagatcgtggtgcctgagggcgccggcatccagatccaggtggtgtcctttgtgacagagcagaactgggacagcctggaggtgtttgatggagctgacaacacagtgaccatgctgggcagcttcagcggcaccaccgtgcctgccctgctgaacagcaccagcaaccagctgtacctgcacttctacagcgacatctctgtgtctgctgctggcttccacctggagtacaagacagtgggcctgagcagctgcccagagcctgctgtgcccagcaatggagtgaagacaggagagcgctacctggtgaatgatgtggtgtccttccagtgtgagcccggctacgccctgcagggccacgcccacatcagctgcatgcctggcaccgtgcggcgctggaactaccccccacccctgtgcatcgcccagtgtggcggcaccgtggaggagatggagggcgtcatcctgagccctggcttccctggcaactaccccagcaacatggactgctcctggaagatcgccctgcctgtgggctttggagcccacatccagttcctgaacttcagcacagagcccaaccacgactacatcgagatcagaaatggcccctatgagaccagcaggatgatgggccgcttcagcggcagcgagctgcccagcagcctgctgagcaccagccatgagaccaccgtgtacttccacagcgaccacagccagaacagacctggcttcaagctggagtaccaggcctatgagctgcaggagtgcccagaccctgagccctttgccaatggaattgtgagaggagctggctacaacgtgggccagagcgtgacctttgagtgcctgcccggctaccagctgaccggccaccctgtgctgacctgccagcacggcaccaacagaaactgggaccaccccctgcccaagtgtgaggtgccctgtggcggcaacatcaccagcagcaatggcaccgtgtacagccctggcttccccagcccctacagcagcagccaggactgtgtgtggctgatcaccgtgcccatcggccacggcgtgcggctgaacctgagcctgctgcagacagagcccagcggggacttcatcaccatctgggatggcccccagcagacagccccccggctgggcgtcttcaccaggtccatggccaagaagacagtgcagagcagcagcaaccaggtgctgctgaagttccacagagatgctgccaccggcggcatctttgccatcgccttcagcgcctaccccctgaccaagtgccccccacccaccatcctgcccaatgctgaggtggtgacagaaaatgaggagttcaacatcggggacatcgtgcgctaccgctgcctgcccggcttcaccctggtgggcaatgagatcctgacctgcaagctgggcacctacctgcagtttgagggccccccacccatctgtgaggtgcactgccccaccaatgagctgctgacagacagcactggagtcatcctgagccagagctacccaggcagctacccccagttccagacctgctcctggctggtgcgggtggagccagactacaacatcagcctgactgtggagtacttcctgtctgagaagcagtatgatgaatttgagatctttgatggccccagcggccagagccccctgctgaaggccctgagcggcaactacagcgcccccctcatcgtgaccagcagcagcaacagcgtgtacctgcgctggagcagtgaccacgcctacaacaggaagggcttcaagatccgctacagcgccccctactgcagcctgccccgggcccccctgcacggcttcatcctgggccagaccagcacccagcccggcggcagcatccacttcggctgcaatgccggctaccgcctggtgggccacagcatggccatctgcaccaggcacccccagggctaccacctgtggagcgaggccatccccctgtgccaggccctgagctgtggcctgcctgaggcccccaagaatggcatggtgtttgggaaggagtacacagtgggcaccaaggccatgtacagctgcagcgagggctaccacctgcaggccggggctgaggccacagctgagtgcctggacaccggcctgtggagcaacagaaatgtgcccccccagtgtgtgcctgtgacctgcccagatgtgagcagcatctctgtggagcacggccgctggaggctcatctttgagacccagtaccagttccaggcccagctgatgctgatctgtgaccccggctactactacacaggccagagggtcatccgctgccaggccaacgggaagtggagcctgggggacagcacccccacctgccgcatcatcagctgtggggagctgcccatcccccccaacggccaccgcatcggcaccctgtctgtgtatggagccacagccatcttcagctgcaacagcggctacaccctggtgggcagccgggtgcgggagtgcatggccaacggcctgtggagcggcagcgaggtgcgctgcctggccacccagaccaagctgcacagcatcttctacaagctgctgtttgatgtgctgagcagccccagcctgaccaaggccggccactgcggcaccccagagcccatcgtgaatggccacatcaatggagagaactacagctaccggggctctgtggtgtaccagtgcaatgccggcttccgcctcatcggcatgtctgtgcgcatctgccagcaggaccaccactggagcggcaagacccccttctgtgtgcccatcacctgtggccaccctggcaaccctgtgaatggcctgacccagggcaaccagttcaacctgaatgatgtggtgaagtttgtgtgcaaccctggctacatggccgagggcgccgcccggagccagtgcctggccagcggccagtggagcgacatgctgcccacctgccgcatcatcaactgcacagaccccggccaccaggagaacagcgtgcggcaggtgcacgccagcggcccccaccgcttctcctttggcaccaccgtgtcctaccgctgcaaccacggcttctacctgctgggcacccctgtgctgagctgccagggagatggcacctgggaccggccccggccccagtgcctgctggtgtcctgtggccaccctggcagccccccccacagccagatgtctggggacagctacacagtgggcgctgtggtgcgctacagctgcatcggcaagaggaccctggtgggcaacagcaccaggatgtgtggcctggatggccactggacaggcagcctgccccactgcagcggcacctctgtgggcgtgtgtggggaccccggcatcccagcccacggcatccggctgggggacagctttgatcctggcaccgtgatgaggttcagctgtgaggccggccacgtgctgcggggcagcagcgagaggacctgccaggccaacggctcctggagcggcagccagccagaatgtggggtcatcagctgtggcaaccctggcacccccagcaatgcccgggtggtgttcagtgatggcctggtgttcagcagcagcatcgtgtatgaatgtcgggagggctactatgccaccggcctgctgagccgccactgcagcgtgaatggcacctggacaggcagtgaccctgagtgcctggtgatcaactgtggggaccccggcatcccagccaacggcctgcggctgggcaatgacttccgctacaacaagacagtgacctaccagtgtgtgcccggctacatgatggagagccaccgggtgtctgtgctgagctgcaccaaggacaggacctggaatggcaccaagcctgtgtgcaaggccctgatgtgcaagcccccacccctcatccccaacgggaaggtggtgggcagtgacttcatgtggggcagctctgtgacctacgcctgcctggagggctaccagctgagcctgcctgctgtgttcacctgtgagggcaatggctcctggacaggagagctgccccagtgcttccctgtgttctgtggggaccccggggtgcccagccggggccggcgggaggaccggggcttctcctaccgcagctctgtgtccttcagctgccacccccccctggtgctggtgggcagcccccggcgcttctgccagagtgatggcacctggagcggcacccagcccagctgcatcgaccccaccctgaccacctgtgccgaccccggggtgccccagtttggcatccagaacaacagccagggctaccaggtgggcagcacagtgctcttccgctgccagaagggctacctgctgcagggcagcaccaccaggacctgcctgcccaacctgacctggagcggcaccccaccagactgtgtgccccaccactgccggcagcctgagacccccacccacgccaacgtgggcgccctggacctgcccagcatgggctacaccctcatctacagctgccaggagggcttcagcctgaagggcggcagcgagcacaggacctgcaaggcagatggctcctggacaggcaagccacccatctgcctggaggtgcggcccagcggccggcccatcaacacagcccgggagccccccctgacccaggccctgatccctggagatgtgtttgccaagaacagcctgtggaagggggcctatgagtaccagggcaagaagcagcctgccatgctgcgggtgacaggcttccaggtggccaacagcaaggtgaatgccaccatgattgaccacagcggcgtggagctgcacctggccggcacctacaagaaggaggacttccacctgctgctgcaggtgtaccagatcactggacctgtggagatcttcatgaacaagttcaaggatgaccactgggccctggatggccacgtgagcagcgagagcagcggggccaccttcatctaccagggctctgtgaagggccagggcttcggccagtttggcttccagaggctggacctgcggctgctggagagtgaccctgagagcatcggccgccactttgccagcaacagcagctctgtggccgccgccatcctggtgcccttcatcgccctgatcatcgccggctttgtgctgtacctgtacaagcacagaagaagacccaaggtgcccttcaacggctacgccggccacgagaacaccaacgtgcgggccacctttgagaaccccatgtatgacaggaacatccagcccacagacatcatggccagcgaggccgagttcaccgtgtccacagtgtgcacagctgtgtag

SEQ ID NO: 148714 - DNA, 1281 bp, Artificial Sequence; identical to SEQ ID NO: 148711
  Description of Artificial Sequence: Synthetic coding sequence

SEQ ID NO: 148715 - DNA, 11124 bp, Artificial Sequence
  Description of Artificial Sequence: Synthetic coding sequence
atgaagggcatcaggaagggggagagccgggccaaggagagcaagccctgggagcccgggaagaggcgctgtgccaagtgtggccgcctggacttcatcctgatgaagaagatgggcatcaagagcggcttcaccttctggaacctggtgttcctgctgactgtgtcctgtgtgaagggcttcatctacacctgtggcggcaccctgaagggcctgaatggcaccatcgagagccctggcttcccctacggctacccaaatggagccaactgcacctgggtgatcatcgccgaggagaggaaccgcatccagatcgtgttccagagctttgccctggaggaggagtatgactacctgagcctgtatgatggccacccccaccccaccaacttccgcacccggctgaccggcttccacctgcccccacctgtgaccagcaccaagtctgtgttcagcctgcggctgaccagtgactttgctgtgtctgcccacggcttcaaggtgtactatgaggagctgcagagcagcagctgtggcaaccctggggtgccccccaagggcgtgctgtatggcaccaggtttgatgtgggggacaagatccgctacagctgtgtgacaggctacatcctggatggccacccccagctgacctgcatcgccaacagcgtgaacacagcctcctgggacttccctgtgcccatctgcagagcagaagatgcctgtggcggcaccatgaggggcagcagcggcatcatcagcagccccagcttccccaatgagtaccacaacaatgctgactgcacctggaccatcgtggccgagcccggggacaccatcagcctcatcttcacagacttccagatggaggagaagtatgactacctggagattgagggcagcgagccccccaccatctggctgagcggcatgaacatccccccacccatcatcagcaacaagaactggctgcggctgcactttgtgacagacagcaaccaccgctaccggggcttcagcgccccctaccagggcagcagcaccctgacccacaccaccagcactggagagctggaggagcacaacagaaccaccactggagccatcgctgtggccagcaccccagcagatgtgacagtgtcctctgtgacagctgtgaccatccaccggctgtctgaggagcagagggtgcaggtgaccagcctgaggaacagcggcctggaccccaacaccagcaaggatggcctgagcccccaccctgctgacacccagagcaccaggagaagacccaggcatgctgagcagattgaaagaaccaaggagctggccgtggtgacccaccgggtgaagaaggccatcgacttcaagagccggggcttcaagctgtttcctgggaaggacaacagcaacaagttcagcatcctgaatgaaggaggcatcaagacagccagcaacctgtgcccagaccctggagagccagaaaatggcaagagaattggaagtgacttcagcctgggcagcacagtgcagttcagctgtgatgaggactatgtgctgcagggcgccaagagcatcacctgccagagaattgctgaggtgtttgctgcctggagcgaccacaggcctgtgtgcaaggtgaagacctgtggcagcaacctgcagggccccagcggcaccttcaccagccccaacttccccttccagtatgacagcaatgcccagtgtgtgtgggtgatcacagctgtgaacaccaacaaggtgatccagatcaactttgaggagtttgacctggagatcggctatgacaccctgaccatcggagatggaggagaggtgggggaccccaggacagtgctgcaggtgctgaccggcagctttgtgcctgacctgattgtgtccatgagcagccagatgtggctgcacctgcagacagatgagagcgtgggctctgtgggcttcaaggtgaactacaaggagattgagaaggagagctgtggggaccccggcacccccctgtatggcatccgggagggagatggcttcagcaacagagatgtgctgcgctttgagtgccagtttggatttgagctgattggagagaagagcatcgtgtgccaggagaacaaccagtggagcgccaacatccccatctgcatcttcccctgcctgagcaacttcaccgcccccatgggcaccgtgctgagcccagactacccagagggctacggcaacaacctgaactgcatctggaccatcatcagtgaccccggcagccgcatccacctgtccttcaatgactttgacctggagagccagtttgacttcctggccgtgaaggatggagacagccctgagagccccatcctgggcaccttcaccggggctgaggtgcccagccacctgaccagcaacagccacatcctgcggctggagttccaggccgaccacagcatgagcggccggggcttcaacatcacctacaacaccttcggccacaatgaatgtcctgaccccggcatccccatcaatgccaggagatttggagacaacttccagctgggcagcagcatcagcgtcatctgtgaggagggcttcatcaagacccagggcacagagaccatcacctgcatcctgatggatggcaaggtgatgtggagcggcctcatccccaagtgtggggccccctgtggcggccacttcagcgcccccagcggggtcatcctgagccctggctggccaggctactacaaggacagcctgaactgtgagtgggtgattgaagctgagcccggccacagcatcaagatcacctttgagcgcttccagacagagctgaactatgatgtgctggaggtgcatgatggccccaacctgctgagccccctgctgggcagctacaacggcacccaggtgccccagttcctgttcagcagcagcaacttcatctacctgctcttcaccacagacaacagccgcagcaacaacggcttcaagatccactatgagagcgtgacagtgaacacctacagctgcctggaccccggcatccctgtgcacggccgccgctatggccatgacttcagcatcggcagcacagtgtccttcagctgtgacagcggctaccgcctgagccatgaggagcccctgctgtgtgagaagaaccactggtggagccaccccctgcccacctgtgatgccctgtgtggaggagatgtgcggggccccagcggcaccatcctgagccctggctacccagagttctaccccaacagcctgaactgcacctggacagtggatgtgacccatggaaaaggagtgcagttcaacttccacaccttccacctggaggaccaccacgactacctgctgatcacagaaaatggcagcttcacccagcccctggcccggctgactggaagtgacctgccccccaccatcaatgccggcctgtatggcaacttccgggcccagctgcgcttcatcagtgacttcagcatctcctatgagggcttcaacatcaccttcagcgagtacaacctggagccctgtgaagatcctggcatcccccagtatggcagccgcatcggcttcaactttggcatcggggacaccctgaccttcagctgcagcagcggctaccgcctggagggcaccagcgagatcatctgcctgggcggcggcagaagagtgtggagcgcccccctgccccgctgtgtggccgagtgtggggccagcgccaccaacaatgaaggcatcctgctgagccccaactaccccctgaactatgagaacaaccacgagtgcatctacagcatccaggtgcaggccggcaagggcatcaacatcagcgcccggaccttccacctggcccagggagatgtgctgaagatctatgatggcaaggacaagaccacccacctgctgggcgccttcaccggggcctccatgaggggcctgaccctgagcagcaccagcaaccagctgtggctggagttcaacagcgacacagagggcacagatgagggcttccagctggtgtacaccagctttgagctgagccactgtgaagatcctggcatcccccagtttggctacaagatcagtgaccagggccactttgctggcagcaccatcatctacggctgcaaccctggctacaccctgcacggcagcagcctgctgaagtgcatgactggagagcggcgggcctgggactaccccctgcccagctgcatcgcagaatgtggcggccgcttcaagggggagagcagcggccgcatcctgagccctggctaccccttcccctatgacaacaacctgcgctgcatgtggatgattgaggtggaccccggcaacatcgtgtccctgcagttcctggcctttgacacagaggccagccatgacatcctgcgggtgtgggatggccccccagaaaatgacatgctgctgaaggagatcagcggcagcctcatccctgagggcatccacagcaccctgaacatcgtgaccatccagtttgacacagacttctacatcagcaagagcggctttgccatccagttcagcagctctgtggccacagcctgccgggaccccggggtgcccatgaatggcaccagaaatggagatggccgggagcccggggacacagtggtgttccagtgtgaccccggctatgagctgcagggcgaggagcgcatcacctgcatccaggtggagaaccgctacttctggcagcccagcccccctgtgtgcatcgccccctgtggcggcaacctgaccggcagcagcggcttcatcctgagccccaacttcccccacccctacccccacagccgggactgtgactggaccatcaccgtgaatgctgactatgtgatcagcctggccttcatctccttcagcattgagcccaactatgacttcctgtacatctatgatggccctgacagcaacagccccctgattggcagcttccaggacagcaagctgcctgagagaattgagagcagcagcaacaccatgcacctggccttcagaagtgatggctctgtgtcctacacaggcttccacctggagtacaaggccaagctgcgggagagctgctttgaccccggcaacatcatgaatggcacccggctgggcatggactacaagctgggcagcacagtgacctactactgtgatgctggctacgtgctgcagggctacagcaccctgacctgcatcatgggagatgatggccggcccggctggaacagagccctgcccagctgccacgccccctgtggcagccgcagcactggaagtgagggcaccgtgctgagccccaactaccccaagaactacagcgtgggccacaactgtgtgtacagcattgctgtgcccaaggagtttgtggtgtttggccagtttgtgttcttccagaccagcctgcatgatgtggtggaggtgtatgatggccccacccagcagagcagcctgctgagcagcctgagcggcagccacagcggggagagcctgcccctgagcagcggcaaccagatcaccatccgcttcacctctgtgggccccatcacagccaagggcttccactttgtgtaccaggccgtgcccaggaccagcagcacccagtgcagctctgtgcctgagccccgcttcggcagaagaattggaaatgaatttgctgtgggcagctctgtgctgtttgactgcaaccctggctacatcctgcacggcagcatcgccatccgctgtgagaccgtgcccaacagcctggcccagtggaatgacagcctgcccacctgcatcgtgccctgtggcggcatcctgaccaagaggaagggcaccatcctgagccctggctacccagagccctatgacaacaacctgaactgtgtgtggaagatcaccgtgcctgagggcgccggcatccaggtgcaggtggtgtcctttgccacagagcacaactgggacagcctggacttctatgatggaggagacaacaatgccccccggctgggcagctacagcggcaccaccatcccccacctgctgaacagcaccagcaacaacctgtacctgaacttccagagcgacatctctgtgtctgctgctggcttccacctggagtacacagccatcggcctggacagctgcccagagccccagacccccagcagcggcatcaagatcggggaccgctacatggtgggagatgtggtgtccttccagtgtgaccagggctacagcctgcagggccacagccacatcacctgcatgcctggccctgtgcggcgctggaactaccccatccccatctgcctggcccagtgtggcggggccatgtctgacttctctggagtcatcctgagccctggcttccctggcaactaccccagcagcctggactgcacctggaccatcaacctgcccatcggctttggagtgcacctgcagtttgtgaacttcagcacagagaccatccatgactacctggaggtgcgcagcggcagcagcgagaccagcaccgtcatcggccgcctgagcggcccccagatccccagcagcctcttcagcaccacccatgagaccagcctgtacttccacagcgactacagccagaacaagcagggcttccacatcgtgtaccaggcctaccagctgcagagctgcccagacccccggcccttcagaaatggatttgtgattggaaatgacttcaccgtgggccagaccatcagctttgagtgcttccctggctacaccctgattggcaacagcgccctgacctgcctgcacggcgtgtccaggaactggaaccaccccctgccccgctgtgaggccctgtgtggcggcaacatcacagccatgaatggcaccatctacagccctggctacccagatgagtaccccaacttccaggactgcttctggctggtgcgggtgcccccaggaaatggcatctacatcaacttcaccgtgctgcagacagagcccatctatgacttcatcaccgtgtgggatggccctgaccagaacagcccccagatcggccagttcagcggcaacacagccctggagagcgtgtacagcaccagcaaccagatcctgatcaagttccacagcgacttcaccaccagcggcttctttgtgctgagctaccacgcctaccagctgcgggtgtgccagcccccacctcctgtgcccaatgctgagatcctgacagaagatgatgaatttgaaattggagacatcatccgctaccagtgcctgcccggcttcaccctggtgggcaatgccatcctgacctgccgcctgggggagcggctgcagatggatggagcccctcctgtgtgccaggtgctgtgcccagccaatgagctgcggctggacagcactggagtcatcctgagccctggctacccagacagctaccccaacctgcagatgtgtgcctggagcatctctgtggagaagggctacaacatcaccatgtttgtggagttcttccagacagagaaggagtttgatgtgctgcaggtgtatgatggccccaacatccagagccctgtgctgatcagcctgagcggggactacagcagcgccttcaacatcaccagcaatggacatgaggtgttcctgcagtggagcgctgaccacggcaacaacaagaagggcttccgcatccgctacatcgccttctactgcagcaccccagagagcccccctcatggctacatcatcagccagacaggaggccagctgaacagcgtggtgcgctgggcctgtgaccggggcttccggctggtgggcaagagcagcgctgtgtgcaggaagagcagctatggctaccacgcctgggatgcccctgtgcctgcctgccaggccatcagctgtggcatccccaaggcccccaccaacggcggcatcctgaccacagactacctggtgggcaccagggtgacctacttctgcaatgatggctaccgcctgagcagcaaggagctgaccacagctgtgtgccagagtgatggcacctggagcaaccacaacaagaccccccgctgtgtggtggtgacctgccccagcatcaacagcttcatcctggagcacggccgctggagaattgtgaatggcagccactatgagtacaagaccaaggtggtgttcagctgtgaccccggctaccacggcctgggccctgccagcattgagtgcctgcccaacggcacctggagctggagaaatgaaagaccctactgccagatcatcagctgtggggagctgcccaccccaccaaatggaaacaagattggcacccagaccagctatggcagcacagccatcttcacctgtgacctgggcttcatgctggtgggcagcgctgtgcgggagtgcctgagcagcggcctgtggagcgagagcgagacccgctgcctggccggccactgcggcatccctgagctgattgtgaatggccaggtgattggagaaaattatggctacagagacacagtggtgtaccagtgcaaccctggcttccgcctcatcggcagctctgtgcgcatctgccagcaggaccacaactggagcggccagctgcccagctgtgtgcctgtgtcctgtggccaccctggcagccccatctacggccgcaccagcggaaatggcttcaacttcaatgatgtggtgaccttcagctgcaacatcggctacctgatgcagggccccaccaaggcccagtgccaggccaaccggcagtggagccaccccccacccatgtgcaaggtggtgaactgcagcgaccccggcatcccagccaacagcaagcgggagagcaagattgagcacggcaacttcacctatggaacagtggtgttctatgactgcaaccctggctacttcctgtttggcagctctgtgctgatctgccagcccaacggccagtgggacaagcccctgcctgagtgcatcatgattgactgtggccaccctggggtgcccccaaatgctgtgctgtctggagagaagtacaccttcggcagcacagtgcactacagctgcaccgggaagaggagcctgctgggccagagcagcaggacctgccagctgaatggccactggagcggcagccagccccactgcagcggagatgccaccggcacctgtggggaccccggcaccccaggccacggcagccggcaggagagcaacttccgcaccaagagcacagtgcgctatgcctgtgacaccggctacatcctgcacggcagcgaggagaggacctgcctggccaacggctcctggacaggccggcagcctgagtgcaaggctgtgcagtgtggcaaccctggcaccacagccaacgggaaggtgttcagaattgatggcaccaccttcagcagcagcgtcatctacagctgcatggagggctacatcctgagcggccccagcgtgcggcagtgcacagccaacggcacctggagcggcaccctgcccaactgcaccatcatcagctgtggggaccccggcatcccagccaacggcctgcgctatggagatgattatgtggtgggccagaatgtgtcctacatgtgccagcccggctacaccatggagctgaatggcagccgcatccgcacctgcaccatcaatggcacctggagcggcgtgatgcccacctgcagagctgtgacctgccccaccccaccccagatcagcaatggccgcctggagggcaccaactttgactggggcttcagcatctcctacatctgcagccctggctatgagctgtccttccctgctgtgctgacctgtgtgggcaatggcacctggagcggggaggtgccccagtgcctgcccaagttctgtggggaccccggcatcccagcccagggcaagcgggagggcaagagcttcatctaccagagcgaggtgtccttcagctgcaacttccccttcatcctggtgggcagcagcacccgcatctgccaggctgatggcacctggagcggcagcagcccccactgcatcgagcccacccagaccagctgtgaaaatcctggggtgcccaggcatggcagccagaacaacaccttcggcttccaggtgggctctgtggtgcagttccactgcaagaagggccacctgctgcagggcagcaccaccaggacctgcctgcctgacctgacctggagcggcatccagcctgagtgcatcccccacagctgcaagcagcctgagaccccagcccacgccaacgtggtgggcatggacctgcccagccacggctacaccctcatctacacctgccagcccggcttcttcctggccggcggcacagagcaccgggtgtgccgcagtgacaacacctggacaggcaaggtgcccatctgtgaggccggcagcaagatcctggtgaaggaccccaggcctgccctgggcacccccagccccaagctgtctgtgcctgatgatgtgtttgcccagaactacatctggaagggcagctacaacttcaagggcaggaagcagcccatgaccctgactgtgaccagcttcaatgccagcacaggccgggtgaatgccaccctgagcaacagcaacatggagctgctgctgagcggcgtgtacaagagccaggaggcccggctgatgctgcgcatctacctgatcaaggtgcctgcccacgcctctgtgaagaagatgaaggaggagaactgggccatggatggctttgtgtctgctgagccagatggagccacctacgtgttccagggcttcatccagggcaaggactatggccagtttggcctgcagaggctgggcctgaacatgtctgagggcagcaacagcagcaaccagccccacggcaccaacagcagctctgtggccatcgccatcctggtgcccttctttgccctgatctttgctggcttcggcttctacctgtacaagcagaggacagcccccaagacccagtacacaggctgcagcgtgcatgagaacaacaacggccaggccgcctttgagaaccccatgtatgacaccaatgccaagtctgtggagggcaaggctgtgcgctttgaccccaacctgaacacagtgtgcaccatggtgtag

SEQ ID NO: 148716 - DNA, 11004 bp, Artificial Sequence
  Description of Artificial Sequence: Synthetic coding sequence
atgtggagctggttcctgtgctggaagcctgtgcagctggaccggcagacagccagcggcttcatctacacctgtggcggcaccctgaagggcctgaatggcaccatcgagagccctggcttcccctacggctacccaaatggagccaactgcacctgggtgatcatcgccgaggagaggaaccgcatccagatcgtgttccagagctttgccctggaggaggagtatgactacctgagcctgtatgatggccacccccaccccaccaacttccgcacccggctgaccggcttccacctgcccccacctgtgaccagcaccaagtctgtgttcagcctgcggctgaccagtgactttgctgtgtctgcccacggcttcaaggtgtactatgaggagctgcagagcagcagctgtggcaaccctggggtgccccccaagggcgtgctgtatggcaccaggtttgatgtgggggacaagatccgctacagctgtgtgacaggctacatcctggatggccacccccagctgacctgcatcgccaacagcgtgaacacagcctcctgggacttccctgtgcccatctgcagagcagaagatgcctgtggcggcaccatgaggggcagcagcggcatcatcagcagccccagcttccccaatgagtaccacaacaatgctgactgcacctggaccatcgtggccgagcccggggacaccatcagcctcatcttcacagacttccagatggaggagaagtatgactacctggagattgagggcagcgagccccccaccatctggctgagcggcatgaacatccccccacccatcatcagcaacaagaactggctgcggctgcactttgtgacagacagcaaccaccgctaccggggcttcagcgccccctaccagggcagcagcaccctgacccacaccaccagcactggagagctggaggagcacaacagaaccaccactggagccatcgctgtggccagcaccccagcagatgtgacagtgtcctctgtgacagctgtgaccatccaccggctgtctgaggagcagagggtgcaggtgaccagcctgaggaacagcggcctggaccccaacaccagcaaggatggcctgagcccccaccctgctgacacccagagcaccaggagaagacccaggcatgctgagcagattgaaagaaccaaggagctggccgtggtgacccaccgggtgaagaaggccatcgacttcaagagccggggcttcaagctgtttcctgggaaggacaacagcaacaagttcagcatcctgaatgaaggaggcatcaagacagccagcaacctgtgcccagaccctggagagccagaaaatggcaagagaattggaagtgacttcagcctgggcagcacagtgcagttcagctgtgatgaggactatgtgctgcagggcgccaagagcatcacctgccagagaattgctgaggtgtttgctgcctggagcgaccacaggcctgtgtgcaaggtgaagacctgtggcagcaacctgcagggccccagcggcaccttcaccagccccaacttccccttccagtatgacagcaatgcccagtgtgtgtgggtgatcacagctgtgaacaccaacaaggtgatccagatcaactttgaggagtttgacctggagatcggctatgacaccctgaccatcggagatggaggagaggtgggggaccccaggacagtgctgcaggtgctgaccggcagctttgtgcctgacctgattgtgtccatgagcagccagatgtggctgcacctgcagacagatgagagcgtgggctctgtgggcttcaaggtgaactacaaggagattgagaaggagagctgtggggaccccggcacccccctgtatggcatccgggagggagatggcttcagcaacagagatgtgctgcgctttgagtgccagtttggatttgagctgattggagagaagagcatcgtgtgccaggagaacaaccagtggagcgccaacatccccatctgcatcttcccctgcctgagcaacttcaccgcccccatgggcaccgtgctgagcccagactacccagagggctacggcaacaacctgaactgcatctggaccatcatcagtgaccccggcagccgcatccacctgtccttcaatgactttgacctggagagccagtttgacttcctggccgtgaaggatggagacagccctgagagccccatcctgggcaccttcaccggggctgaggtgcccagccacctgaccagcaacagccacatcctgcggctggagttccaggccgaccacagcatgagcggccggggcttcaacatcacctacaacaccttcggccacaatgaatgtcctgaccccggcatccccatcaatgccaggagatttggagacaacttccagctgggcagcagcatcagcgtcatctgtgaggagggcttcatcaagacccagggcacagagaccatcacctgcatcctgatggatggcaaggtgatgtggagcggcctcatccccaagtgtggggccccctgtggcggccacttcagcgcccccagcggggtcatcctgagccctggctggccaggctactacaaggacagcctgaactgtgagtgggtgattgaagctgagcccggccacagcatcaagatcacctttgagcgcttccagacagagctgaactatgatgtgctggaggtgcatgatggccccaacctgctgagccccctgctgggcagctacaacggcacccaggtgccccagttcctgttcagcagcagcaacttcatctacctgctcttcaccacagacaacagccgcagcaacaacggcttcaagatccactatgagagcgtgacagtgaacacctacagctgcctggaccccggcatccctgtgcacggccgccgctatggccatgacttcagcatcggcagcacagtgtccttcagctgtgacagcggctaccgcctgagccatgaggagcccctgctgtgtgagaagaaccactggtggagccaccccctgcccacctgtgatgccctgtgtggaggagatgtgcggggccccagcggcaccatcctgagccctggctacccagagttctaccccaacagcctgaactgcacctggacagtggatgtgacccatggaaaaggagtgcagttcaacttccacaccttccacctggaggaccaccacgactacctgctgatcacagaaaatggcagcttcacccagcccctggcccggctgactggaagtgacctgccccccaccatcaatgccggcctgtatggcaacttccgggcccagctgcgcttcatcagtgacttcagcatctcctatgagggcttcaacatcaccttcagcgagtacaacctggagccctgtgaagatcctggcatcccccagtatggcagccgcatcggcttcaactttggcatcggggacaccctgaccttcagctgcagcagcggctaccgcctggagggcaccagcgagatcatctgcctgggcggcggcagaagagtgtggagcgcccccctgccccgctgtgtggccgagtgtggggccagcgccaccaacaatgaaggcatcctgctgagccccaactaccccctgaactatgagaacaaccacgagtgcatctacagcatccaggtgcaggccggcaagggcatcaacatcagcgcccggaccttccacctggcccagggagatgtgctgaagatctatgatggcaaggacaagaccacccacctgctgggcgccttcaccggggcctccatgaggggcctgaccctgagcagcaccagcaaccagctgtggctggagttcaacagcgacacagagggcacagatgagggcttccagctggtgtacaccagctttgagctgagccactgtgaagatcctggcatcccccagtttggctacaagatcagtgaccagggccactttgctggcagcaccatcatctacggctgcaaccctggctacaccctgcacggcagcagcctgctgaagtgcatgactggagagcggcgggcctgggactaccccctgcccagctgcatcgcagaatgtggcggccgcttcaagggggagagcagcggccgcatcctgagccctggctaccccttcccctatgacaacaacctgcgctgcatgtggatgattgaggtggaccccggcaacatcgtgtccctgcagttcctggcctttgacacagaggccagccatgacatcctgcgggtgtgggatggccccccagaaaatgacatgctgctgaaggagatcagcggcagcctcatccctgagggcatccacagcaccctgaacatcgtgaccatccagtttgacacagacttctacatcagcaagagcggctttgccatccagttcagcagctctgtggccacagcctgccgggaccccggggtgcccatgaatggcaccagaaatggagatggccgggagcccggggacacagtggtgttccagtgtgaccccggctatgagctgcagggcgaggagcgcatcacctgcatccaggtggagaaccgctacttctggcagcccagcccccctgtgtgcatcgccccctgtggcggcaacctgaccggcagcagcggcttcatcctgagccccaacttcccccacccctacccccacagccgggactgtgactggaccatcaccgtgaatgctgactatgtgatcagcctggccttcatctccttcagcattgagcccaactatgacttcctgtacatctatgatggccctgacagcaacagccccctgattggcagcttccaggacagcaagctgcctgagagaattgagagcagcagcaacaccatgcacctggccttcagaagtgatggctctgtgtcctacacaggcttccacctggagtacaaggccaagctgcgggagagctgctttgaccccggcaacatcatgaatggcacccggctgggcatggactacaagctgggcagcacagtgacctactactgtgatgctggctacgtgctgcagggctacagcaccctgacctgcatcatgggagatgatggccggcccggctggaacagagccctgcccagctgccacgccccctgtggcagccgcagcactggaagtgagggcaccgtgctgagccccaactaccccaagaactacagcgtgggccacaactgtgtgtacagcattgctgtgcccaaggagtttgtggtgtttggccagtttgtgttcttccagaccagcctgcatgatgtggtggaggtgtatgatggccccacccagcagagcagcctgctgagcagcctgagcggcagccacagcggggagagcctgcccctgagcagcggcaaccagatcaccatccgcttcacctctgtgggccccatcacagccaagggcttccactttgtgtaccaggccgtgcccaggaccagcagcacccagtgcagctctgtgcctgagccccgcttcggcagaagaattggaaatgaatttgctgtgggcagctctgtgctgtttgactgcaaccctggctacatcctgcacggcagcatcgccatccgctgtgagaccgtgcccaacagcctggcccagtggaatgacagcctgcccacctgcatcgtgccctgtggcggcatcctgaccaagaggaagggcaccatcctgagccctggctacccagagccctatgacaacaacctgaactgtgtgtggaagatcaccgtgcctgagggcgccggcatccaggtgcaggtggtgtcctttgccacagagcacaactgggacagcctggacttctatgatggaggagacaacaatgccccccggctgggcagctacagcggcaccaccatcccccacctgctgaacagcaccagcaacaacctgtacctgaacttccagagcgacatctctgtgtctgctgctggcttccacctggagtacacagccatcggcctggacagctgcccagagccccagacccccagcagcggcatcaagatcggggaccgctacatggtgggagatgtggtgtccttccagtgtgaccagggctacagcctgcagggccacagccacatcacctgcatgcctggccctgtgcggcgctggaactaccccatccccatctgcctggcccagtgtggcggggccatgtctgacttctctggagtcatcctgagccctggcttccctggcaactaccccagcagcctggactgcacctggaccatcaacctgcccatcggctttggagtgcacctgcagtttgtgaacttcagcacagagaccatccatgactacctggaggtgcgcagcggcagcagcgagaccagcaccgtcatcggccgcctgagcggcccccagatccccagcagcctcttcagcaccacccatgagaccagcctgtacttccacagcgactacagccagaacaagcagggcttccacatcgtgtaccaggcctaccagctgcagagctgcccagacccccggcccttcagaaatggatttgtgattggaaatgacttcaccgtgggccagaccatcagctttgagtgcttccctggctacaccctgattggcaacagcgccctgacctgcctgcacggcgtgtccaggaactggaaccaccccctgccccgctgtgaggccctgtgtggcggcaacatcacagccatgaatggcaccatctacagccctggctacccagatgagtaccccaacttccaggactgcttctggctggtgcgggtgcccccaggaaatggcatctacatcaacttcaccgtgctgcagacagagcccatctatgacttcatcaccgtgtgggatggccctgaccagaacagcccccagatcggccagttcagcggcaacacagccctggagagcgtgtacagcaccagcaaccagatcctgatcaagttccacagcgacttcaccaccagcggcttctttgtgctgagctaccacgcctaccagctgcgggtgtgccagcccccacctcctgtgcccaatgctgagatcctgacagaagatgatgaatttgaaattggagacatcatccgctaccagtgcctgcccggcttcaccctggtgggcaatgccatcctgacctgccgcctgggggagcggctgcagatggatggagcccctcctgtgtgccaggtgctgtgcccagccaatgagctgcggctggacagcactggagtcatcctgagccctggctacccagacagctaccccaacctgcagatgtgtgcctggagcatctctgtggagaagggctacaacatcaccatgtttgtggagttcttccagacagagaaggagtttgatgtgctgcaggtgtatgatggccccaacatccagagccctgtgctgatcagcctgagcggggactacagcagcgccttcaacatcaccagcaatggacatgaggtgttcctgcagtggagcgctgaccacggcaacaacaagaagggcttccgcatccgctacatcgccttctactgcagcaccccagagagcccccctcatggctacatcatcagccagacaggaggccagctgaacagcgtggtgcgctgggcctgtgaccggggcttccggctggtgggcaagagcagcgctgtgtgcaggaagagcagctatggctaccacgcctgggatgcccctgtgcctgcctgccaggccatcagctgtggcatccccaaggcccccaccaacggcggcatcctgaccacagactacctggtgggcaccagggtgacctacttctgcaatgatggctaccgcctgagcagcaaggagctgaccacagctgtgtgccagagtgatggcacctggagcaaccacaacaagaccccccgctgtgtggtggtgacctgccccagcatcaacagcttcatcctggagcacggccgctggagaattgtgaatggcagccactatgagtacaagaccaaggtggtgttcagctgtgaccccggctaccacggcctgggccctgccagcattgagtgcctgcccaacggcacctggagctggagaaatgaaagaccctactgccagatcatcagctgtggggagctgcccaccccaccaaatggaaacaagattggcacccagaccagctatggcagcacagccatcttcacctgtgacctgggcttcatgctggtgggcagcgctgtgcgggagtgcctgagcagcggcctgtggagcgagagcgagacccgctgcctggccggccactgcggcatccctgagctgattgtgaatggccaggtgattggagaaaattatggctacagagacacagtggtgtaccagtgcaaccctggcttccgcctcatcggcagctctgtgcgcatctgccagcaggaccacaactggagcggccagctgcccagctgtgtgcctgtgtcctgtggccaccctggcagccccatctacggccgcaccagcggaaatggcttcaacttcaatgatgtggtgaccttcagctgcaacatcggctacctgatgcagggccccaccaaggcccagtgccaggccaaccggcagtggagccaccccccacccatgtgcaaggtggtgaactgcagcgaccccggcatcccagccaacagcaagcgggagagcaagattgagcacggcaacttcacctatggaacagtggtgttctatgactgcaaccctggctacttcctgtttggcagctctgtgctgatctgccagcccaacggccagtgggacaagcccctgcctgagtgcatcatgattgactgtggccaccctggggtgcccccaaatgctgtgctgtctggagagaagtacaccttcggcagcacagtgcactacagctgcaccgggaagaggagcctgctgggccagagcagcaggacctgccagctgaatggccactggagcggcagccagccccactgcagcggagatgccaccggcacctgtggggaccccggcaccccaggccacggcagccggcaggagagcaacttccgcaccaagagcacagtgcgctatgcctgtgacaccggctacatcctgcacggcagcgaggagaggacctgcctggccaacggctcctggacaggccggcagcctgagtgcaaggctgtgcagtgtggcaaccctggcaccacagccaacgggaaggtgttcagaattgatggcaccaccttcagcagcagcgtcatctacagctgcatggagggctacatcctgagcggccccagcgtgcggcagtgcacagccaacggcacctggagcggcaccctgcccaactgcaccatcatcagctgtggggaccccggcatcccagccaacggcctgcgctatggagatgattatgtggtgggccagaatgtgtcctacatgtgccagcccggctacaccatggagctgaatggcagccgcatccgcacctgcaccatcaatggcacctggagcggcgtgatgcccacctgcagagctgtgacctgccccaccccaccccagatcagcaatggccgcctggagggcaccaactttgactggggcttcagcatctcctacatctgcagccctggctatgagctgtccttccctgctgtgctgacctgtgtgggcaatggcacctggagcggggaggtgccccagtgcctgcccaagttctgtggggaccccggcatcccagcccagggcaagcgggagggcaagagcttcatctaccagagcgaggtgtccttcagctgcaacttccccttcatcctggtgggcagcagcacccgcatctgccaggctgatggcacctggagcggcagcagcccccactgcatcgagcccacccagaccagctgtgaaaatcctggggtgcccaggcatggcagccagaacaacaccttcggcttccaggtgggctctgtggtgcagttccactgcaagaagggccacctgctgcagggcagcaccaccaggacctgcctgcctgacctgacctggagcggcatccagcctgagtgcatcccccacagctgcaagcagcctgagaccccagcccacgccaacgtggtgggcatggacctgcccagccacggctacaccctcatctacacctgccagcccggcttcttcctggccggcggcacagagcaccgggtgtgccgcagtgacaacacctggacaggcaaggtgcccatctgtgaggccggcagcaagatcctggtgaaggaccccaggcctgccctgggcacccccagccccaagctgtctgtgcctgatgatgtgtttgcccagaactacatctggaagggcagctacaacttcaagggcaggaagcagcccatgaccctgactgtgaccagcttcaatgccagcacaggccgggtgaatgccaccctgagcaacagcaacatggagctgctgctgagcggcgtgtacaagagccaggaggcccggctgatgctgcgcatctacctgatcaaggtgcctgcccacgcctctgtgaagaagatgaaggaggagaactgggccatggatggctttgtgtctgctgagccagatggagccacctacgtgttccagggcttcatccagggcaaggactatggccagtttggcctgcagaggctgggcctgaacatgtctgagggcagcaacagcagcaaccagccccacggcaccaacagcagctctgtggccatcgccatcctggtgcccttctttgccctgatctttgctggcttcggcttctacctgtacaagcagaggacagcccccaagacccagtacacaggctgcagcgtgcatgagaacaacaacggccaggccgcctttgagaaccccatgtatgacaccaatgccaagtctgtggagggcaaggctgtgcgctttgaccccaacctgaacacagtgtgcaccatggtgtag

SEQ ID NO: 148717 - DNA, 10914 bp, Artificial Sequence
  Description of Artificial Sequence: Synthetic coding sequence
atgaagggcatcaggaagggggagagccgggccaaggagagcaagccctgggagcccgggaagaggcgctgtgccaagtgtggccgcctggacttcatcctgatgaagaagatgggcatcaagagcggcttcaccttctggaacctggtgttcctgctgactgtgtcctgtgtgaagggcttcatctacacctgtggcggcaccctgaagggcctgaatggcaccatcgagagccctggcttcccctacggctacccaaatggagccaactgcacctgggtgatcatcgccgaggagaggaaccgcatccagatcgtgttccagagctttgccctggaggaggagtatgactacctgagcctgtatgatggccacccccaccccaccaacttccgcacccggctgaccggcttccacctgcccccacctgtgaccagcaccaagtctgtgttcagcctgcggctgaccagtgactttgctgtgtctgcccacggcttcaaggtgtactatgaggagctgcagagcagcagctgtggcaaccctggggtgccccccaagggcgtgctgtatggcaccaggtttgatgtgggggacaagatccgctacagctgtgtgacaggctacatcctggatggccacccccagctgacctgcatcgccaacagcgtgaacacagcctcctgggacttccctgtgcccatctgcagagcagaagatgcctgtggcggcaccatgaggggcagcagcggcatcatcagcagccccagcttccccaatgagtaccacaacaatgctgactgcacctggaccatcgtggccgagcccggggacaccatcagcctcatcttcacagacttccagatggaggagaagtatgactacctggagattgagggcagcgagccccccaccatctggctgagcggcatgaacatccccccacccatcatcagcaacaagaactggctgcggctgcactttgtgacagacagcaaccaccgctaccggggcttcagcgccccctaccagggcagcagcaccctgacccacaccaccagcactggagagctggaggagcacaacagaaccaccactggagccatcgctgtggccagcaccccagcagatgtgacagtgtcctctgtgacagctgtgaccatccaccggctgtctgaggagcagagggtgcaggtgaccagcctgaggaacagcggcctggaccccaacaccagcaaggatggcctgagcccccaccctgctgacacccagagcaccaggagaagacccaggcatgctgagcagattgaaagaaccaaggagctggccgtggtgacccaccgggtgaagaaggccatcgacttcaagagccggggcttcaagctgtttcctgggaaggacaacagcaacaagttcagcatcctgaatgaaggaggcatcaagacagccagcaacctgtgcccagaccctggagagccagaaaatggcaagagaattggaagtgacttcagcctgggcagcacagtgcagttcagctgtgatgaggactatgtgctgcagggcgccaagagcatcacctgccagagaattgctgaggtgtttgctgcctggagcgaccacaggcctgtgtgcaaggtgaagacctgtggcagcaacctgcagggccccagcggcaccttcaccagccccaacttccccttccagtatgacagcaatgcccagtgtgtgtgggtgatcacagctgtgaacaccaacaaggtgatccagatcaactttgaggagtttgacctggagatcggctatgacaccctgaccatcggagatggaggagaggtgggggaccccaggacagtgctgcaggtgctgaccggcagctttgtgcctgacctgattgtgtccatgagcagccagatgtggctgcacctgcagacagatgagagcgtgggctctgtgggcttcaaggtgaactacaaggagattgagaaggagagctgtggggaccccggcacccccctgtatggcatccgggagggagatggcttcagcaacagagatgtgctgcgctttgagtgccagtttggatttgagctgattggagagaagagcatcgtgtgccaggagaacaaccagtggagcgccaacatccccatctgcatcttcccctgcctgagcaacttcaccgcccccatgggcaccgtgctgagcccagactacccagagggctacggcaacaacctgaactgcatctggaccatcatcagtgaccccggcagccgcatccacctgtccttcaatgactttgacctggagagccagtttgacttcctggccgtgaaggatggagacagccctgagagccccatcctgggcaccttcaccggggctgaggtgcccagccacctgaccagcaacagccacatcctgcggctggagttccaggccgaccacagcatgagcggccggggcttcaacatcacctacaacaccttcggccacaatgaatgtcctgaccccggcatccccatcaatgccaggagatttggagacaacttccagctgggcagcagcatcagcgtcatctgtgaggagggcttcatcaagacccagggcacagagaccatcacctgcatcctgatggatggcaaggtgatgtggagcggcctcatccccaagtgtggggccccctgtggcggccacttcagcgcccccagcggggtcatcctgagccctggctggccaggctactacaaggacagcctgaactgtgagtgggtgattgaagctgagcccggccacagcatcaagatcacctttgagcgcttccagacagagctgaactatgatgtgctggaggtgcatgatggccccaacctgctgagccccctgctgggcagctacaacggcacccaggtgccccagttcctgttcagcagcagcaacttcatctacctgctcttcaccacagacaacagccgcagcaacaacggcttcaagatccactatgagagcgtgacagtgaacacctacagctgcctggaccccggcatccctgtgcacggccgccgctatggccatgacttcagcatcggcagcacagtgtccttcagctgtgacagcggctaccgcctgagccatgaggagcccctgctgtgtgagaagaaccactggtggagccaccccctgcccacctgtgatgccctgtgtggaggagatgtgcggggccccagcggcaccatcctgagccctggctacccagagttctaccccaacagcctgaactgcacctggacagtggatgtgacccatggaaaaggagtgcagttcaacttccacaccttccacctggaggaccaccacgactacctgctgatcacagaaaatggcagcttcacccagcccctggcccggctgactggaagtgacctgccccccaccatcaatgccggcctgtatggcaacttccgggcccagctgcgcttcatcagtgacttcagcatctcctatgagggcttcaacatcaccttcagcgagtacaacctggagccctgtgaagatcctggcatcccccagtatggcagccgcatcggcttcaactttggcatcggggacaccctgaccttcagctgcagcagcggctaccgcctggagggcaccagcgagatcatctgcctgggcggcggcagaagagtgtggagcgcccccctgccccgctgtgtggccgagtgtggggccagcgccaccaacaatgaaggcatcctgctgagccccaactaccccctgaactatgagaacaaccacgagtgcatctacagcatccaggtgcaggccggcaagggcatcaacatcagcgcccggaccttccacctggcccagggagatgtgctgaagatctatgatggcaaggacaagaccacccacctgctgggcgccttcaccggggcctccatgaggggcctgaccctgagcagcaccagcaaccagctgtggctggagttcaacagcgacacagagggcacagatgagggcttccagctggtgtacaccagctttgagctgagccactgtgaagatcctggcatcccccagtttggctacaagatcagtgaccagggccactttgctggcagcaccatcatctacggctgcaaccctggctacaccctgcacggcagcagcctgctgaagtgcatgactggagagcggcgggcctgggactaccccctgcccagctgcatcgcagaatgtggcggccgcttcaagggggagagcagcggccgcatcctgagccctggctaccccttcccctatgacaacaacctgcgctgcatgtggatgattgaggtggaccccggcaacatcgtgtccctgcagttcctggcctttgacacagaggccagccatgacatcctgcgggtgtgggatggccccccagaaaatgacatgctgctgaaggagatcagcggcagcctcatccctgagggcatccacagcaccctgaacatcgtgaccatccagtttgacacagacttctacatcagcaagagcggctttgccatccagttcagcagctctgtggccacagcctgccgggaccccggggtgcccatgaatggcaccagaaatggagatggccgggagcccggggacacagtggtgttccagtgtgaccccggctatgagctgcagggcgaggagcgcatcacctgcatccaggtggagaaccgctacttctggcagcccagcccccctgtgtgcatcgccccctgtggcggcaacctgaccggcagcagcggcttcatcctgagccccaacttcccccacccctacccccacagccgggactgtgactggaccatcaccgtgaatgctgactatgtgatcagcctggccttcatctccttcagcattgagcccaactatgacttcctgtacatctatgatggccctgacagcaacagccccctgattggcagcttccaggacagcaagctgcctgagagaattgagagcagcagcaacaccatgcacctggccttcagaagtgatggctctgtgtcctacacaggcttccacctggagtacaaggccaagctgcgggagagctgctttgaccccggcaacatcatgaatggcacccggctgggcatggactacaagctgggcagcacagtgacctactactgtgatgctggctacgtgctgcagggctacagcaccctgacctgcatcatgggagatgatggccggcccggctggaacagagccctgcccagctgccacgccccctgtggcagccgcagcactggaagtgagggcaccgtgctgagccccaactaccccaagaactacagcgtgggccacaactgtgtgtacagcattgctgtgcccaaggagtttgctgtgcccaggaccagcagcacccagtgcagctctgtgcctgagccccgcttcggcagaagaattggaaatgaatttgctgtgggcagctctgtgctgtttgactgcaaccctggctacatcctgcacggcagcatcgccatccgctgtgagaccgtgcccaacagcctggcccagtggaatgacagcctgcccacctgcatcgtgccctgtggcggcatcctgaccaagaggaagggcaccatcctgagccctggctacccagagccctatgacaacaacctgaactgtgtgtggaagatcaccgtgcctgagggcgccggcatccaggtgcaggtggtgtcctttgccacagagcacaactgggacagcctggacttctatgatggaggagacaacaatgccccccggctgggcagctacagcggcaccaccatcccccacctgctgaacagcaccagcaacaacctgtacctgaacttccagagcgacatctctgtgtctgctgctggcttccacctggagtacacagccatcggcctggacagctgcccagagccccagacccccagcagcggcatcaagatcggggaccgctacatggtgggagatgtggtgtccttccagtgtgaccagggctacagcctgcagggccacagccacatcacctgcatgcctggccctgtgcggcgctggaactaccccatccccatctgcctggcccagtgtggcggggccatgtctgacttctctggagtcatcctgagccctggcttccctggcaactaccccagcagcctggactgcacctggaccatcaacctgcccatcggctttggagtgcacctgcagtttgtgaacttcagcacagagaccatccatgactacctggaggtgcgcagcggcagcagcgagaccagcaccgtcatcggccgcctgagcggcccccagatccccagcagcctcttcagcaccacccatgagaccagcctgtacttccacagcgactacagccagaacaagcagggcttccacatcgtgtaccaggcctaccagctgcagagctgcccagacccccggcccttcagaaatggatttgtgattggaaatgacttcaccgtgggccagaccatcagctttgagtgcttccctggctacaccctgattggcaacagcgccctgacctgcctgcacggcgtgtccaggaactggaaccaccccctgccccgctgtgaggccctgtgtggcggcaacatcacagccatgaatggcaccatctacagccctggctacccagatgagtaccccaacttccaggactgcttctggctggtgcgggtgcccccaggaaatggcatctacatcaacttcaccgtgctgcagacagagcccatctatgacttcatcaccgtgtgggatggccctgaccagaacagcccccagatcggccagttcagcggcaacacagccctggagagcgtgtacagcaccagcaaccagatcctgatcaagttccacagcgacttcaccaccagcggcttctttgtgctgagctaccacgcctaccagctgcgggtgtgccagcccccacctcctgtgcccaatgctgagatcctgacagaagatgatgaatttgaaattggagacatcatccgctaccagtgcctgcccggcttcaccctggtgggcaatgccatcctgacctgccgcctgggggagcggctgcagatggatggagcccctcctgtgtgccaggtgctgtgcccagccaatgagctgcggctggacagcactggagtcatcctgagccctggctacccagacagctaccccaacctgcagatgtgtgcctggagcatctctgtggagaagggctacaacatcaccatgtttgtggagttcttccagacagagaaggagtttgatgtgctgcaggtgtatgatggccccaacatccagagccctgtgctgatcagcctgagcggggactacagcagcgccttcaacatcaccagcaatggacatgaggtgttcctgcagtggagcgctgaccacggcaacaacaagaagggcttccgcatccgctacatcgccttctactgcagcaccccagagagcccccctcatggctacatcatcagccagacaggaggccagctgaacagcgtggtgcgctgggcctgtgaccggggcttccggctggtgggcaagagcagcgctgtgtgcaggaagagcagctatggctaccacgcctgggatgcccctgtgcctgcctgccaggccatcagctgtggcatccccaaggcccccaccaacggcggcatcctgaccacagactacctggtgggcaccagggtgacctacttctgcaatgatggctaccgcctgagcagcaaggagctgaccacagctgtgtgccagagtgatggcacctggagcaaccacaacaagaccccccgctgtgtggtggtgacctgccccagcatcaacagcttcatcctggagcacggccgctggagaattgtgaatggcagccactatgagtacaagaccaaggtggtgttcagctgtgaccccggctaccacggcctgggccctgccagcattgagtgcctgcccaacggcacctggagctggagaaatgaaagaccctactgccagatcatcagctgtggggagctgcccaccccaccaaatggaaacaagattggcacccagaccagctatggcagcacagccatcttcacctgtgacctgggcttcatgctggtgggcagcgctgtgcgggagtgcctgagcagcggcctgtggagcgagagcgagacccgctgcctggccggccactgcggcatccctgagctgattgtgaatggccaggtgattggagaaaattatggctacagagacacagtggtgtaccagtgcaaccctggcttccgcctcatcggcagctctgtgcgcatctgccagcaggaccacaactggagcggccagctgcccagctgtgtgcctgtgtcctgtggccaccctggcagccccatctacggccgcaccagcggaaatggcttcaacttcaatgatgtggtgaccttcagctgcaacatcggctacctgatgcagggccccaccaaggcccagtgccaggccaaccggcagtggagccaccccccacccatgtgcaaggtggtgaactgcagcgaccccggcatcccagccaacagcaagcgggagagcaagattgagcacggcaacttcacctatggaacagtggtgttctatgactgcaaccctggctacttcctgtttggcagctctgtgctgatctgccagcccaacggccagtgggacaagcccctgcctgagtgcatcatgattgactgtggccaccctggggtgcccccaaatgctgtgctgtctggagagaagtacaccttcggcagcacagtgcactacagctgcaccgggaagaggagcctgctgggccagagcagcaggacctgccagctgaatggccactggagcggcagccagccccactgcagcggagatgccaccggcacctgtggggaccccggcaccccaggccacggcagccggcaggagagcaacttccgcaccaagagcacagtgcgctatgcctgtgacaccggctacatcctgcacggcagcgaggagaggacctgcctggccaacggctcctggacaggccggcagcctgagtgcaaggctgtgcagtgtggcaaccctggcaccacagccaacgggaaggtgttcagaattgatggcaccaccttcagcagcagcgtcatctacagctgcatggagggctacatcctgagcggccccagcgtgcggcagtgcacagccaacggcacctggagcggcaccctgcccaactgcaccatcatcagctgtggggaccccggcatcccagccaacggcctgcgctatggagatgattatgtggtgggccagaatgtgtcctacatgtgccagcccggctacaccatggagctgaatggcagccgcatccgcacctgcaccatcaatggcacctggagcggcgtgatgcccacctgcagagctgtgacctgccccaccccaccccagatcagcaatggccgcctggagggcaccaactttgactggggcttcagcatctcctacatctgcagccctggctatgagctgtccttccctgctgtgctgacctgtgtgggcaatggcacctggagcggggaggtgccccagtgcctgcccaagttctgtggggaccccggcatcccagcccagggcaagcgggagggcaagagcttcatctaccagagcgaggtgtccttcagctgcaacttccccttcatcctggtgggcagcagcacccgcatctgccaggctgatggcacctggagcggcagcagcccccactgcatcgagcccacccagaccagctgtgaaaatcctggggtgcccaggcatggcagccagaacaacaccttcggcttccaggtgggctctgtggtgcagttccactgcaagaagggccacctgctgcagggcagcaccaccaggacctgcctgcctgacctgacctggagcggcatccagcctgagtgcatcccccacagctgcaagcagcctgagaccccagcccacgccaacgtggtgggcatggacctgcccagccacggctacaccctcatctacacctgccagcccggcttcttcctggccggcggcacagagcaccgggtgtgccgcagtgacaacacctggacaggcaaggtgcccatctgtgaggccggcagcaagatcctggtgaaggaccccaggcctgccctgggcacccccagccccaagctgtctgtgcctgatgatgtgtttgcccagaactacatctggaagggcagctacaacttcaagggcaggaagcagcccatgaccctgactgtgaccagcttcaatgccagcacaggccgggtgaatgccaccctgagcaacagcaacatggagctgctgctgagcggcgtgtacaagagccaggaggcccggctgatgctgcgcatctacctgatcaaggtgcctgcccacgcctctgtgaagaagatgaaggaggagaactgggccatggatggctttgtgtctgctgagccagatggagccacctacgtgttccagggcttcatccagggcaaggactatggccagtttggcctgcagaggctgggcctgaacatgtctgagggcagcaacagcagcaaccagccccacggcaccaacagcagctctgtggccatcgccatcctggtgcccttctttgccctgatctttgctggcttcggcttctacctgtacaagcagaggacagcccccaagacccagtacacaggctgcagcgtgcatgagaacaacaacggccaggccgcctttgagaaccccatgtatgacaccaatgccaagtctgtggagggcaaggctgtgcgctttgaccccaacctgaacacagtgtgcaccatggtgtag

SEQ ID NO: 148718 - DNA, 10617 bp, Artificial Sequence
  Description of Artificial Sequence: Synthetic coding sequence
atgaagggcatcaggaagggggagagccgggccaaggagagcaagccctgggagcccgggaagaggcgctgtgccaagtgtggccgcctggacttcatcctgatgaagaagatgggcatcaagagcggcttcaccttctggaacctggtgttcctgctgactgtgtcctgtgtgaagggcttcatctacacctgtggcggcaccctgaagggcctgaatggcaccatcgagagccctggcttcccctacggctacccaaatggagccaactgcacctgggtgatcatcgccgaggagaggaaccgcatccagatcgtgttccagagctttgccctggaggaggagtatgactacctgagcctgtatgatggccacccccaccccaccaacttccgcacccggctgaccggcttccacctgcccccacctgtgaccagcaccaagtctgtgttcagcctgcggctgaccagtgactttgctgtgtctgcccacggcttcaaggtgtactatgaggagctgcagagcagcagctgtggcaaccctggggtgccccccaagggcgtgctgtatggcaccaggtttgatgtgggggacaagatccgctacagctgtgtgacaggctacatcctggatggccacccccagctgacctgcatcgccaacagcgtgaacacagcctcctgggacttccctgtgcccatctgcagagcagaagatgcctgtggcggcaccatgaggggcagcagcggcatcatcagcagccccagcttccccaatgagtaccacaacaatgctgactgcacctggaccatcgtggccgagcccggggacaccatcagcctcatcttcacagacttccagatggaggagaagtatgactacctggagattgagggcagcgagccccccaccatctggctgagcggcatgaacatccccccacccatcatcagcaacaagaactggctgcggctgcactttgtgacagacagcaaccaccgctaccggggcttcagcgccccctaccaggtgaagaaggccatcgacttcaagagccggggcttcaagctgtttcctgggaaggacaacagcaacaagttcagcatcctgaatgaaggaggcatcaagacagccagcaacctgtgcccagaccctggagagccagaaaatggcaagagaattggaagtgacttcagcctgggcagcacagtgcagttcagctgtgatgaggactatgtgctgcagggcgccaagagcatcacctgccagagaattgctgaggtgtttgctgcctggagcgaccacaggcctgtgtgcaaggtgaagacctgtggcagcaacctgcagggccccagcggcaccttcaccagccccaacttccccttccagtatgacagcaatgcccagtgtgtgtgggtgatcacagctgtgaacaccaacaaggtgatccagatcaactttgaggagtttgacctggagatcggctatgacaccctgaccatcggagatggaggagaggtgggggaccccaggacagtgctgcaggtgctgaccggcagctttgtgcctgacctgattgtgtccatgagcagccagatgtggctgcacctgcagacagatgagagcgtgggctctgtgggcttcaaggtgaactacaaggagattgagaaggagagctgtggggaccccggcacccccctgtatggcatccgggagggagatggcttcagcaacagagatgtgctgcgctttgagtgccagtttggatttgagctgattggagagaagagcatcgtgtgccaggagaacaaccagtggagcgccaacatccccatctgcatcttcccctgcctgagcaacttcaccgcccccatgggcaccgtgctgagcccagactacccagagggctacggcaacaacctgaactgcatctggaccatcatcagtgaccccggcagccgcatccacctgtccttcaatgactttgacctggagagccagtttgacttcctggccgtgaaggatggagacagccctgagagccccatcctgggcaccttcaccggggctgaggtgcccagccacctgaccagcaacagccacatcctgcggctggagttccaggccgaccacagcatgagcggccggggcttcaacatcacctacaacaccttcggccacaatgaatgtcctgaccccggcatccccatcaatgccaggagatttggagacaacttccagctgggcagcagcatcagcgtcatctgtgaggagggcttcatcaagacccagggcacagagaccatcacctgcatcctgatggatggcaaggtgatgtggagcggcctcatccccaagtgtggggccccctgtggcggccacttcagcgcccccagcggggtcatcctgagccctggctggccaggctactacaaggacagcctgaactgtgagtgggtgattgaagctgagcccggccacagcatcaagatcacctttgagcgcttccagacagagctgaactatgatgtgctggaggtgcatgatggccccaacctgctgagccccctgctgggcagctacaacggcacccaggtgccccagttcctgttcagcagcagcaacttcatctacctgctcttcaccacagacaacagccgcagcaacaacggcttcaagatccactatgagagcgtgacagtgaacacctacagctgcctggaccccggcatccctgtgcacggccgccgctatggccatgacttcagcatcggcagcacagtgtccttcagctgtgacagcggctaccgcctgagccatgaggagcccctgctgtgtgagaagaaccactggtggagccaccccctgcccacctgtgatgccctgtgtggaggagatgtgcggggccccagcggcaccatcctgagccctggctacccagagttctaccccaacagcctgaactgcacctggacagtggatgtgacccatggaaaaggagtgcagttcaacttccacaccttccacctggaggaccaccacgactacctgctgatcacagaaaatggcagcttcacccagcccctggcccggctgactggaagtgacctgccccccaccatcaatgccggcctgtatggcaacttccgggcccagctgcgcttcatcagtgacttcagcatctcctatgagggcttcaacatcaccttcagcgagtacaacctggagccctgtgaagatcctggcatcccccagtatggcagccgcatcggcttcaactttggcatcggggacaccctgaccttcagctgcagcagcggctaccgcctggagggcaccagcgagatcatctgcctgggcggcggcagaagagtgtggagcgcccccctgccccgctgtgtggccgagtgtggggccagcgccaccaacaatgaaggcatcctgctgagccccaactaccccctgaactatgagaacaaccacgagtgcatctacagcatccaggtgcaggccggcaagggcatcaacatcagcgcccggaccttccacctggcccagggagatgtgctgaagatctatgatggcaaggacaagaccacccacctgctgggcgccttcaccggggcctccatgaggggcctgaccctgagcagcaccagcaaccagctgtggctggagttcaacagcgacacagagggcacagatgagggcttccagctggtgtacaccagctttgagctgagccactgtgaagatcctggcatcccccagtttggctacaagatcagtgaccagggccactttgctggcagcaccatcatctacggctgcaaccctggctacaccctgcacggcagcagcctgctgaagtgcatgactggagagcggcgggcctgggactaccccctgcccagctgcatcgcagaatgtggcggccgcttcaagggggagagcagcggccgcatcctgagccctggctaccccttcccctatgacaacaacctgcgctgcatgtggatgattgaggtggaccccggcaacatcgtgtccctgcagttcctggcctttgacacagaggccagccatgacatcctgcgggtgtgggatggccccccagaaaatgacatgctgctgaaggagatcagcggcagcctcatccctgagggcatccacagcaccctgaacatcgtgaccatccagtttgacacagacttctacatcagcaagagcggctttgccatccagttcagcagctctgtggccacagcctgccgggaccccggggtgcccatgaatggcaccagaaatggagatggccgggagcccggggacacagtggtgttccagtgtgaccccggctatgagctgcagggcgaggagcgcatcacctgcatccaggtggagaaccgctacttctggcagcccagcccccctgtgtgcatcgccccctgtggcggcaacctgaccggcagcagcggcttcatcctgagccccaacttcccccacccctacccccacagccgggactgtgactggaccatcaccgtgaatgctgactatgtgatcagcctggccttcatctccttcagcattgagcccaactatgacttcctgtacatctatgatggccctgacagcaacagccccctgattggcagcttccaggacagcaagctgcctgagagaattgagagcagcagcaacaccatgcacctggccttcagaagtgatggctctgtgtcctacacaggcttccacctggagtacaaggccaagctgcgggagagctgctttgaccccggcaacatcatgaatggcacccggctgggcatggactacaagctgggcagcacagtgacctactactgtgatgctggctacgtgctgcagggctacagcaccctgacctgcatcatgggagatgatggccggcccggctggaacagagccctgcccagctgccacgccccctgtggcagccgcagcactggaagtgagggcaccgtgctgagccccaactaccccaagaactacagcgtgggccacaactgtgtgtacagcattgctgtgcccaaggagtttgtggtgtttggccagtttgtgttcttccagaccagcctgcatgatgtggtggaggtgtatgatggccccacccagcagagcagcctgctgagcagcctgagcggcagccacagcggggagagcctgcccctgagcagcggcaaccagatcaccatccgcttcacctctgtgggccccatcacagccaagggcttccactttgtgtaccaggccgtgcccaggaccagcagcacccagtgcagctctgtgcctgagccccgcttcggcagaagaattggaaatgaatttgctgtgggcagctctgtgctgtttgactgcaaccctggctacatcctgcacggcagcatcgccatccgctgtgagaccgtgcccaacagcctggcccagtggaatgacagcctgcccacctgcatcgtgccctgtggcggcatcctgaccaagaggaagggcaccatcctgagccctggctacccagagccctatgacaacaacctgaactgtgtgtggaagatcaccgtgcctgagggcgccggcatccaggtgcaggtggtgtcctttgccacagagcacaactgggacagcctggacttctatgatggaggagacaacaatgccccccggctgggcagctacagcggcaccaccatcccccacctgctgaacagcaccagcaacaacctgtacctgaacttccagagcgacatctctgtgtctgctgctggcttccacctggagtacacagccatcggcctggacagctgcccagagccccagacccccagcagcggcatcaagatcggggaccgctacatggtgggagatgtggtgtccttccagtgtgaccagggctacagcctgcagggccacagccacatcacctgcatgcctggccctgtgcggcgctggaactaccccatccccatctgcctggcccagtgtggcggggccatgtctgacttctctggagtcatcctgagccctggcttccctggcaactaccccagcagcctggactgcacctggaccatcaacctgcccatcggctttggagtgcacctgcagtttgtgaacttcagcacagagaccatccatgactacctggaggtgcgcagcggcagcagcgagaccagcaccgtcatcggccgcctgagcggcccccagatccccagcagcctcttcagcaccacccatgagaccagcctgtacttccacagcgactacagccagaacaagcagggcttccacatcgtgtaccaggcctaccagctgcagagctgcccagacccccggcccttcagaaatggatttgtgattggaaatgacttcaccgtgggccagaccatcagctttgagtgcttccctggctacaccctgattggcaacagcgccctgacctgcctgcacggcgtgtccaggaactggaaccaccccctgccccgctgtgaggccctgtgtggcggcaacatcacagccatgaatggcaccatctacagccctggctacccagatgagtaccccaacttccaggactgcttctggctggtgcgggtgcccccaggaaatggcatctacatcaacttcaccgtgctgcagacagagcccatctatgacttcatcaccgtgtgggatggccctgaccagaacagcccccagatcggccagttcagcggcaacacagccctggagagcgtgtacagcaccagcaaccagatcctgatcaagttccacagcgacttcaccaccagcggcttctttgtgctgagctaccacgcctaccagctgcgggtgtgccagcccccacctcctgtgcccaatgctgagatcctgacagaagatgatgaatttgaaattggagacatcatccgctaccagtgcctgcccggcttcaccctggtgggcaatgccatcctgacctgccgcctgggggagcggctgcagatggatggagcccctcctgtgtgccaggtgctgtgcccagccaatgagctgcggctggacagcactggagtcatcctgagccctggctacccagacagctaccccaacctgcagatgtgtgcctggagcatctctgtggagaagggctacaacatcaccatgtttgtggagttcttccagacagagaaggagtttgatgtgctgcaggtgtatgatggccccaacatccagagccctgtgctgatcagcctgagcggggactacagcagcgccttcaacatcaccagcaatggacatgaggtgttcctgcagtggagcgctgaccacggcaacaacaagaagggcttccgcatccgctacatcgccttctactgcagcaccccagagagcccccctcatggctacatcatcagccagacaggaggccagctgaacagcgtggtgcgctgggcctgtgaccggggcttccggctggtgggcaagagcagcgctgtgtgcaggaagagcagctatggctaccacgcctgggatgcccctgtgcctgcctgccaggccatcagctgtggcatccccaaggcccccaccaacggcggcatcctgaccacagactacctggtgggcaccagggtgacctacttctgcaatgatggctaccgcctgagcagcaaggagctgaccacagctgtgtgccagagtgatggcacctggagcaaccacaacaagaccccccgctgtgtggtgatcagctgtggggagctgcccaccccacccaacggcaacaagattggcacccagaccagctatggcagcacagccatcttcacctgtgacctgggcttcatgctggtgggcagcgctgtgagagaatgtctgagcagcggcctgtggagcgagagcgagacccgctgcctggccggccactgcggcatccctgagctgattgtgaatggccaggtgattggagagaactacggctacagagacacagtggtgtaccagtgcaaccctggcttccggctgattggcagctctgtgcgcatctgccagcaggaccacaactggagcggccagctgcccagctgtgtgcctgtgtcctgtggccaccctggcagccccatctacggccgcaccagcggaaatggcttcaacttcaatgatgtggtgaccttcagctgcaacatcggctacctgatgcagggccccaccaaggcccagtgccaggccaaccggcagtggagccaccccccacccatgtgcaaggtggtgaactgcagcgaccccggcatcccagccaacagcaagcgggagagcaagattgaacatggcaacttcacctacggcaccgtggtgttctatgactgcaaccctggctacttcctgtttggcagctctgtgctgatctgccagcccaacggccagtgggacaagcccctgcctgagtgcatcatgattgactgtggccaccctggggtgcccccaaatgctgtgctgagcggggagaagtacaccttcggcagcacagtgcactacagctgcaccgggaagaggagcctgctgggccagagcagcaggacctgccagctgaatggccactggagcggcagccagccccactgcagcggagatgccaccggcacctgtggggaccccggcaccccaggccacggcagccggcaggagagcaacttccgcaccaagagcacagtgcgctatgcctgtgacaccggctacatcctgcacggcagcgaggagaggacctgcctggccaacggctcctggacaggccggcagcctgagtgcaaggctgtgcagtgtggcaaccctggcaccacagccaacgggaaggtgttcagaattgatggcaccaccttcagcagcagcgtcatctacagctgcatggagggctacatcctgagcggccccagcgtgcggcagtgcacagccaacggcacctggagcggcaccctgcccaactgcaccatcatcagctgtggggaccccggcatcccagccaacggcctgcgctatggagatgattatgtggtgggccagaatgtgtcctacatgtgccagcccggctacaccatggagctgaatggcagccgcatccgcacctgcaccatcaatggcacctggagcggcgtgatgcccacctgcagagctgtgacctgccccaccccaccccagatcagcaatggccgcctggagggcaccaactttgactggggcttcagcatctcctacatctgcagccctggctatgagctgtccttccctgctgtgctgacctgtgtgggcaatggcacctggagcggggaggtgccccagtgcctgcccaagttctgtggggaccccggcatcccagcccagggcaagcgggagggcaagagcttcatctaccagagcgaggtgtccttcagctgcaacttccccttcatcctggtgggcagcagcacccgcatctgccaggctgatggcacctggagcggcagcagcccccactgcatcgagcccacccagaccagctgtgagaaccctggggtgcccaggcatggcagccagaacaacaccttcggcttccaggtgggctctgtggtgcagttccactgcaagaagggccacctgctgcagggcagcaccaccaggacctgcctgcctgacctgacctggagcggcatccagcctgagtgcatcccccacagctgcaagcagcctgagaccccagcccacgccaacgtggtgggcatggacctgcccagccacggctacaccctcatctacacctgccagcccggcttcttcctggccggcggcacagagcaccgggtgtgccgcagtgacaacacctggacaggcaaggtgcccatctgtgaggccggcagcaagatcctggtgaaggaccccaggcctgccctgggcacccccagccccaagctgtctgtgcctgatgatgtgtttgcccagaactacatctggaagggcagctacaacttcaagggcaggaagcagcccatgaccctgactgtgaccagcttcaatgccagcacaggccgggtgaatgccaccctgagcaacagcaacatggagctgctgctgtctggagtgtacaagagccaggaggcccggctgatgctgcgcatctacctgatcaaggtgcctgcccacgcctctgtgaagaagatgaaggaggagaactgggccatggatggctttgtgtctgctgagccagatggagccacctacgtgttccagggcttcatccagggcaaggactatggccagtttggcctgcagaggctgggcctgaacatgtctgagggcagcaacagcagcaaccagccccacggcaccaacagcagctctgtggccatcgccatcctggtgcccttctttgccctgatctttgctggcttcggcttctacctgtacaagcagaggacagcccccaagacccagtacacaggctgcagcgtgcatgagaacaacaacggccaggccgcctttgagaaccccatgtatgacaccaatgccaagtctgtggagggcaaggctgtgcgctttgaccccaacctgaacacagtgtgcaccatggtgtag

SEQ ID NO: 148719 - DNA, 2511 bp, Artificial Sequence
  Description of Artificial Sequence: Synthetic coding sequence
atggccggcctgaactgtggggtgtccatcgccctgctgggcgtgctgctgctgggcgccgcccggctgcccagaggagctgaggcctttgagatcgccctgccccgggagagcaacatcaccgtgctgatcaagctgggcacccccaccctgctggccaagccctgctacatcgtcatcagcaagaggcacatcaccatgctgagcatcaagagcggggagcgcatcgtgttcaccttcagctgccagagccctgagaaccactttgtgattgagatccagaagaacatcgactgcatgagcggcccctgcccctttggagaggtgcagctgcagcccagcaccagcctgctgcccaccctgaacagaaccttcatctgggatgtgaaggcccacaagagcatcggcctggagctgcagttcagcatcccccggctgcggcagatcggccctggagagagctgcccagatggagtgacccacagcatcagcggcagaattgatgccaccgtggtgcgcatcggcaccttctgcagcaatggcaccgtgagccgcatcaagatgcaggagggcgtgaagatggccctgcacctgccctggttccaccccagaaatgtgtctggcttcagcatcgccaacagaagcagcatcaagaggctgtgcatcattgaatctgtgtttgaaggagagggcagcgccaccctgatgtctgccaactacccagagggcttcccagaagatgagctgatgacctggcagtttgtggtgcctgcccacctgcgggcctctgtgtccttcctgaacttcaacctgagcaactgtgagaggaaggaggagcgggtggagtactacatccctggcagcaccaccaaccctgaggtgttcaagctggaggacaagcagcccggcaacatggccggcaacttcaacctgagcctgcagggctgtgaccaggatgcccagagccctggcatcctgcggctgcagttccaggtgctggtgcagcacccccagaatgaaagcaacaagatctacgtggtggacctgagcaatgaaagagccatgagcctgaccatcgagcccaggcctgtgaagcagagcaggaagtttgtgcccggctgctttgtgtgcctggagagcaggacctgcagcagcaacctgaccctgaccagcggcagcaagcacaagatctccttcctgtgtgatgacctgacccggctgtggatgaatgtggagaagaccatcagctgcacagaccaccgctactgccagaggaagagctacagcctgcaggtgcccagcgacatcctgcacctgcctgtggagctgcatgacttctcctggaagctgctggtgcccaaggaccggctgagcctggtgctggtgcctgcccagaagctgcagcagcacacccatgagaagccctgcaacaccagcttctcctacctggtggccagcgccatccccagccaggacctgtacttcggcagcttctgccctgggggcagcatcaagcagatccaggtgaagcagaacatctctgtgaccctgcggacctttgcccccagcttccagcaggaggccagccggcagggcctgactgtgtccttcatcccctacttcaaggaggagggcgtcttcaccgtgaccccagacaccaagagcaaggtgtacctgcggacccccaactgggaccggggcctgcccagcctgacctctgtgtcctggaacatctctgtgccccgggaccaggtggcctgcctgaccttcttcaaggagaggtctggagtggtgtgccagacaggccgggccttcatgatcatccaggagcagaggaccagggctgaggagatcttcagcctggatgaagatgtgctgcccaagcccagcttccaccaccacagcttctgggtgaacatcagcaactgcagccccaccagcggcaagcagctggacctgctcttctctgtgaccctgacccccaggacagtggacctgaccgtcatcctgattgctgctgtgggcggcggcgtgctgctgctgagcgccctgggcctcatcatctgctgcgtgaagaagaagaagaagaagaccaacaagggccctgctgtgggcatctacaatgacaacatcaacacagagatgccccggcagcccaagaagttccagaagggcaggaaggacaatgacagccacgtgtatgctgtgattgaggacaccatggtgtatggccacctgctgcaggacagcagcggcagcttcctgcagcctgaggtggacacctaccggcccttccagggcaccatgggcgtgtgcccccccagcccccccaccatctgcagccgggcccccacagccaagctggccacagaggagcccccacccaggagccccccagagagcgagagcgagccctacaccttcagccaccccaacaatggagatgtgagcagcaaggacacagacatccccctgctgaacacccaggagcccatggagcctgctgagtag

SEQ ID NO: 148720 - DNA, 1032 bp, Artificial Sequence
  Description of Artificial Sequence: Synthetic coding sequence
atggccggcctgaactgtggggtgtccatcgccctgctgggcgtgctgctgctgggcgccgcccggctgcccagaggagctgaggcctttgagatcgccctgccccgggagagcaacatcaccgtgctgatcaagctgggcacccccaccctgctggccaagccctgctacatcgtcatcagcaagaggcacatcaccatgctgagcatcaagagcggggagcgcatcgtgttcaccttcagctgccagagccctgagaaccactttgtgattgagatccagaagaacatcgactgcatgagcggcccctgcccctttggagaggtgcagctgcagcccagcaccagcctgctgcccaccctgaacagaaccttcatctgggatgtgaaggcccacaagagcatcggcctggagctgcagttcagcatcccccggctgcggcagatcggccctggagagagctgcccagatggagtgacccacagcatcagcggcagaattgatgccaccgtggtgcgcatcggcaccttctgcagcaatggcaccgtgagccgcatcaagatgcaggagggcgtgaagatggccctgcacctgccctggttccaccccagaaatgtgtctggcttcagcatcgccaacagaagcagcatcaagaggctgtgcatcattgaatctgtgtttgaaggagagggcagcgccaccctgatgtctgccaactacccagagggcttcccagaagatgagctgatgacctggcagtttgtggtgcctgcccacctgcgggcctctgtgtccttcctgaacttcaacctgagcaactgtgagaggaaggaggagcgggtggagtactacatccctggcagcaccaccaaccctgaggtgttcaagctggaggacaagcagcccggcaacatggccggcaacttcaacctgagcctgcagggctgtgaccaggatgcccagagccctggcatcctgcggctgcagttccaggtgctggtgcagcacccccagaatgaaagcagcgagtag

SEQ ID NO: 148721 - DNA, 513 bp, Artificial Sequence
  Description of Artificial Sequence: Synthetic coding sequence
atgatgaacatgagcctgcccttcctgtggagcctgctgaccctgctgatctttgctgaggtgaatggagaggccggggagctggagctgcagaggcagaagaggagcatcaacctgcagcagcccaggatggccacagagcggggcaacctggtgttcctgactggaagtgcccagaacatcgagttcagaacaggcagcctgggcaagatcaagctgaatgatgaggacctgtctgagtgcctgcaccagatccagaagaacaaggaggacatcatcgagctgaagggcagcgccatcggcctgccccagaacatcagcagccagatctaccagctgaacagcaagctggtggacctggagaggaagttccagggcctgcagcagacagtggacaagaaggtgtgcagcagcaacccctgccagaatggaggcacctgcctgaacctgcatgacagcttcttctgcatctgccccccccagtggaaggtgagccacctgctgtttggatag

SEQ ID NO: 148722 - DNA, 10872 bp, Artificial Sequence
  Description of Artificial Sequence: Synthetic coding sequence
atgatgaacatgagcctgcccttcctgtggagcctgctgaccctgctgatctttgctgaggtgaatggagaggccggggagctggagctgcagaggcagaagaggagcatcaacctgcagcagcccaggatggccacagagcggggcaacctggtgttcctgactggaagtgcccagaacatcgagttcagaacaggcagcctgggcaagatcaagctgaatgatgaggacctgtctgagtgcctgcaccagatccagaagaacaaggaggacatcatcgagctgaagggcagcgccatcggcctgccccagaacatcagcagccagatctaccagctgaacagcaagctggtggacctggagaggaagttccagggcctgcagcagacagtggacaagaaggtgtgcagcagcaacccctgccagaatggaggcacctgcctgaacctgcatgacagcttcttctgcatctgccccccccagtggaagggccccctgtgcagcgcagatgtgaatgaatgtgagatctacagcggcacccccctgagctgccagaatggaggcacctgtgtgaacaccatgggcagctacagctgccactgccccccagagacctacggcccccagtgtgccagcaaatatgatgactgtgagggcggctctgtggcccgctgtgtgcacggcatctgtgaggacctgatgagggagcaggccggggagcccaagtacagctgtgtgtgtgatgctggctggatgttcagccccaacagccctgcctgcaccctggacagagatgagtgcagcttccagcccggcccctgcagcaccctggtgcagtgcttcaacacccagggcagcttctactgtggggcctgccccaccggctggcagggcaatggctacatctgtgaggacatcaatgaatgtgagatcaacaatggaggctgcagcgtggcccctcctgtggagtgtgtgaacaccccaggcagcagccactgccaggcctgccccccaggctaccagggagatggccgggtgtgcaccctgacagacatctgcagcgtgtccaatggaggctgccacccagatgccagctgcagcagcaccctgggcagcctgcccctgtgcacctgcctgcccggctacacaggaaatggctacggccccaacggctgtgtgcagctgagcaacatctgcctgagccacccctgcctgaatggccagtgcatcgacacagtgtctggctacttctgcaagtgtgacagcggctggacaggagtgaactgcacagagaacatcaatgaatgtctgagcaacccctgcctgaatggaggcacctgtgtggatggagtggacagcttcagctgtgaatgtacccggctgtggacaggagccctgtgccaggtgccccagcaggtgtgtggggagagcctgagcggcatcaatggcagcttctcctaccgcagcccagatgtgggctacgtgcatgatgtgaactgcttctgggtgatcaagacagagatgggcaaggtgctgcgcatcaccttcaccttcttccggctggagagcatggacaactgcccccatgagttcctgcaggtgtatgatggagacagcagcagcgccttccagctgggccgcttctgtggcagcagcctgccccatgagctgctgagcagtgacaatgccctgtacttccacctgtacagcgagcacctgagaaatggccggggcttcaccgtgcgctgggagacccagcagccagaatgtggcggcatcctgaccggcccctacggcagcatcaagagccctggctacccaggcaactacccacctggccgggactgtgtgtggatcgtggtgaccagcccagacctgctggtgaccttcaccttcggcaccctgagcctggagcaccatgatgactgcaacaaggactacctggagatcagagatggccccctgtaccaggaccccctgctgggcaagttctgcaccaccttctctgtgccccccctgcagaccaccggcccctttgcccgcatccacttccacagcgacagccagatcagtgaccagggcttccacatcacctacctgaccagccccagcgacctgcgctgtggcggcaactacacagatcctgagggggagctgttcctgcctgagctgagcggccccttcacccacacccggcagtgtgtgtacatgatgaagcagccccagggcgagcagatccagatcaacttcacccacgtggagctgcagtgccagagcgacagcagccagaactacatcgaggtgagagatggagagaccctgctgggcaaggtgtgtggaaatggcaccatcagccacatcaagagcatcaccaacagcgtgtggatccgcttcaagattgatgcctctgtggagaaggccagcttccgggctgtgtaccaggtggcctgtggagatgagctgaccggggagggcgtcatccgcagccccttcttccccaacgtgtacccaggagagaggacctgccgctggaccatccaccagccccagagccaggtgatcctgctgaacttcaccgtgtttgaaattggcagcagcgcccactgtgaaacagattatgtggagatcggcagcagcagcatcctgggcagccctgagaacaagaagtactgcggcacagacatccccagcttcatcacctctgtgtacaacttcctgtatgtgacctttgtgaagagcagcagcacagaaaatcatggcttcatggccaagttctctgctgaggacctggcctgtggggagatcctgacagagagcacaggcaccatccagagccctggccaccccaacgtgtacccccacggcatcaactgcacctggcacatcctggtgcagcccaaccacctgatccacctgatgtttgagaccttccacctggagttccactacaactgcaccaatgactacctggaggtgtatgacacagattctgagaccagcctgggccgctactgcggcaagagcatcccccccagcctgaccagcagcggcaacagcctgatgctggtgtttgtgacagacagcgacctggcctatgagggcttcctgatcaactatgaggccatctctgctgccacagcctgcctgcaggactacacagatgacctgggcaccttcaccagccccaacttccccaacaactaccccaacaactgggagtgcatctaccgcatcaccgtgaggacaggccagctgattgctgtgcacttcaccaacttcagcctggaggaggccatcggcaactactacacagacttcctggagatcagagatggcggctatgagaagagccccctgctgggcatcttctacggcagcaacctgccccccaccatcatcagccacagcaacaagctgtggctgaagttcaagagtgaccagattgacaccaggagcggcttcagcgcctactgggatggcagcagcacaggctgcggcggcaacctgaccaccagcagcggcaccttcatcagccccaactaccccatgccctactaccacagcagcgagtgctactggtggctgaagagcagccacggcagcgcctttgagctggagttcaaggacttccacctggagcaccaccccaactgcaccctggactacctggccgtgtatgatggccccagcagcaacagccacctgctgacccagctgtgtggagatgagaagcccccactcatccgcagcagcggggacagcatgttcatcaagctgaggacagatgagggccagcagggccggggcttcaaggccgagtaccggcagacctgtgaaaatgtggtgattgtgaaccagacctacggcatcctggagagcatcggctaccccaacccctacagcgagaaccagcactgcaactggaccatccgggccaccaccggcaacacagtgaactacaccttcctggcctttgacctggagcaccacatcaactgcagcacagactacctggagctgtatgatggcccccggcagatgggccgctactgcggcgtggacctgcccccacctggcagcaccaccagcagcaagctgcaggtgctgctgctgacagatggagtgggcagaagagagaagggcttccagatgcagtggtttgtgtatggctgcggcggggagctgagcggggccaccggcagcttcagcagccctggcttccccaaccgctacccacccaacaaggagtgcatctggtacatcagaacagatcctggcagcagcatccagctgaccatccatgactttgatgtggagtaccacagccgctgcaactttgatgtgctggagatctacggcggccctgacttccacagcccccgcatcgcccagctgtgcacccagaggagccctgagaaccccatgcaggtgagcagcactggaaatgagctggccatccgcttcaagacagacctgagcatcaatggccggggcttcaatgcctcctggcaggccgtgactggaggctgcggcggcatcttccaggcccccagcggggagatccacagccccaactaccccagcccctaccgcagcaacacagactgctcctgggtgatccgggtggacaggaaccaccgggtgctgctgaacttcacagactttgacctggagccccaggacagctgcatcatggcctatgatggcctgagcagcaccatgagccggctggcccggacctgtggccgggagcagctggccaaccccatcgtgagcagcggcaacagcctcttcctgcgcttccagagcggccccagccggcagaacagaggcttccgggcccagttccggcaggcctgtggcggccacatcctgaccagcagctttgacacagtgagcagcccccgcttccctgccaactaccccaacaaccagaactgctcctggatcatccaggcccagccccccctgaaccacatcaccctgtccttcacccactttgagctggagaggagcaccacctgtgcccgggactttgtggagatcctggatggcggccatgaagatgcccccctgcggggccgctactgcggcacagacatgccccaccccatcaccagcttcagcagcgccctgaccctgcgctttgtgtctgacagcagcatctctgctgggggcttccacaccaccgtgacagcctctgtgtctgcctgtggcggcaccttctacatggccgagggcatcttcaacagccctggctacccagacatctaccccccaaatgtggagtgtgtgtggaacatcgtgagcagccctggcaaccggctgcagctgtccttcatctccttccagctggaggacagccaggactgcagccgggactttgtggagatccgggagggcaatgccaccggccacctggtgggccgctactgcggcaacagcttccccctgaactacagcagcatcgtgggccacaccctgtgggtgcgcttcatcagtgatggcagcggcagcggcaccggcttccaggccaccttcatgaagatctttggaaatgacaacatcgtgggcacccacggcaaggtggccagccccttctggccagagaactacccccacaacagcaactaccagtggacagtgaatgtgaatgccagccacgtggtgcacggccgcatcctggagatggacatcgaggagatccagaactgctactatgacaagctgcgcatctatgatggccccagcatccacgcccggctgattggagcctactgcggcacccagacagagagcttcagcagcactggaaacagcctgaccttccacttctacagcgacagcagcatcagcggcaagggcttcctgctggagtggtttgctgtggatgccccagatggagtgctgcccaccatcgcccctggggcctgtggcggcttcctgaggactggagatgcccctgtgttcctgttcagccctggctggccagacagctacagcaacagagtggactgcacctggctgatccaggccccagacagcacagtggagctgaacatcctgagcctggacatcgagagccacaggacctgtgcctatgacagcctggtgatcagagatggagacaacaacctggcccagcagctggccgtgctgtgtggccgggagatccctggccccatccgcagcactggagagtacatgttcatccgcttcaccagtgacagctctgtgacccgggccggcttcaatgccagcttccacaagagctgtggcggctacctgcacgccgaccggggcatcatcaccagccccaagtacccagagacctaccccagcaacctgaactgctcctggcacgtgctggtgcagagcggcctgaccatcgctgtgcactttgagcagcccttccagatccccaacggggacagcagctgcaaccagggcgactacctggtgctgagaaatggaccagacatctgcagcccccccctgggccccccaggcggcaatggccacttctgtggcagccacgccagcagcaccctcttcaccagtgacaaccagatgtttgtgcagttcatcagtgaccacagcaatgaaggccagggcttcaagatcaagtatgaggccaagagcctggcctgtggcggcaatgtgtacatccatgatgctgacagcgctggctacgtgaccagccccaaccacccccacaactacccacctcatgctgactgcatctggatcctggccgcccctcctgagacccgcatccagctgcagtttgaggacagatttgatattgaggtgacccccaactgcaccagcaactacctggagctgagagatggagtggacagtgatgcccccatcctgagcaagttctgtggcaccagcctgcccagcagccagtggagcagcggggaggtgatgtacctgcgcttcagaagtgacaacagccccacccacgtgggcttcaaggccaagtacagcatcgcccagtgtggcggccgggtgcccggccagagcggcgtggtggagagcatcggccaccccaccctgccctacagagacaacctcttctgtgagtggcacctgcagggcctgagcggccactacctgaccatcagctttgaggacttcaacctgcagaacagcagcggctgtgagaaggactttgtggagatctgggacaaccacaccagcggcaacatcctgggccgctactgcggcaacaccatcccagacagcattgacaccagcagcaacacagctgtggtgcgctttgtgacagatggctctgtgacagccagcggcttccggctgcgctttgagagctccatggaggagtgtggcggggacctgcagggcagcatcggcaccttcaccagccccaactaccccaaccccaacccccacggccgcatctgtgagtggaggatcacagcccctgagggccgccgcatcaccctgatgttcaacaacctgcggctggccacccaccccagctgcaacaatgaacatgtgattgtgttcaacggcatccgcagcaacagcccccagctggagaagctgtgcagctctgtgaatgtgtccaatgagatcaagagcagcggcaacaccatgaaggtgatcttcttcacagatggcagccggccctatggaggcttcaccgccagctacaccagcagtgaagatgctgtgtgtggcggcagcctgcccaacaccccagagggcaacttcaccagccctggctatgatggagtgaggaactacagcaggaacctgaactgtgagtggaccctgagcaaccccaaccagggcaacagcagcatcagcatccactttgaggacttctacctggagagccaccaggactgccagtttgatgtgctggagttccgggtgggagatgctgatggccccctgatgtggaggctgtgtggccccagcaagcccaccctgcccctggtgatcccctacagccaggtgtggatccactttgtgaccaatgaaagagtggagcacatcggcttccacgccaagtacagcttcacagactgtggcggcatccagatcggggacagcggggtcatcaccagccccaactacccaaatgcctatgacagcctgacccactgcagcagcctgctggaggccccccagggccacaccatcaccctgaccttcagtgactttgacatcgagccccacaccacctgtgcctgggacagcgtgacagtgagaaatggaggcagccctgagagccccatcatcggccagtactgcggcaacagcaaccccaggaccatccagagcggcagcaaccagctggtggtgaccttcaacagcgaccacagcctgcagggcggcggcttctacgccacctggaacacccagaccctgggctgcggcggcatcttccacagcgacaatggcaccatccgcagcccccactggccccagaacttccctgagaacagccgctgctcctggacagccatcacccacaagagcaagcacctggagatcagctttgacaacaacttcctgatccccagcggagatggccagtgccagaacagctttgtgaaggtgtgggccggcacagaggaggtggacaaggccctgctggccaccggctgtggaaatgtggcccctggccctgtgatcacccccagcaacaccttcaccgctgtgttccagagccaggaggccccagcccagggcttcagcgccagctttgtgagccgctgtggcagcaacttcaccggccccagcggctacatcatcagccccaactaccccaagcagtatgacaacaacatgaactgcacctacgtgattgaggccaaccccctgtctgtggtgctgctgacctttgtgtccttccacctggaggcccggtctgctgtgacaggcagctgtgtgaatgatggagtgcacatcatccggggctacagcgtgatgagcaccccatttgccaccgtgtgtggagatgagatgcctgcccccctgaccatcgccggccctgtgctgctgaacttctacagcaatgagcagatcacagactttggcttcaagttctcctaccgcatcatcagctgtggcggcgtcttcaacttcagcagcggcatcatcaccagccctgcctacagctatgctgactacccaaatgacatgcactgcctgtacaccatcaccgtgtctgatgacaaggtgattgagctgaagttcagtgactttgatgtggtgcccagcaccagctgcagccatgactacctggccatctatgatggagccaacaccagtgaccccctgctgggcaagttctgtggcagcaagaggcctcccaacgtgaagagcagcaacaacagcatgctgctggtgttcaagacagacagcttccagacagccaagggctggaagatgtccttccggcagaccctgggcccccagcagggctgcggcggctacctgaccggcagcaacaacacctttgccagcccagacagcgacagcaatggcatgtatgacaagaacctgaactgtgtgtggatcatcatcgcccctgtgaacaaggtgatccacctgaccttcaacacctttgccctggaggccgccagcacccggcagcgctgcctgtatgactatgtgaagctgtatgatggagacagtgaaaatgccaacctggccggcaccttctgtggcagcacagtgcctgcccccttcatcagcagcggcaacttcctgactgtgcagttcatcagtgacctgaccctggagcgggagggcttcaatgccacctacaccatcatggacatgccctgtggcggcacctacaatgccacctggaccccccagaacatcagcagccccaacagcagtgaccctgatgtgcccttcagcatctgcacctgggtgattgacagccccccccaccagcaggtgaagatcaccgtgtgggccctgcagctgaccagccaggactgcacccagaactacctgcagctgcaggacagcccccagggccacggcaacagccgcttccagttctgtggcagaaatgccagcgctgtgcctgtgttctacagctccatgagcacagccatggtgatcttcaagtctggagtggtgaacagaaacagcaggatgtccttcacctaccagattgctgactgcaacagagactaccacaaggcctttggaaacctgcggagccctggctggccagacaactatgacaatgacaaggactgcaccgtgaccctgacagccccccagaaccacaccatcagcctcttcttccacagcctgggcattgaaaattctgtggagtgcagaaatgacttcctggaggtgagaaatggcagcaacagcaacagccccctgctgggcaagtactgcggcaccctgctgcccaaccctgtgttcagccagaacaatgagctgtacctgcgcttcaagagtgacagcgtgaccagtgaccggggctatgagatcatctggaccagcagccccagcggctgcggcggcaccctgtatggagaccggggcagcttcaccagccctggctacccaggcacctaccccaacaacacctactgtgagtgggtgctggtggccccagctggccgcctggtgaccatcaacttctacttcatcagcattgatgatcctggggactgtgtgcagaactacctgaccctgtatgatggccccaatgccagcagccccagcagcggcccctactgcggcggggacaccagcatcgccccctttgtggccagcagcaaccaggtgttcatcaagttccacgccgactatgcccggcggcccagcgccttccggctgacctgggacagctag

SEQ ID NO: 148723 - DNA, 318 bp, Artificial Sequence
  Description of Artificial Sequence: Synthetic coding sequence
aacagcaagctggtggacctggagaggaagttccagggcctgcagcagacagtggacaagaaggtgtgcagcagcaacccctgccagaatggaggcacctgcctgaacctgcatgacagcttcttctgcatctgccccccccagtggaagggccccctgtgcagcgcagatgtgaatgaatgtgagatctacagcggcacccccctgagctgccagaatggaggcacctgtgtgaacaccatgggcagctacagaaacccctgcagcaacatccccaaggagcctgaggagggcagccgggactggcaccgggagtag

SEQ ID NO: 148724 - DNA, 267 bp, Artificial Sequence
  Description of Artificial Sequence: Synthetic coding sequence
agcactggaaatgagctggccatccgcttcaagacagacctgagcatcaatggccggggcttcaatgcctcctggcaggccgtgactggaggctgcggcggcatcttccaggcccccagcggggagatccacagccccaactaccccagcccctaccgcagcaacacagactgctcctgggtgatccgggtggacaggaaccaccgggtgctgctgaacttcacagactttgacctggagccccaggacagctgcatcatggtgtag

SEQ ID NO: 148725 - DNA, 1395 bp, Artificial Sequence
  Description of Artificial Sequence: Synthetic coding sequence
atgagccacagctggaatgtgctgtggctgaccttctgcagcgacagcaatggcatgtatgacaagaacctgaactgtgtgtggatcatcatcgcccctgtgaacaaggtgatccacctgaccttcaacacctttgccctggaggccgccagcacccggcagcgctgcctgtatgactatgtgaagctgtatgatggagacagtgaaaatgccaacctggccggcaccttctgtggcagcacagtgcctgcccccttcatcagcagcggcaacttcctgactgtgcagttcatcagtgacctgaccctggagcgggagggcttcaatgccacctacaccatcatggacatgccctgtggcggcacctacaatgccacctggaccccccagaacatcagcagccccaacagcagtgaccctgatgtgcccttcagcatctgcacctgggtgattgacagccccccccaccagcaggtgaagatcaccgtgtgggccctgcagctgaccagccaggactgcacccagaactacctgcagctgcaggacagcccccagggccacggcaacagccgcttccagttctgtggcagaaatgccagcgctgtgcctgtgttctacagctccatgagcacagccatggtgatcttcaagagcggcgtggtgaacagaaacagcaggatgtccttcacctaccagattgctgactgcaacagagactaccacaaggccttcggcaacctgcggagccctggctggccagacaactatgacaatgacaaggactgcaccgtgaccctgacagccccccagaaccacaccatcagcctcttcttccacagcctgggcatcgagaacagcgtggagtgcagaaatgacttcctggaggtgagaaatggcagcaacagcaacagccccctgctgggcaagtactgcggcaccctgctgcccaaccctgtgttcagccagaacaatgagctgtacctgcgcttcaagagtgacagcgtgaccagtgaccggggctatgagatcatctggaccagcagccccagcggctgcggcggcaccctgtatggagaccggggcagcttcaccagccctggctacccaggcacctaccccaacaacacctactgtgagtgggtgctggtggccccagctggccgcctggtgaccatcaacttctacttcatcagcattgatgaccccggggactgtgtgcagaactacctgaccctgtatgatggccccaatgccagcagccccagcagcggcccctactgcggcggggacaccagcatcgccccctttgtggccagcagcaaccaggtgttcatcaagttccacgccgactatgcccggcggcccagcgccttccggctgacctgggacagctag

SEQ ID NO: 148726 - DNA, 864 bp, Artificial Sequence
  Description of Artificial Sequence: Synthetic coding sequence
atggagctggagcgcatcgtgtctgctgccctgctggcctttgtgcagacccacctgcctgaggccgacctgagcggcctggatgaggtgatcttctcctatgtgctgggcgtgctggaggacctgggccccagcggccccagcgaggagaactttgacatggaggccttcacagagatgatggaggcctacgtgcccggctttgcccacatcccccggggcaccatcggggacatgatgcagaagctgagcggccagctgagtgatgccaggaacaaggagaacctgcagccccagagcagtggagtgcagggccaggtgcccatcagccctgagcccctgcagaggcctgagatgctgaaggaggagaccaggagcagcgctgctgctgctgctgacacccaggatgaggccactggagctgaggaggagctgctgcccggggtggatgtgctgctggaggtgttccccacctgcagcgtggagcaggcccagtgggtgctggccaaggcccggggggacctggaggaggccgtgcagatgctggtggagggcaaggaggagggccctgctgcctgggagggccccaaccaggacctgccccggcggctgcggggcccccagaaggatgagctgaagagcttcatcctgcagaagtacatgatggtggacagcgctgaggaccagaagatccaccggcccatggcccccaaggaggcccccaagaagctgatccgctacatcgacaaccaggtggtgtccaccaagggggagcgcttcaaggatgtgaggaaccctgaggccgaggagatgaaggccacctacatcaacctgaagccagccaggaagtaccgcttccactag

SEQ ID NO: 148727 - DNA, 1365 bp, Artificial Sequence
  Description of Artificial Sequence: Synthetic coding sequence
atggctgctgcccctgggggcagcgcccagcctgctggccctggcccccggctgggcttcagcacagctgacagcggcgtgggcatgagcggcctgaaccctggccctgctgtgcccatgaaggaccatgatgccatcaagctgtttgtgggccagatcccccggggcctggatgagcaggacctgaagcccctgtttgaggagtttggccgcatctatgagctgactgtgctgaaggaccggctgaccggcctgcacaagggctgtgccttcctgacctactgtgcccgggacagcgccctgaaggcccagagcgccctgcacgagcagaagaccctgcccggcatgaaccggcccatccaggtgaagccagctgccagcgagggccgcggggaggacaggaagctgtttgtgggcatgctgggcaagcagcagggcgaggaggatgtgagaagactcttccagcccttcggccacatcgaggagtgcaccgtgctgcggagcccagatggcaccagcaagggctgtgcctttgtgaagtttggcagccagggcgaggcccaggccgccatccggggcctgcacggcagcaggaccatggccggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgctgccaacagccccccaggcagcggccctggcaccctgcccggcctgcctgcccccatcggcgtgaatggcttcggccccctgaccccccagaccaacggccagcccggcagtgacaccctgtacaacaacggcctgagcccctacccagcccagagccctggggtggccgaccccctgcagcaggcctatgccggcatgcaccactacgccggccctgagggctgcaacctcttcatctaccacctgccccaggagtttggagatgctgagctgatccagaccttcctgccctttggagctgtggtgtctgccaaggtgtttgtggaccgggccaccaaccagagcaagtgcttcggctttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 148728 - DNA, 1398 bp, Artificial Sequence
  Description of Artificial Sequence: Synthetic coding sequence
atgaaggagccagatgccatcaagctgtttgtgggccagatccccaggcacctggaggagaaggacctgaagcccatctttgagcagtttggccgcatctttgagctgaccgtcatcaaggacaagtacacaggcctgcacaagggctgtgccttcctgacctactgtgcccgggacagcgccctgaaggcccagagcgccctgcacgagcagaagaccctgcccggcatgaaccggcccatccaggtgaagccagctgacagcgagagcagaggagaggacaggaagctgtttgtgggcatgctgggcaagcagcagacagatgaagatgtgaggaagatgtttgagcccttcggcaccattgatgaatgtactgtgctgcggggcccagatggcaccagcaagggctgtgcctttgtgaagttccagacccacgccgaggcccaggccgccatcaacaccctgcacagcagcaggaccctgcccggggccagcagcagcctggtggtgaagtttgctgacacagagaaggagcggggcctgcggaggatgcagcaggtggccacccagctgggcatgttcagccccatcgccctgcagtttggagcctacagcgcctacacccaggccctgatgcagcagcaggccgccctggtggccgcccacagcgcctacctgagccccatggccaccatggctgctgtgcagatgcagcacatggccgccatcaatgccaacggcctgattgccacccccatcacccccagcagcggcaccagcaccccaccagccatcgccgccacccctgtgtctgccatcccagctgccctgggcgtgaatggctacagccctgtgcccacccagcccaccggccagcctgccccagatgccctgtacccaaatggagtgcacccctacccagcccagagccctgctgcccctgtggaccccctgcagcaggcctatgccggcatgcagcactacacagctgcctacccagctgcctacagcctggtggccccagccttcccccagcccccagccctggtggcccagcagcccccacctccaccccagcagcagcagcagcagcagcagcagcagcagcagcagcagcagcgggagggcccagatggctgcaacatcttcatctaccacctgccccaggagttcacagacagcgagatcctgcagatgtttgtgccctttggacatgtgatcagcgccaaggtgtttgtggaccgggccaccaaccagagcaaatgttttggatttgtgtcctttgacaacccagccagcgcccaggccgccatccaggccatgaatggcttccagatcggcatgaagaggctgaaggtgcagctgaagaggcccaaggatgccaaccggccctactag

SEQ ID NO: 148729 - DNA, 1248 bp, Artificial Sequence
  Description of Artificial Sequence: Synthetic coding sequence
atgaaggagccagatgccatcaagctgtttgtgggccagatccccaggcacctggaggagaaggacctgaagcccatctttgagcagtttggccgcatctttgagctgaccgtcatcaaggacaagtacacaggcctgcacaagggctgtgccttcctgacctactgtgcccgggacagcgccctgaaggcccagagcgccctgcacgagcagaagaccctgcccggcatgaaccggcccatccaggtgaagccagctgacagcgagagcagaggagaggacaggaagctgtttgtgggcatgctgggcaagcagcagacagatgaagatgtgaggaagatgtttgagcccttcggcaccattgatgaatgtactgtgctgcggggcccagatggcaccagcaagggctgtgcctttgtgaagttccagacccacgccgaggcccaggccgccatcaacaccctgcacagcagcaggaccctgcccggggccagcagcagcctggtggtgaagtttgctgacacagagaaggagcggggcctgcggaggatgcagcaggtggccacccagctgggcatgttcagccccatcgccctgcagtttggagcctacagcgcctacacccaggccctgatgcagcagcaggccgccctggtggccgcccacagcgcctacctgagccccatggccaccatggctgctgtgcagatgcagcacatggccgccatcaatgccaacggcctgattgccacccccatcacccccagcagcgcccagagccctgctgcccctgtggaccccctgcagcaggcctatgccggcatgcagcactacacagctgcctacccagctgcctacagcctggtggccccagccttcccccagcccccagccctggtggcccagcagcccccacctccaccccagcagcagcagcagcagcagcagcagcagcagcagcagcagcagcgggagggcccagatggctgcaacatcttcatctaccacctgccccaggagttcacagacagcgagatcctgcagatgtttgtgccctttggacatgtgatcagcgccaaggtgtttgtggaccgggccaccaaccagagcaaatgttttggatttgtgtcctttgacaacccagccagcgcccaggccgccatccaggccatgaatggcttccagatcggcatgaagaggctgaaggtgcagctgaagaggcccaaggatgccaaccggccctactag

SEQ ID NO: 148730 - DNA, 900 bp, Artificial Sequence
  Description of Artificial Sequence: Synthetic coding sequence
atgaaggagccagatgccatcaagctgtttgtgggccagatccccaggcacctggaggagaaggacctgaagcccatctttgagcagtttggccgcatctttgagctgaccgtcatcaaggacaagtacacaggcctgcacaagggctgtgccttcctgacctactgtgcccgggacagcgccctgaaggcccagagcgccctgcacgagcagaagaccctgcccggcatgaaccggcccatccaggtgaagccagctgacagcgagagcagaggagacaggaagctgtttgtgggcatgctgggcaagcagcagacagatgaagatgtgaggaagatgtttgagcccttcggcaccattgatgagtgcaccgtgctgcggggcccagatggcaccagcaagggctgtgcctttgtgaagttccagacccatgctgaggcccaggccgccatcaacaccctgcacagcagcaggaccctgcccggggccagcagcagcctggtggtgaagtttgctgacacagagaaggagcggggcctgcggaggatgcagcaggtggccacccagctgggcatgttcagccccatcgccctgcagtttggagcctacagcgcctacacccaggccctgatgcagcagcaggccgccctggtggccgcccacagcgcctacctgagccccatggccaccatggctgctgtgcagatgcagcacatggccgccatcaatgccaacggcctcatcgccacccccatcacccccagcagcgccaagggccacggctacgccagcctggccccccgggcccacttcctgctggatgccctgctggcctttgtgcgggagcggggcaccggcagcaaggcccctggctacctgcccagcgctggcctgctgtag

SEQ ID NO: 148731 - DNA, 783 bp, Artificial Sequence
  Description of Artificial Sequence: Synthetic coding sequence
atgcagcaggtggccacccagctgggcatgttcagccccatcgccctgcagtttggagcctacagcgcctacacccaggccctgatgcagcagcaggccgccctggtggccgcccacagcgcctacctgagccccatggccaccatggctgctgtgcagatgcagcacatggccgccatcaatgccaacggcctcatcgccacccccatcacccccagcagcggcaccagcaccccaccagccatcgccgccacccctgtgtctgccatcccagctgccctgggcgtgaatggctacagccctgtgcccacccagcccaccggccagcctgccccagatgccctgtaccccaacggggtgcacccctacccagctgcctacccagctgcctacagcctggtggccccagccttcccccagcccccagccctggtggcccagcagcccccacctccaccccagcagcagcagcagcagcagcagcagcagcagcagcagcagcagcgggagggcccagatggctgcaacatcttcatctaccacctgccccaggagttcacagattctgagatcctgcagatgtttgtgcccttcggccacgtgatcagcgccaaggtgtttgtggaccgggccaccaaccagagcaagtgcttcggctttgtgtcctttgacaacccagccagcgcccaggccgccatccaggccatgaatggcttccagatcggcatgaagaggctgaaggtgcagctgaagaggcccaaggatgccaaccggccctactag

SEQ ID NO: 148732 - DNA, 1401 bp, Artificial Sequence
  Description of Artificial Sequence: Synthetic coding sequence
tgagtggaggagagcgctgctggggagcagagcagcggcacccagatccccaggcacctggaggagaaggacctgaagcccatctttgagcagtttggccgcatctttgagctgaccgtcatcaaggacaagtacacaggcctgcacaagggctgtgccttcctgacctactgtgcccgggacagcgccctgaaggcccagagcgccctgcacgagcagaagaccctgcccggcatgaaccggcccatccaggtgaagccagctgacagcgagagcagaggagacaggaagctgtttgtgggcatgctgggcaagcagcagacagatgaagatgtgaggaagatgtttgagcccttcggcaccattgatgagtgcaccgtgctgcggggcccagatggcaccagcaagggctgtgcctttgtgaagttccagacccatgctgaggcccaggccgccatcaacaccctgcacagcagcaggaccctgcccggggccagcagcagcctggtggtgaagtttgctgacacagagaaggagcggggcctgcggaggatgcagcaggtggccacccagctgggcatgttcagccccatcgccctgcagtttggagcctacagcgcctacacccaggccctgatgcagcagcaggccgccctggtggccgcccacagcgcctacctgagccccatggccaccatggctgctgtgcagatgcagcacatggccgccatcaatgccaacggcctcatcgccacccccatcacccccagcagcggcaccagcaccccaccagccatcgccgccacccctgtgtctgccatcccagctgccctgggcgtgaatggctacagccctgtgcccacccagcccaccggccagcctgccccagatgccctgtaccccaacggggtgcacccctacccagcccagagccctgctgcccctgtggaccccctgcagcaggcctatgccggcatgcagcactacacagctgcctacccagctgcctacagcctggtggccccagccttcccccagcccccagccctggtggcccagcagcccccacctccaccccagcagcagcagcagcagcagcagcagcagcagcagcagcagcagcgggagggcccagatggctgcaacatcttcatctaccacctgccccaggagttcacagattctgagatcctgcagatgtttgtgcccttcggccacgtgatcagcgccaaggtgtttgtggaccgggccaccaaccagagcaagtgcttcggctttgtgtcctttgacaacccagccagcgcccaggccgccatccaggccatgaatggcttccagatcggcatgaagaggctgaaggtgcagctgaagaggcccaaggatgccaaccggccctactag

SEQ ID NO: 148733 - DNA, 1347 bp, Artificial Sequence
  Description of Artificial Sequence: Synthetic coding sequence
atgtacatcaagatggccaccctggccaacggccaggccgacaatgccagcctgagcaccaacggcctgggcagcagccctggcagcgctggccacatgaatggcctgagccacagccctggcaaccccagcaccatccccatgaaggaccatgatgccatcaagctgttcatcggccagatccccaggaacctggatgagaaggacctgaagcccctgtttgaggagtttgggaagatctatgagctgactgtgctgaaggaccgcttcaccggcatgcacaagggctgtgccttcctgacctactgtgagcgggagagcgccctgaaggcccagagcgccctgcacgagcagaagaccctgcccggcatgaaccggcccatccaggtgaagccagctgacagcgagagcagaggagaggacaggaagctgtttgtgggcatgctgaacaagcagcagagtgaagatgatgtgagaagactctttgaggcctttggaaacatcgaggagtgcaccatcctgcggggcccagatggcaacagcaagggctgtgcctttgtgaagtacagcagccatgctgaggcccaggccgccatcaatgccctgcacggcagccagaccatgcctggggccagcagcagcctggtggtgaagtttgctgacacagacaaggagaggaccatgaggaggatgcagcagatggccggccagatgggcatgttcaaccccatggccatcccctttggagcctatggagcctatgcccaggccctgatgcagcagcaggccgccctgatggcctctgtggcccagggcggctacctgaaccccatggccgcctttgctgctgcccagatgcagcagatggccgccctgaacatgaatggcctggccgccgcccccatgacccccaccagcggcggcagcaccccacctggcatcacagccccagctgtgcccagcatccccagccccatcggcgtgaatggcttcaccggcctgcccccccaggccaacggccagcctgctgctgaggccgtgtttgccaacggcatccacccctacccagcccagagccccacagctgctgaccccctgcagcaggcctatgccggcgtgcagcagtatgccggccctgctgcctacccagctgcctacggccagatcagccaggccttcccccagcccccacccatgatcccccagcagcagcgggagggctttgtgtcctttgacaacccagccagcgcccagacagccatccaggccatgaatggcttccagatcggcatgaagaggctgaaggtgcagctgaagaggcccaaggatgccaaccggccctactag

SEQ ID NO: 148734 - DNA, 639 bp, Artificial Sequence
  Description of Artificial Sequence: Synthetic coding sequence
gtgtctgctgagggccctgagagagctgcccgggcagaagattctgccagagatgagcctgctgaccctggagaggcctgtggccagcgggagcccaaggacaggaagctgtttgtgggcatgctgaacaagcagcagagtgaagatgatgtgcggcggctgtttgaggccttcggcaacattgaagaatgtaccatcctgcggggcccagatggcaacagcaagggctgtgcctttgtgaagtacagcagccacgccgaggcccaggccgccatcaatgccctgcacggcagccagaccatgcctggggccagcagcagcctggtggtgaagtttgctgacacagacaaggagaggaccatgaggaggatgcagcagatggccggccagatgggcatgttcaaccccatggccatcccctttggagcctacggggcctatgcccaggccctgatgcagcagcaggccgccctgatggcctctgtggcccagggcggctacctgaaccccatggccgcctttgctgctgcccagatgcagcagatggccgccctgaacatgtggccaggcggccgcacctatgaccccaacctgcgctggcagcaccccagcggccaccactgcaccagccgggcctag

SEQ ID NO: 148735 - DNA, 1461 bp, Artificial Sequence
  Description of Artificial Sequence: Synthetic coding sequence
atgtacatcaagatggccaccctggccaacggccaggccgacaatgccagcctgagcaccaacggcctgggcagcagccctggcagcgctggccacatgaatggcctgagccacagccctggcaaccccagcaccatccccatgaaggaccatgatgccatcaagctgttcatcggccagatccccaggaacctggatgagaaggacctgaagcccctgtttgaggagtttgggaagatctatgagctgactgtgctgaaggaccgcttcaccggcatgcacaagggctgtgccttcctgacctactgtgagcgggagagcgccctgaaggcccagagcgccctgcacgagcagaagaccctgcccggcatgaaccggcccatccaggtgaagccagctgacagcgagagcagaggaggcagcagctgcctgcggcagccccccagccaggacaggaagctgtttgtgggcatgctgaacaagcagcagagtgaagatgatgtgagaagactctttgaggcctttggaaacatcgaggagtgcaccatcctgcggggcccagatggcaacagcaagggctgtgcctttgtgaagtacagcagccatgctgaggcccaggccgccatcaatgccctgcacggcagccagaccatgcctggggccagcagcagcctggtggtgaagtttgctgacacagacaaggagaggaccatgaggaggatgcagcagatggccggccagatgggcatgttcaaccccatggccatcccctttggagcctatggagcctatgcccaggccctgatgcagcagcaggccgccctgatggcctctgtggcccagggcggctacctgaaccccatggccgcctttgctgctgcccagatgcagcagatggccgccctgaacatgaatggcctggccgccgcccccatgacccccaccagcggcggcagcaccccacctggcatcacagccccagctgtgcccagcatccccagccccatcggcgtgaatggcttcaccggcctgcccccccaggccaacggccagcctgctgctgaggccgtgtttgccaacggcatccacccctacccagcccagagccccacagctgctgaccccctgcagcaggcctatgccggcgtgcagcagtatgccggccctgctgcctacccagctgcctacggccagatcagccaggccttcccccagcccccacccatgatcccccagcagcagcgggagggccctgagggctgcaacctcttcatctaccacctgccccaggagtttggagatgctgagctgatgcagatgttcctgcccttcggctttgtgtcctttgacaacccagccagcgcccagacagccatccaggccatgaatggcttccagatcggcatgaagaggctgaaggtgcagctgaagaggcccaaggatgccaaccggccctactag

SEQ ID NO: 148736 - DNA, 1458 bp, Artificial Sequence
  Description of Artificial Sequence: Synthetic coding sequence
atgtacatcaagatggccaccctggccaacggccaggccgacaatgccagcctgagcaccaacggcctgggcagcagccctggcagcgctggccacatgaatggcctgagccacagccctggcaaccccagcaccatccccatgaaggaccatgatgccatcaagctgttcatcggccagatccccaggaacctggatgagaaggacctgaagcccctgtttgaggagtttgggaagatctatgagctgactgtgctgaaggaccgcttcaccggcatgcacaagggctgtgccttcctgacctactgtgagcgggagagcgccctgaaggcccagagcgccctgcacgagcagaagaccctgcccggcatgaaccggcccatccaggtgaagccagctgacagcgagagcagaggaggcagcagctgcctgcggcagccccccagccaggacaggaagctgtttgtgggcatgctgaacaagcagcagagtgaagatgatgtgagaagactctttgaggcctttggaaacatcgaggagtgcaccatcctgcggggcccagatggcaacagcaagggctgtgcctttgtgaagtacagcagccatgctgaggcccaggccgccatcaatgccctgcacggcagccagaccatgcctggggccagcagcagcctggtggtgaagtttgctgacacagacaaggagaggaccatgaggaggatgcagcagatggccggccagatgggcatgttcaaccccatggccatcccctttggagcctatggagcctatgcccaggccatgcagcagcaggccgccctgatggcctctgtggcccagggcggctacctgaaccccatggccgcctttgctgctgcccagatgcagcagatggccgccctgaacatgaatggcctggccgccgcccccatgacccccaccagcggcggcagcaccccacctggcatcacagccccagctgtgcccagcatccccagccccatcggcgtgaatggcttcaccggcctgcccccccaggccaacggccagcctgctgctgaggccgtgtttgccaacggcatccacccctacccagcccagagccccacagctgctgaccccctgcagcaggcctatgctggggtgcagcagtatgccggccctgctgcctacccagctgcctacggccagatcagccaggccttcccccagcccccacccatgatcccccagcagcagcgggagggccctgagggctgcaacctcttcatctaccacctgccccaggagtttggagatgctgagctgatgcagatgttcctgccctttggatttgtgtcctttgacaacccagccagcgcccagacagccatccaggccatgaatggcttccagatcggcatgaagaggctgaaggtgcagctgaagaggcccaaggatgccaaccggccctactag

SEQ ID NO: 148737 - DNA, 1455 bp, Artificial Sequence
  Description of Artificial Sequence: Synthetic coding sequence
atgtacatcaagatggccaccctggccaacggccaggccgacaatgccagcctgagcaccaacggcctgggcagcagccctggcagcgctggccacatgaatggcctgagccacagccctggcaaccccagcaccatccccatgaaggaccatgatgccatcaagctgttcatcggccagatccccaggaacctggatgagaaggacctgaagcccctgtttgaggagtttgggaagatctatgagctgactgtgctgaaggaccgcttcaccggcatgcacaagggctgtgccttcctgacctactgtgagcgggagagcgccctgaaggcccagagcgccctgcacgagcagaagaccctgcccggcatgaaccggcccatccaggtgaagccagctgacagcgagagcagaggaggcagcagctgcctgcggcagccccccagccacaggaagctgtttgtgggcatgctgaacaagcagcagagtgaagatgatgtgcggcggctgtttgaggccttcggcaacattgaagaatgtaccatcctgcggggcccagatggcaacagcaagggctgtgcctttgtgaagtacagcagccacgccgaggcccaggccgccatcaatgccctgcacggcagccagaccatgcctggggccagcagcagcctggtggtgaagtttgctgacacagacaaggagaggaccatgaggaggatgcagcagatggccggccagatgggcatgttcaaccccatggccatcccctttggagcctacggggcctatgcccaggccatgcagcagcaggccgccctgatggcctctgtggcccagggcggctacctgaaccccatggccgcctttgctgctgcccagatgcagcagatggccgccctgaacatgaatggcctggccgccgcccccatgacccccaccagcggcggcagcaccccacctggcatcacagccccagctgtgcccagcatccccagccccatcggcgtgaatggcttcaccggcctgcccccccaggccaacggccagcctgctgctgaggccgtgtttgccaacggcatccacccctacccagcccagagccccacagctgctgaccccctgcagcaggcctatgccggcgtgcagcagtatgccggccctgctgcctacccagctgcctacggccagatcagccaggccttcccccagcccccacccatgatcccccagcagcagcgggagggccctgagggctgcaacctcttcatctaccacctgccccaggagtttggagatgctgagctgatgcagatgttcctgcccttcggctttgtgtcctttgacaacccagccagcgcccagacagccatccaggccatgaatggcttccagatcggcatgaagaggctgaaggtgcagctgaagaggcccaaggatgccaaccggccctactag

SEQ ID NO: 148738 - DNA, 1458 bp, Artificial Sequence
  Description of Artificial Sequence: Synthetic coding sequence
atggcccggctgacagaaagtgaggcccggcggcagcagcagcagctgctgcagccccggcccagccctgtgggcagcagcggccctgagcccccaggcggccagccagatggcatgaaggacctggatgccatcaagctgtttgtgggccagatccccaggcacctggatgagaaggacctgaagcccctgtttgagcagtttggccgcatctatgagctgactgtgctgaaggacccctacacaggcatgcacaagggctgtgccttcctgacctactgtgcccgggacagcgccatcaaggcccagacagccctgcacgagcagaagaccctgcccggcatggcccggcccatccaggtgaagccagctgacagcgagagccggggcggccgggacaggaagctgtttgtgggcatgctgaacaagcagcagagcgaggaggatgtgctgcggctcttccagccctttggagtgattgatgagtgcaccgtgctgcggggcccagatggcagcagcaagggctgtgcctttgtgaagttcagcagccacacagaggcccaggccgccatccacgccctgcacggcagccagaccatgcctggggccagcagcagcctggtggtgaagtttgctgacacagacaaggagaggaccctgcggaggatgcagcagatggtgggccagctgggcatcctgacccccagcctgaccctgcccttcagcccctacagcgcctatgcccaggccctgatgcagcagcagaccaccgtgctgagcaccagcggcagctacctgagccctggggtggccttcagcccctgccacatccagcagatcggggctgtgtccctgaatggcctgcctgccacccccatcgccccagccagcggcctgcacagcccccccctgctgggcaccacagctgtgcccggcctggtggcccccatcaccaatggatttgctggggtggtgcccttccctgggggccacccagccctggagaccgtgtatgccaacggcctggtgccctacccagcccagagccccaccgtggccgagaccctgcacccagccttctctggagtgcagcagtacacagccatgtaccccacagctgccatcacccccatcgcccacagcgtgccccagcccccacccctgctgcagcagcagcagcgggagggccctgagggctgcaacctcttcatctaccacctgccccaggagtttggagacacagagctgacccagatgttcctgccctttggaaacatcatcagcagcaaggtgttcatggaccgggccaccaaccagagcaaatgttttggatttgtgtcctttgacaacccagccagcgcccaggccgccatccaggccatgaatggcttccagatcggcatgaagaggctgaaggtgcagctgaagaggcccaaggaccccggccacccctactag

SEQ ID NO: 148739 - DNA, 963 bp, Artificial Sequence
  Description of Artificial Sequence: Synthetic coding sequence
atggcccggcccatccaggtgaagccagctgacagcgagagccggggcggccgggacaggaagctgtttgtgggcatgctgaacaagcagcagagcgaggaggatgtgctgcggctcttccagccctttggagtgattgatgagtgcaccgtgctgcggggcccagatggcagcagcaagggctgtgcctttgtgaagttcagcagccacacagaggcccaggccgccatccacgccctgcacggcagccagaccatgcctggggccagcagcagcctggtggtgaagtttgctgacacagacaaggagaggaccctgcggaggatgcagcagatggtgggccagctgggcatcctgacccccagcctgaccctgcccttcagcccctacagcgcctatgcccaggccctgatgcagcagcagaccaccgtgctgagcaccagcggcagctacctgagccctggggtggccttcagcccctgccacatccagcagatcggggctgtgtccctgaatggcctgcctgccacccccatcgccccagccagcggcctgcacagcccccccctgctgggcaccacagctgtgcccggcctggtggcccccatcaccaatggatttgctggggtggtgcccttccctgggggccacccagccctggagaccgtgtatgccaacggcctggtgccctacccagcccagagccccaccgtggccgagaccctgcacccagccttctctggagtgcagcagtacacagccatgtaccccacagctgccatcacccccatcgcccacagcgtgccccagcccccacccctgctgcagcagcagcagcgggagggcgtgtggaggcatggagcagatgctgatgtgcccaccctgcggcagtaccacttcctgcagggcgtgtatggcagcagctaccagcctgagcaggtgttccggctgcgggagctgtag

SEQ ID NO: 148740 - DNA, 1230 bp, Artificial Sequence
  Description of Artificial Sequence: Synthetic coding sequence
atggcccggctgacagaaagtgaggcccggcggcagcagcagcagctgctgcagccccggcccagccctgtgggcagcagcggccctgagcccccaggcggccagccagatggcatgaaggacctggatgccatcaagctgtttgtgggccagatccccaggcacctggatgagaaggacctgaagcccctgtttgagcagtttggccgcatctatgagctgactgtgctgaaggacccctacacaggcatgcacaagggctgtgccttcctgacctactgtgcccgggacagcgccatcaaggcccagacagccctgcacgagcagaagaccctgcccggcatggcccggcccatccaggtgaagccagctgacagcgagagccggggcggccgggacaggaagctgtttgtgggcatgctgaacaagcagcagagcgaggaggatgtgctgcggctcttccagccctttggagtgattgatgagtgcaccgtgctgcggggcccagatggcagcagcaagggctgtgcctttgtgaagttcagcagccacacagaggcccaggccgccatccacgccctgcacggcagccagaccatgcctggggccagcagcagcctggtggtgaagtttgctgacacagacaaggagaggaccctgcggaggatgcagcagatggtgggccagctgggcatcctgacccccagcctgaccctgcccttcagcccctacagcgcctatgcccaggccctgatgcagcagcagaccaccgtgctgagcaccagcggcagctacctgagccctggggtggccttcagcccctgccacatccagcagatcggggctgtgtccctgaatggcctgcctgccacccccatcgccccagccagcggcgtggtgcccttccctgggggccacccagccctggagaccgtgtatgccaacggcctggtgccctacccagcccagagccccaccgtggccgagaccctgcacccagccttcagcggcgtgcagcagtacacagccatgtaccccacagctgccatcacccccatcgcccacagcgtgccccagcccccacccctgctgcagcagcagcagcgggagggcgtgtggaggcatggagcagatgctgatgtgcccaccctgcggcagtaccacttcctgcagggcgtgtatggcagcagctaccagcctgagcaggtgttccggctgcgggagctgtag

SEQ ID NO: 148741 - DNA, 1446 bp, Artificial Sequence
  Description of Artificial Sequence: Synthetic coding sequence
atggctgctgcccctgggggcagcgcccagcctgctggccctggcccccggctgggcttcagcacagctgacagcggcgtgggcatgagcggcctgaaccctggccctgctgtgcccatgaaggaccatgatgccatcaagctgtttgtgggccagatcccccggggcctggatgagcaggacctgaagcccctgtttgaggagtttggccgcatctatgagctgactgtgctgaaggaccggctgaccggcctgcacaagggctgtgccttcctgacctactgtgcccgggacagcgccctgaaggcccagagcgccctgcacgagcagaagaccctgcccggcatgaaccggcccatccaggtgaagccagctgccagcgagggccgcggggaggacaggaagctgtttgtgggcatgctgggcaagcagcagggcgaggaggatgtgagaagactcttccagcccttcggccacatcgaggagtgcaccgtgctgcggagcccagatggcaccagcaagggctgtgcctttgtgaagtttggcagccagggcgaggcccaggccgccatccggggcctgcacggcagcaggaccatggccggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgctgccaacagccccccaggcagcggccctggcaccctgcccggcctgcctgcccccatcggcgtgaatggcttcggccccctgaccccccagaccaacggccagcccggcagtgacaccctgtacaacaacggcctgagcccctacccagcccagagccctggggtggccgaccccctgcagcaggcctatgccggcatgcaccactacgccgccgcctaccccagcgcctatgcccctgtgtccacagccttcccccagcagcccagcgccctgccccagcagcagcgggagggccctgagggctgcaacctcttcatctaccacctgccccaggagtttggagatgctgagctgatccagaccttcctgccctttggagctgtggtgtctgccaaggtgtttgtggaccgggccaccaaccagagcaaatgttttggatttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 148742 - DNA, 1107 bp, Artificial Sequence
  Description of Artificial Sequence: Synthetic coding sequence
atgatcagtgacccccccagcaacaacagctggaacagcgtgctgtacctgctggaggacaggaagctgtttgtgggcatgctgggcaagcagcagggcgaggaggatgtgcggcggctcttccagcccttcggccacattgaagaatgtactgtgctgcggagcccagatggcaccagcaagggctgtgcctttgtgaagtttggcagccagggcgaggcccaggccgccatccggggcctgcacggcagcaggaccatggccggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgctgccaacagccccccaggcagcggccctggcaccctgcccggcctgcctgcccccatcggcgtgaatggatttggccccctgaccccccagaccaacggccagcccggcagtgacaccctgtacaacaacggcctgagcccctacccagcccagagccctggggtggccgaccccctgcagcaggcctatgccggcatgcaccactatgctgctgcctaccccagcgcctatgcccctgtgtccacagccttcccccagcagcccagcgccctgccccagcagcagcgggagggccctgagggctgcaacctcttcatctaccacctgccccaggagtttggagatgctgagctgatccagaccttcctgccctttggagctgtggtgtctgccaaggtgtttgtggaccgggccaccaaccagagcaagtgcttcggctttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 148743 - DNA, 1365 bp, Artificial Sequence; identical to SEQ ID NO: 148727
  Description of Artificial Sequence: Synthetic coding sequence

SEQ ID NO: 148744 - DNA, 1029 bp, Artificial Sequence
  Description of Artificial Sequence: Synthetic coding sequence
atgctgggcaagcagcagggcgaggaggatgtgcggcggctcttccagcccttcggccacattgaagaatgtactgtgctgcggagcccagatggcaccagcaagggctgtgcctttgtgaagtttggcagccagggcgaggcccaggccgccatccggggcctgcacggcagcaggaccatggccggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgctgccaacagccccccaggcagcggccctggcaccctgcccggcctgcctgcccccatcggcgtgaatggatttggccccctgaccccccagaccaacggccagcccggcagtgacaccctgtacaacaacggcctgagcccctacccagcccagagccctggggtggccgaccccctgcagcaggcctatgccggcatgcaccactatgctgctgcctaccccagcgcctatgcccctgtgtccacagccttcccccagcagcccagcgccctgccccagcagcagcgggagggccctgagggctgcaacctcttcatctaccacctgccccaggagtttggagatgctgagctgatccagaccttcctgccctttggagctgtggtgtctgccaaggtgtttgtggaccgggccaccaaccagagcaagtgcttcggctttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 148745 - DNA, 1035 bp, Artificial Sequence
  Description of Artificial Sequence: Synthetic coding sequence
atgaaccggcccatccaggtgaagccagctgccagcgagggcagaggagaggacaggaagctgtttgtgggcatgctgggcaagcagcagggcgaggaggatgtgcggcggctcttccagcccttcggccacattgaagaatgtactgtgctgcggagcccagatggcaccagcaagggctgtgcctttgtgaagtttggcagccagggcgaggcccaggccgccatccggggcctgcacggcagcaggaccatggccggggccagcagcagcctggtggtgaagctggccgacacagaccgggagcgggccctgcggaggatgcagcagatggccggccacctgggcgccttccacccagcccccctgcccctgggcgcctgtggggcctacaccacagccatcctgcagcaccaggccgccctgctggccgccgcccagggccctggcctgggccctgtggccgctgtggccgcccagatgcagcacgtggccgccttcagcctggtggccgcccccctgctgcctgctgctgccaacagccccccaggcagcggccctggcaccctgcccggcctgcctgcccccatcggcgtgaatggcttcggccccctgaccccccagaccaacggccagcccggcagtgacaccctgtacaacaacggcctgagcccctacccagctgcctaccccagcgcctatgcccctgtgtccacagccttcccccagcagcccagcgccctgccccagcagcagcgggagggccctgagggctgcaacctcttcatctaccacctgccccaggagtttggagatgctgagctgatccagaccttcctgccctttggagctgtggtgtctgccaaggtgtttgtggaccgggccaccaaccagagcaagtgcttcggctttgtgtcctttgacaaccccaccagcgcccagacagccatccaggccatgaatggcttccagatcggcatgaagaggctgaaggtgcagctgaagaggcccaaggatgccaaccggccctactag

SEQ ID NO: 148746 - DNA, 1980 bp, Artificial Sequence
  Description of Artificial Sequence: Synthetic coding sequence
atgctgtacaagcagctgcggcaggcctgtgaagatcatgtgcaggcccagatcctgcccttccgggaggacagcctggacagcgtgctcttcctgaagaagatcaacacctgctggcaggaccactgccggcagatgatcatgatccgcagcatcttcctgttcctggacaggacctacgtgctgcagaacagcaccctgcccagcatctgggacatgggcctggagctgttccgcacccacatcatcagtgacaagatggtgcagagcaagaccattgatggcatcctgctgctgattgaaagagagaggtctggagaggccgtggacaggagcctgctgcggagcctgctgggcatgctgagtgacctgcaggtgtacaaggacagctttgagctgaagttcctggaggagaccaactgcctgtatgctgctgagggccagaggctgatgcaggagcgggaggtgcctgagtacctgaaccacgtgtccaagaggctggaggaggagggggacagagtcatcacctacctggaccacagcacccagaagcccctgattgcctgtgtggagaagcagctgctgggggagcacctgacagccatcctgcagaagggcctggaccacctgctggatgaaaatagagtgcctgacctggcccagatgtaccagctgttcagccgggtgcggggcggccagcaggccctgctgcagcactggagcgagtacatcaagacctttggaacagccatcgtcatcaaccctgagaaggacaaggacatggtgcaggacctgctggacttcaaggacaaggtggaccacgtgattgaggtgtgcttccagaagaatgaaagatttgtgaacctgatgaaggagagctttgagaccttcatcaacaagaggcccaacaagccagctgagctgattgccaagcacgtggacagcaagctgcgggccggcaacaaggaggccacagatgaggagctggagaggaccctggacaagatcatgatcctcttccgcttcatccacggcaaggatgtgtttgaggccttctacaagaaggacctggccaagaggctgctggtgggcaagagcgcctctgtggatgctgagaagtccatgctgagcaagctgaagcatgaatgtggggccgccttcaccagcaagctggagggcatgttcaaggacatggagctgagcaaggacatcatggtgcacttcaagcagcacatgcagaaccagagcgacagcggccccatcgacctgactgtgaacatcctgaccatgggctactggcccacctacacccccatggaggtgcacctgaccccagagatgatcaagctgcaggaggtgttcaaggccttctacctgggcaagcacagcggcaggaagctgcagtggcagaccaccctgggccatgctgtgctgaaggccgagttcaaggagggcaagaaggagttccaggtgtccctcttccagaccctggtgctgctgatgtttaatgaaggagatggcttctcctttgaggagatcaagatggccactggaattgaggacagcgagctgcggaggaccctgcagagcctggcctgtgggaaggcccgggtgctgatcaagagccccaagggcaaggaggtggaggatggagacaagttcatcttcaatggagagttcaagcacaagctgttccgcatcaagatcaaccagatccagatgaaggagaccgtggaggagcaggtgtccaccacagagagggtcttccaggaccggcagtaccagattgatgctgccatcgtgcgcatcatgaagatgaggaagaccctgggccacaacctgctggtgtctgagctgtacaaccagctgaagtttcctgtgaagccaggggacctgaagaagagaattgagagcctgattgaccgggactacatggagcgggacaaggacaaccccaaccagtaccactacgtggcctag

SEQ ID NO: 148747 - DNA, 2280 bp, Artificial Sequence
  Description of Artificial Sequence: Synthetic coding sequence
atggctgatgaggcccccaggaagggcagcttcagcgccctggtgggccgcaccaacggcctgaccaagccagctgccctggccgccgccccagccaagccaggaggagctgggggcagcaagaagctggtgatcaagaacttccgggaccggccccggctgcctgacaactacacccaggacacctggaggaagctgcatgaagctgtgcgggctgtgcagagcagcaccagcatccgctacaacctggaggagctgtaccaggccgtggagaacctgtgcagccacaaggtgagccccatgctgtacaagcagctgcggcaggcctgtgaagatcatgtgcaggcccagatcctgcccttccgggaggacagcctggacagcgtgctcttcctgaagaagatcaacacctgctggcaggaccactgccggcagatgatcatgatccgcagcatcttcctgttcctggacaggacctacgtgctgcagaacagcaccctgcccagcatctgggacatgggcctggagctgttccgcacccacatcatcagtgacaagatggtgcagagcaagaccattgatggcatcctgctgctgattgaaagagagaggtctggagaggccgtggacaggagcctgctgcggagcctgctgggcatgctgagtgacctgcaggtgtacaaggacagctttgagctgaagttcctggaggagaccaactgcctgtatgctgctgagggccagaggctgatgcaggagcgggaggtgcctgagtacctgaaccacgtgtccaagaggctggaggaggagggggacagagtcatcacctacctggaccacagcacccagaagcccctgattgcctgtgtggagaagcagctgctgggggagcacctgacagccatcctgcagaagggcctggaccacctgctggatgaaaatagagtgcctgacctggcccagatgtaccagctgttcagccgggtgcggggcggccagcaggccctgctgcagcactggagcgagtacatcaagacctttggaacagccatcgtcatcaaccctgagaaggacaaggacatggtgcaggacctgctggacttcaaggacaaggtggaccacgtgattgaggtgtgcttccagaagaatgaaagatttgtgaacctgatgaaggagagctttgagaccttcatcaacaagaggcccaacaagccagctgagctgattgccaagcacgtggacagcaagctgcgggccggcaacaaggaggccacagatgaggagctggagaggaccctggacaagatcatgatcctcttccgcttcatccacggcaaggatgtgtttgaggccttctacaagaaggacctggccaagaggctgctggtgggcaagagcgcctctgtggatgctgagaagtccatgctgagcaagctgaagcatgaatgtggggccgccttcaccagcaagctggagggcatgttcaaggacatggagctgagcaaggacatcatggtgcacttcaagcagcacatgcagaaccagagcgacagcggccccatcgacctgactgtgaacatcctgaccatgggctactggcccacctacacccccatggaggtgcacctgaccccagagatgatcaagctgcaggaggtgttcaaggccttctacctgggcaagcacagcggcaggaagctgcagtggcagaccaccctgggccatgctgtgctgaaggccgagttcaaggagggcaagaaggagttccaggtgtccctcttccagaccctggtgctgctgatgtttaatgaaggagatggcttctcctttgaggagatcaagatggccactggaattgaggacagcgagctgcggaggaccctgcagagcctggcctgtgggaaggcccgggtgctgatcaagagccccaagggcaaggaggtggaggatggagacaagttcatcttcaatggagagttcaagcacaagctgttccgcatcaagatcaaccagatccagatgaaggagaccgtggaggagcaggtgtccaccacagagagggtcttccaggaccggcagtaccagattgatgctgccatcgtgcgcatcatgaagatgaggaagaccctgggccacaacctgctggtgtctgagctgtacaaccagctgaagtttcctgtgaagccaggggacctgaagaagagaattgagagcctgattgaccgggactacatggagcgggacaaggacaaccccaaccagtaccactacgtggcctag

SEQ ID NO: 148748 - DNA, 1980 bp, Artificial Sequence; identical to SEQ ID NO: 148746
  Description of Artificial Sequence: Synthetic coding sequence

SEQ ID NO: 148749 - DNA, 1980 bp, Artificial Sequence; identical to SEQ ID NO: 148746
  Description of Artificial Sequence: Synthetic coding sequence

SEQ ID NO: 148750 - DNA, 2703 bp, Artificial Sequence
  Description of Artificial Sequence: Synthetic coding sequence
atgaagtctgtgtgccctgtgaccagcggcttcagcagccccagccccagcgctgctgctgctgcccaggaggtgcgcagcgccacagatggcaacaccagcaccaccccacccaccagcgccaagaagaggaagctgaacagcagcagcagcagcagcagcaacagcagcaatgaaagagaagattttgacagcaccagcagcagcagcagcaccccacccctgcagccccgggacagcgccagccccagcaccagcagcttctgcctgggcgtgtctgtggccgccagcagccacgtgcccatccagaagaagctgcgctttgaggacaccctggagtttgtgggctttgatgccaagatggccgaggagagcagcagcagcagcagcagcagcagccccacagctgccaccagccagcagcagcagctgaagaacaagagcatcctgatcagctctgtggcctctgtgcaccacgccaacggcctggccaagagcagcaccaccgtgagcagctttgccaacagcaagccaggcagcgccaagaagctggtgatcaagaacttcaaggacaagcccaagctgcctgagaactacacagatgagacctggcagaagctgaaggaggccgtggaggccatccagaacagcaccagcatcaagtacaacctggaggagctgtaccaggccgtggagaacctgtgcagctacaagatcagcgccaacctgtacaagcagctgcggcagatctgtgaggaccacatcaaggcccagatccaccagttccgggaggacagcctggacagcgtgctcttcctgaagaagattgaccgctgctggcagaaccactgccggcagatgatcatgatccgcagcatcttcctgttcctggacaggacctacgtgctgcagaacagcatgctgcccagcatctgggacatgggcctggagctgttccgggcccacatcatcagtgaccagaaggtgcagaacaagaccattgatggcatcctgctgctgattgagcgggagagaaatggagaggccatcgacaggagcctgctgcggagcctgctgtccatgctgagtgacctgcagatctaccaggacagctttgagcagcgcttcctggaggagaccaaccggctgtatgctgctgagggccagaagctgatgcaggagcgggaggtgcctgagtacctgcaccacgtgaacaagaggctggaggaggaggccgacaggctcatcacctacctggaccagaccacccagaagagcctcatcgccaccgtggagaagcagctgctgggggagcacctgacagccatcctgcagaagggcctgaacaacctgctggatgagaaccgcatccaggacctgagcctgctgtaccagctgttcagccgggtgcggggcggcgtgcaggtgctgctgcagcagtggattgagtacatcaaggccttcggcagcaccatcgtcatcaaccctgagaaggacaagaccatggtgcaggagctgctggacttcaaggacaaggtggaccacatcatcgacatctgcttcctgaagaatgagaagttcatcaatgccatgaaggaggcctttgagaccttcatcaacaagaggcccaacaagccagctgagctgattgccaagtatgtggacagcaagctgcgggccggcaacaaggaggccacagatgaggagctggagaagatgctggacaagatcatgatcatcttccgcttcatctacggcaaggatgtgtttgaggccttctacaagaaggacctggccaagaggctgctggtgggcaagagcgcctctgtggatgctgagaagtccatgctgagcaagctgaagcatgaatgtggggccgccttcaccagcaagctggagggcatgttcaaggacatggagctgagcaaggacatcatgatccagttcaagcagtacatgcagaaccagaatgtgcccggcaacatcgagctgactgtgaacatcctgaccatgggctactggcccacctacgtgcccatggaggtgcacctgcccccagagatggtgaagctgcaggagatcttcaagaccttctacctgggcaagcacagcggcaggaagctgcagtggcagagcaccctgggccactgtgtgctgaaggccgagttcaaggagggcaagaaggagctgcaggtgtccctcttccagaccctggtgctgctgatgtttaatgaaggagaggagttcagcctggaggagatcaagcaggccaccggcattgaagatggagagctgcggaggaccctgcagagcctggcctgtgggaaggcccgggtgctggccaagaaccccaagggcaaggacattgaagatggagacaagttcatctgcaatgatgacttcaagcacaagctgttccgcatcaagatcaaccagatccagatgaaggagaccgtggaggagcaggccagcaccacagagagggtcttccaggaccggcagtaccagattgatgctgccatcgtgcgcatcatgaagatgaggaagaccctgagccacaacctgctggtgtctgaggtgtacaaccagctgaagtttcctgtgaagccagctgacctgaagaagagaattgagagcctgattgaccgggactacatggagcgggacaaggagaaccccaaccagtacaactacatcgcctag

SEQ ID NO: 148751 - DNA, 2688 bp, Artificial Sequence
  Description of Artificial Sequence: Synthetic coding sequence
atgttccccaccggcttcagcagccccagccccagcgctgctgctgctgcccaggaggtgcgcagcgccacagatggcaacaccagcaccaccccacccaccagcgccaagaagaggaagctgaacagcagcagcagcagcagcagcaacagcagcaatgaaagagaggactttgacagcaccagcagcagcagcagcaccccacccctgcagccccgggacagcgccagccccagcaccagcagcttctgcctgggcgtgtctgtggccgccagcagccacgtgcccatccagaagaagctgcgctttgaggacaccctggagtttgtgggctttgatgccaagatggccgaggagagcagcagcagcagcagcagcagcagccccacagctgccaccagccagcagcagcagctgaagaacaagagcatcctgatcagctctgtggcctctgtgcaccacgccaacggcctggccaagagcagcaccaccgtgtcctcctttgccaacagcaagccaggcagcgccaagaagctggtgatcaagaacttcaaggacaagcccaagctgcctgagaactacacagatgagacctggcagaagctgaaggaggccgtggaggccatccagaacagcaccagcatcaagtacaacctggaggagctgtaccaggccgtggagaacctgtgcagctacaagatcagcgccaacctgtacaagcagctgcggcagatctgtgaggaccacatcaaggcccagatccaccagttccgggaggacagcctggacagcgtgctcttcctgaagaagattgaccgctgctggcagaaccactgccggcagatgatcatgatccgcagcatcttcctgttcctggacaggacctacgtgctgcagaacagcatgctgcccagcatctgggacatgggcctggagctgttccgggcccacatcatcagtgaccagaaggtgcagaacaagaccattgatggcatcctgctgctgattgaaagagaaagaaatggagaggccatcgacaggagcctgctgcggagcctgctgtccatgctgagtgacctgcagatctaccaggacagctttgagcagcgcttcctggaggagaccaaccggctgtatgctgctgagggccagaagctgatgcaggagcgggaggtgcctgagtacctgcaccacgtgaacaagaggctggaggaggaggccgacaggctcatcacctacctggaccagaccacccagaagagcctgattgccaccgtggagaagcagctgctgggggagcacctgacagccatcctgcagaagggcctgaacaacctgctggatgaaaatcgcatccaggacctgagcctgctgtaccagctgttcagccgggtgcggggcggcgtgcaggtgctgctgcagcagtggattgagtacatcaaggccttcggcagcaccatcgtcatcaaccctgagaaggacaagaccatggtgcaggagctgctggacttcaaggacaaggtggaccacatcatcgacatctgcttcctgaagaatgagaagttcatcaatgccatgaaggaggcctttgagaccttcatcaacaagaggcccaacaagccagctgagctgattgccaagtatgtggacagcaagctgcgggccggcaacaaggaggccacagatgaggagctggagaagatgctggacaagatcatgatcatcttccgcttcatctacggcaaggatgtgtttgaggccttctacaagaaggacctggccaagaggctgctggtgggcaagagcgcctctgtggatgctgagaagtccatgctgagcaagctgaagcatgaatgtggggccgccttcaccagcaagctggagggcatgttcaaggacatggagctgagcaaggacatcatgatccagttcaagcagtacatgcagaaccagaatgtgcccggcaacatcgagctgactgtgaacatcctgaccatgggctactggcccacctacgtgcccatggaggtgcacctgcccccagagatggtgaagctgcaggagatcttcaagaccttctacctgggcaagcacagcggcaggaagctgcagtggcagagcaccctgggccactgtgtgctgaaggccgagttcaaggagggcaagaaggagctgcaggtgtccctcttccagaccctggtgctgctgatgtttaatgaaggagaggagttcagcctggaggagatcaagcaggccactggaattgaagatggagagctgcggaggaccctgcagagcctggcctgtgggaaggcccgggtgctggccaagaaccccaagggcaaggacattgaagatggagacaagttcatctgcaatgatgacttcaagcacaagctgttccgcatcaagatcaaccagatccagatgaaggagaccgtggaggagcaggccagcaccacagagagggtcttccaggaccggcagtaccagattgatgctgccatcgtgcgcatcatgaagatgaggaagaccctgagccacaacctgctggtgtctgaggtgtacaaccagctgaagtttcctgtgaagccagctgacctgaagaagagaattgagagcctgattgaccgggactacatggagcgggacaaggagaaccccaaccagtacaactacatcgcctag

SEQ ID NO: 148752 - DNA, 705 bp, Artificial Sequence
  Description of Artificial Sequence: Synthetic coding sequence
atgattgatcctgactttgctgacaagcccaagctgcctgagaactacacagatgagacctggcagaagctgaaggaggccgtggaggccatccagaacagcaccagcatcaagtacaacctggaggagctgtaccaggccgtggagaacctgtgcagctacaagatcagcgccaacctgtacaagcagctgcggcagatctgtgaggaccacatcaaggcccagatccaccagttccgggaggacagcctggacagcgtgctcttcctgaagaagattgaccgctgctggcagaaccactgccggcagatgatcatgatccgcagcatcttcctgttcctggacaggacctacgtgctgcagaacagcatgctgcccagcatctgggacatgggcctggagctgttccgggcccacatcatcagtgaccagaaggtgcagaacaagaccattgatggcatcctgctgctgattgaaagagaaagaaatggagaggccatcgacaggagcctgctgcggagcctgctgtccatgctgagtgacctgcagatctaccaggacagctttgagcagcgcttcctggaggagaccaaccggctgtatgctgctgagggccagaagctgatgcaggagcgggaggtgcctgagtacctgcaccacgtgaacaagaggctggaggaggaggccgacaggctcatcacctag

SEQ ID NO: 148753 - DNA, 2742 bp, Artificial Sequence
  Description of Artificial Sequence: Synthetic coding sequence
atgatgagccagagcagcggcagcggagatggaaatgatgatgaggccaccaccagcaaggatggcggcttcagcagccccagccccagcgctgctgctgctgcccaggaggtgcgcagcgccacagatggcaacaccagcaccaccccacccaccagcgccaagaagaggaagctgaacagcagcagcagcagcagcagcaacagcagcaatgaaagagaggactttgacagcaccagcagcagcagcagcaccccacccctgcagccccgggacagcgccagccccagcaccagcagcttctgcctgggcgtgtctgtggccgccagcagccacgtgcccatccagaagaagctgcgctttgaggacaccctggagtttgtgggctttgatgccaagatggccgaggagagcagcagcagcagcagcagcagcagccccacagctgccaccagccagcagcagcagctgaagaacaagagcatcctgatcagctctgtggcctctgtgcaccacgccaacggcctggccaagagcagcaccaccgtgtcctcctttgccaacagcaagccaggcagcgccaagaagctggtgatcaagaacttcaaggacaagcccaagctgcctgagaactacacagatgagacctggcagaagctgaaggaggccgtggaggccatccagaacagcaccagcatcaagtacaacctggaggagctgtaccaggccgtggagaacctgtgcagctacaagatcagcgccaacctgtacaagcagctgcggcagatctgtgaggaccacatcaaggcccagatccaccagttccgggaggacagcctggacagcgtgctcttcctgaagaagattgaccgctgctggcagaaccactgccggcagatgatcatgatccgcagcatcttcctgttcctggacaggacctacgtgctgcagaacagcatgctgcccagcatctgggacatgggcctggagctgttccgggcccacatcatcagtgaccagaaggtgcagaacaagaccattgatggcatcctgctgctgattgaaagagaaagaaatggagaggccatcgacaggagcctgctgcggagcctgctgtccatgctgagtgacctgcagatctaccaggacagctttgagcagcgcttcctggaggagaccaaccggctgtatgctgctgagggccagaagctgatgcaggagcgggaggtgcctgagtacctgcaccacgtgaacaagaggctggaggaggaggccgacaggctcatcacctacctggaccagaccacccagaagagcctgattgccaccgtggagaagcagctgctgggggagcacctgacagccatcctgcagaagggcctgaacaacctgctggatgaaaatcgcatccaggacctgagcctgctgtaccagctgttcagccgggtgcggggcggcgtgcaggtgctgctgcagcagtggattgagtacatcaaggccttcggcagcaccatcgtcatcaaccctgagaaggacaagaccatggtgcaggagctgctggacttcaaggacaaggtggaccacatcatcgacatctgcttcctgaagaatgagaagttcatcaatgccatgaaggaggcctttgagaccttcatcaacaagaggcccaacaagccagctgagctgattgccaagtatgtggacagcaagctgcgggccggcaacaaggaggccacagatgaggagctggagaagatgctggacaagatcatgatcatcttccgcttcatctacggcaaggatgtgtttgaggccttctacaagaaggacctggccaagaggctgctggtgggcaagagcgcctctgtggatgctgagaagtccatgctgagcaagctgaagcatgaatgtggggccgccttcaccagcaagctggagggcatgttcaaggacatggagctgagcaaggacatcatgatccagttcaagcagtacatgcagaaccagaatgtgcccggcaacatcgagctgactgtgaacatcctgaccatgggctactggcccacctacgtgcccatggaggtgcacctgcccccagagatggtgaagctgcaggagatcttcaagaccttctacctgggcaagcacagcggcaggaagctgcagtggcagagcaccctgggccactgtgtgctgaaggccgagttcaaggagggcaagaaggagctgcaggtgtccctcttccagaccctggtgctgctgatgtttaatgaaggagaggagttcagcctggaggagatcaagcaggccactggaattgaagatggagagctgcggaggaccctgcagagcctggcctgtgggaaggcccgggtgctggccaagaaccccaagggcaaggacattgaagatggagacaagttcatctgcaatgatgacttcaagcacaagctgttccgcatcaagatcaaccagatccagatgaaggagaccgtggaggagcaggccagcaccacagagagggtcttccaggaccggcagtaccagattgatgctgccatcgtgcgcatcatgaagatgaggaagaccctgagccacaacctgctggtgtctgaggtgtacaaccagctgaagtttcctgtgaagccagctgacctgaagaagagaattgagagcctgattgaccgggactacatggagcgggacaaggagaaccccaaccagtacaactacatcgcctag

SEQ ID NO: 148754 - DNA, 2343 bp, Artificial Sequence
  Description of Artificial Sequence: Synthetic coding sequence
atggccaccagcaacctgctgaagaacaagggcagcctgcagtttgaggacaagtgggacttcatgaggcccatcgtgctgaagctgctgcggcaggagagcgtgaccaagcagcagtggtttgacctcttcagtgatgtgcatgctgtgtgcctgtgggatgacaagggccctgccaagatccaccaggccctgaaggaggacatcctggagttcatcaagcaggcccaggcccgggtgctgagccaccaggatgacacagccctgctgaaggcctacatcgtggagtggaggaagttcttcacccagtgtgacatcctgcccaagcccttctgccagctggagatcaccctgatgggcaagcagggcagcaacaagaagagcaatgtggaggacagcatcgtgaggaagctgatgctggacacctggaatgaaagcatcttcagcaacatcaagaaccggctgcaggacagcgccatgaagctggtgcatgctgagcggctgggggaggcctttgacagccagctggtgattggagtgcgggagagctatgtgaacctgtgcagcaaccctgaggacaagctgcagatctacagagacaactttgagaaggcctacctggacagcacagagcgcttctaccgcacccaggcccccagctacctgcagcagaatggagtgcagaactacatgaagtatgcagatgccaagctgaaggaggaggagaagagggccctgcgctacctggagacccggcgggagtgcaacagcgtggaggccctgatggagtgctgcgtgaatgccctggtgaccagcttcaaggagaccatcctggccgagtgccagggcatgatcaagagaaatgaaacagagaagctgcacctgatgttcagcctgatggacaaggtgcccaatggaattgagcccatgctgaaggacctggaggagcacatcatctctgctggcctggccgacatggtggccgctgctgagaccatcaccacagattctgagaagtatgtggagcagctgctgaccctcttcaaccgcttcagcaagctggtgaaggaggccttccaggatgacccccgcttcctgacagcccgggacaaggcctacaaggctgtggtgaatgatgccaccatcttcaagctggagctgcccctgaagcagaagggcgtgggcctgaagacccagcctgagagcaaatgtcctgagctgctggccaactactgtgacatgctgctgaggaagacccccctgagcaagaagctgaccagcgaggagattgaggccaagctgaaggaggtgctgctggtgctgaagtatgtgcagaacaaggatgtgttcatgagataccacaaggcccacctgacccggcggctcatcctggacatctctgctgacagcgagattgaggagaacatggtggagtggctgcgggaggtgggcatgcctgctgactatgtgaacaagctggccaggatgttccaggacatcaaggtgtctgaggacctgaaccaggccttcaaggagatgcacaagaacaacaagctggccctgcctgctgacagcgtgaacatcaagatcctgaatgctggggcctggagccgcagcagcgagaaggtgtttgtgtccctgcccacagagctggaggacctgatccctgaggtggaggagttctacaagaagaaccacagcggcaggaagctgcactggcaccacctgatgagcaatggcatcatcaccttcaagaatgaggtgggccagtatgacctggaggtgaccaccttccagctggccgtgctgtttgcctggaaccagaggccccgggagaagatcagctttgagaacctgaagctggccacagagctgcctgatgctgagctgcggaggaccctgtggagcctggtggccttccccaagctgaagaggcaggtgctgctgtatgagccccaggtgaacagccccaaggacttcacagagggcaccctcttctctgtgaaccaggagttcagcctcatcaagaatgccaaggtgcagaagaggggcaagatcaacctgattggccgcctgcagctgaccacagagaggatgagggaggaggagaatgaaggaattgtgcagctgcgcatcctgcggacccaggaggccatcatccagatcatgaagatgaggaagaagatcagcaatgcccagctgcagacagagctggtggagatcctgaagaacatgttcctgccccagaagaagatgatcaaggagcagatcgagtggctgattgagcacaagtacatcagaagagatgaaagtgacatcaacaccttcatctacatggcctag

SEQ ID NO: 148755 - DNA, 2343 bp, Artificial Sequence; identical to SEQ ID NO: 148754
  Description of Artificial Sequence: Synthetic coding sequence

SEQ ID NO: 148756 - DNA, 5097 bp, Artificial Sequence
  Description of Artificial Sequence: Synthetic coding sequence
atggtgggggagctgcgctaccgggagttccgggtgcccctgggccctggcctgcacgcctacccagatgagctgatccggcagagggtgggccatgatggccaccctgagtaccagatccgctggctgatcctgcggagaggagatgaaggagatggcggcagcggccaggtggactgcaaggccgagcacatcctgctgtggatgagcaaggatgagatctatgccaactgccacaagatgctgggggaggatggccaggtgattggccccagccaggagagcgctggggaggtgggcgccctggacaagtctgtgctggaggagatggagacagatgtgaagagcctcatccagagggccctgcggcagctggaggagtgtgtgggcaccatccccccagcccccctgctgcacacagtgcacgtgctgagcgcctatgccagcattgagcccctgactggagtcttcaaggacccccgggtgctggacctgctgatgcacatgctgagcagcccagactaccagatccgctggagcgctggccgcatgatccaggccctgagcagccatgatgctggcaccaggacccagatcctgctgagcctgagccagcaggaggccatcgagaagcacctggactttgacagccgctgtgccctgctggccctgtttgcccaggccaccctgtctgagcaccccatgagctttgagggcatccagctgccccaggtgcccggccgggtgctcttcagcctggtgaagcgctacctgcacgtgaccagcctgctggaccagctgaatgacagcgctgctgagcccggggcccagaacaccagcgcccctgaggagctgagcggggagcggggccagctggagctggagttctccatggccatgggcaccctcatcagcgagctggtgcaggccatgcgctgggaccaggccagtgaccggcccaggagcagcgcccggagccctggcagcatcttccagccccagctggctgatgtgtccccaggcctgcctgctgcccaggcccagcccagcttccgccgcagccgccgcttccggcccaggagtgaatttgccagcggcaacacctacgccctgtatgtgcgggacaccctgcagcccggcatgagggtgaggatgctggatgattatgaggagatctctgctggagatgaaggagagttccggcagagcaacaatggagtgccccctgtgcaggtgttctgggagagcactggaagaacctactgggtgcactggcacatgctggagatcctgggctttgaagaagatattgaggacatggtggaggctgatgagtaccagggcgctgtggccagccgggtgctgggccgggccctgcctgcctggcgctggaggcccatgacagagctgtatgctgtgccctacgtgctgcctgaagatgaggacacagaagaatgtgagcacctgaccctggccgagtggtgggagctgctcttcttcatcaagaagctggatggccctgaccaccaggaggtgctgcagatcctgcaggagaacctggatggagagatcctggatgatgagatcctggccgagctggccgtgcccatcgagctggcccaggacctgctgctgaccctgccccagaggctgaatgacagcgccctgcgggacctgatcaactgccacgtgtacaagaagtatggccctgaggccctggccggcaaccaggcctaccccagcctgctggaggcccaggaggatgtgctgctgctggatgcccaggcccaggccaaggacagtgaagatgctgccaaggtggaggccaaggagccccccagccagagccccaacacccccctgcagaggctggtggagggctacggccctgctgggaagatcctgctggacctggagcaggccctgagcagcgagggcacccaggagaacaaggtgaagcccctgctgctgcagctgcagaggcagccccagcccttcctggccctgatgcagagcctggacaccccagagaccaacagaaccctgcacctgactgtgctgcgcatcctgaagcagctggtggacttccctgaggccctgctgctgccctggcatgaagctgtggatgcctgcatggcctgcctgcggagccccaacacagaccgggaggtgctgcaggagctgatcttcttcctgcaccggctgacctctgtgtcccgggactatgctgtggtgctgaaccagctgggcgccagagatgccatcagcaaggccctggagaagcacctgggcaagctggagctggcccaggagctgcgggacatggtgttcaagtgtgagaagcacgcccacctgtacaggaagctgatcaccaacatcctgggcggctgcatccagatggtgctgggccagatcgaggaccacaggaggacccaccagcccatcaacatccccttctttgatgtgttcctgcgctacctgtgccagggcagctctgtggaggtgaaggaggacaagtgctgggagaaggtggaggtgagcagcaacccccaccgggccagcaagctgacagaccacaaccccaagacctactgggagagcaatggcagcgctggcagccactacatcaccctgcacatgagaagaggcatcctgatccggcagctgaccctgctggtggccagcgaggacagcagctacatgcctgcccgggtggtggtgtgtggcggggacagcaccagcagcctgcacacagagctgaacagcgtgaatgtgatgcccagcgccagcagggtcatcctgctggagaacctgacccgcttctggcccatcatccagatccgcatcaagcgctgccagcagggcggcatcgacacccgcatccggggcctggagatcctgggccccaagcccaccttctggcctgtgttccgggagcagctgtgccgccacaccaggctcttctacatggtgcgggcccaggcctggagccaggacatggccgaggaccggcgcagcctgctgcacctgagcagccggctgaatggagccctgcggcaggagcagaactttgctgaccgcttcctgcctgatgatgaggccgcccaggccctgggcaagacctgctgggaggccctggtgtcccctgtggtgcagaacatcaccagcccagatgaagatggcatcagccccctgggctggctgctggaccagtacctggagtgccaggaggccgtgttcaacccccagagccggggccctgccttcttcagccgggtgcggcggctgacccacctgctggtgcacgtggagccctgtgaggcccctcctcctgtggtggccaccccccggcccaagggcaggaacagaagccatgactggagcagcctggccacccggggcctgcccagcagcatcatgaggaacctgacccgctgctggagggctgtggtggagaagcaggtgaacaacttcctgaccagctcctggagagatgatgactttgtgccccgctactgtgagcacttcaacatcctgcagaacagcagcagcgagctgtttggccccagggctgccttcctgctggccctgcagaatggctgtgccggggccctgctgaagctgcccttcctgaaggccgcccacgtgtctgagcagtttgcccggcacatcgaccagcagatccagggcagcagaattggaggagcccaggagatggagcggctggcccagctgcagcagtgcctgcaggccgtgctgatcttcagcggcctggagatcgccaccacctttgagcactactaccagcactacatggctgaccggctgctgggcgtggtgtcctcctggctggagggcgctgtgctggagcagatcggcccctgcttccccaaccggctgccccagcagatgctgcagagcctgagcaccagcaaggagctgcagaggcagttccacgtgtaccagctgcagcagctggaccaggagctgctgaagctggaggacacagagaagaagatccaggtgggcctgggcgccagcggcaaggagcacaagtctgagaaggaggaggaggccggggctgctgctgtggtggatgtggccgagggggaggaggaggaggaggagaatgaagacctgtactatgagggcgccatgcctgaggtgtctgtgctggtgctgagccgccacagctggcctgtggccagcatctgccacaccctgaaccccaggacctgcctgcccagctacctgcggggcaccctgaaccgctacagcaacttctacaacaagagccagagccacccagccctggagcggggcagccagaggcggctgcagtggacctggctgggctgggccgagctgcagtttggaaaccagaccctgcacgtgtccacagtgcagatgtggctgctgctgtacctgaatgacctgaaggctgtgtctgtggagagcctgctggccttcagcggcctgtctgctgacatgctgaaccaggccatcggccccctgaccagcagccggggccccctggacctgcacgagcagaaggacatccctggaggagtgctgaagatcagagatggcagcaaggagcccaggagccgctgggacatcgtgcggctcatccccccccagacctacctgcaggccgagggagaagatggccagaacctggagaagagaagaaacctgctgaactgcctgattgtgcgcatcctgaaggcccatggagatgagggcctgcacatcgaccagctggtgtgcctggtgctggaggcctggcagaagggcccctgccccccccggggcctggtgagcagcctgggcaagggcagcgcctgcagcagcacagatgtgctgagctgcatcctgcacctgctgggcaagggcaccctgcggagacatgatgaccggccccaggtgctgtcctatgctgtgcctgtgacagtgatggagccccacacagagagcctgaaccctggcagcagcggccccaacccccccctgaccttccacaccctgcagatccgcagccggggcgtgccctatgccagctgcacagccacccagagcttcagcaccttcagatag

SEQ ID NO: 148757 - DNA, 5349 bp, Artificial Sequence
  Description of Artificial Sequence: Synthetic coding sequence
atgagccggggcttctggctggccgagcccctggccggcaccggcccccacccagcccctgtggccgctgacagccggggctgcagctctgtgcccaggagacatgcccccagccggctgtctgtgtccacccccagccggggccctggggccaggatggtgggggagctgcgctaccgggagttccgggtgcccctgggccctggcctgcacgcctacccagatgagctgatccggcagagggtgggccatgatggccaccctgagtaccagatccgctggctgatcctgcggagaggagatgaaggagatggcggcagcggccaggtggactgcaaggccgagcacatcctgctgtggatgagcaaggatgagatctatgccaactgccacaagatgctgggggaggatggccaggtgattggccccagccaggagagcgctggggaggtgggcgccctggacaagtctgtgctggaggagatggagacagatgtgaagagcctcatccagagggccctgcggcagctggaggagtgtgtgggcaccatccccccagcccccctgctgcacacagtgcacgtgctgagcgcctatgccagcattgagcccctgactggagtcttcaaggacccccgggtgctggacctgctgatgcacatgctgagcagcccagactaccagatccgctggagcgctggccgcatgatccaggccctgagcagccatgatgctggggagggccagtgtggggaggagggcaaggccggggagggcctgggccgcctgcgggacagccaggacacagtggccggggccagtgacctgatccgcaccaggacccagatcctgctgagcctgagccagcaggaggccatcgagaagcacctggactttgacagccgctgtgccctgctggccctgtttgcccaggccaccctgtctgagcaccccatgagctttgagggcatccagctgccccaggtgcccggccgggtgctcttcagcctggtgaagcgctacctgcacgtgaccagcctgctggaccagctgaatgacagcgctgctgagcccggggcccagaacaccagcgcccctgaggagctgagcggggagcggggccagctggagctggagttctccatggccatgggcaccctcatcagcgagctggtgcaggccatgcgctgggaccaggccagtgaccggcccaggagcagcgcccggagccctggcagcatcttccagccccagctggctgatgtgtccccaggcctgcctgctgcccaggcccagcccagcttccgccgcagccgccgcttccggcccaggagtgaatttgccagcggcaacacctacgccctgtatgtgcgggacaccctgcagcccggcatgagggtgaggatgctggatgattatgaggagatctctgctggagatgaaggagagttccggcagagcaacaatggagtgccccctgtgcaggtgttctgggagagcactggaagaacctactgggtgcactggcacatgctggagatcctgggctttgaagaagatattgaggacatggtggaggctgatgagtaccagggcgctgtggccagccgggtgctgggccgggccctgcctgcctggcgctggaggcccatgacagagctgtatgctgtgccctacgtgctgcctgaagatgaggacacagaagaatgtgagcacctgaccctggccgagtggtgggagctgctcttcttcatcaagaagctggatggccctgaccaccaggaggtgctgcagatcctgcaggagaacctggatggagagatcctggatgatgagatcctggccgagctggccgtgcccatcgagctggcccaggacctgctgctgaccctgccccagaggctgaatgacagcgccctgcgggacctgatcaactgccacgtgtacaagaagtatggccctgaggccctggccggcaaccaggcctaccccagcctgctggaggcccaggaggatgtgctgctgctggatgcccaggcccaggccaaggacagtgaagatgctgccaaggtggaggccaaggagccccccagccagagccccaacacccccctgcagaggctggtggagggctacggccctgctgggaagatcctgctggacctggagcaggccctgagcagcgagggcacccaggagaacaaggtgaagcccctgctgctgcagctgcagaggcagccccagcccttcctggccctgatgcagagcctggacaccccagagaccaacagaaccctgcacctgactgtgctgcgcatcctgaagcagctggtggacttccctgaggccctgctgctgccctggcatgaagctgtggatgcctgcatggcctgcctgcggagccccaacacagaccgggaggtgctgcaggagctgatcttcttcctgcaccggctgacctctgtgtcccgggactatgctgtggtgctgaaccagctgggcgccagagatgccatcagcaaggccctggagaagcacctgggcaagctggagctggcccaggagctgcgggacatggtgttcaagtgtgagaagcacgcccacctgtacaggaagctgatcaccaacatcctgggcggctgcatccagatggtgctgggccagatcgaggaccacaggaggacccaccagcccatcaacatccccttctttgatgtgttcctgcgctacctgtgccagggcagctctgtggaggtgaaggaggacaagtgctgggagaaggtggaggtgagcagcaacccccaccgggccagcaagctgacagaccacaaccccaagacctactgggagagcaatggcagcgctggcagccactacatcaccctgcacatgagaagaggcatcctgatccggcagctgaccctgctggtggccagcgaggacagcagctacatgcctgcccgggtggtggtgtgtggcggggacagcaccagcagcctgcacacagagctgaacagcgtgaatgtgatgcccagcgccagcagggtcatcctgctggagaacctgacccgcttctggcccatcatccagatccgcatcaagcgctgccagcagggcggcatcgacacccgcatccggggcctggagatcctgggccccaagcccaccttctggcctgtgttccgggagcagctgtgccgccacaccaggctcttctacatggtgcgggcccaggcctggagccaggacatggccgaggaccggcgcagcctgctgcacctgagcagccggctgaatggagccctgcggcaggagcagaactttgctgaccgcttcctgcctgatgatgaggccgcccaggccctgggcaagacctgctgggaggccctggtgtcccctgtggtgcagaacatcaccagcccagatgaagatggcatcagccccctgggctggctgctggaccagtacctggagtgccaggaggccgtgttcaacccccagagccggggccctgccttcttcagccgggtgcggcggctgacccacctgctggtgcacgtggagccctgtgaggcccctcctcctgtggtggccaccccccggcccaagggcaggaacagaagccatgactggagcagcctggccacccggggcctgcccagcagcatcatgaggaacctgacccgctgctggagggctgtggtggagaagcaggtgaacaacttcctgaccagctcctggagagatgatgactttgtgccccgctactgtgagcacttcaacatcctgcagaacagcagcagcgagctgtttggccccagggctgccttcctgctggccctgcagaatggctgtgccggggccctgctgaagctgcccttcctgaaggccgcccacgtgtctgagcagtttgcccggcacatcgaccagcagatccagggcagcagaattggaggagcccaggagatggagcggctggcccagctgcagcagtgcctgcaggccgtgctgatcttcagcggcctggagatcgccaccacctttgagcactactaccagcactacatggctgaccggctgctgggcgtggtgtcctcctggctggagggcgctgtgctggagcagatcggcccctgcttccccaaccggctgccccagcagatgctgcagagcctgagcaccagcaaggagctgcagaggcagttccacgtgtaccagctgcagcagctggaccaggagctgctgaagctggaggacacagagaagaagatccaggtgggcctgggcgccagcggcaaggagcacaagtctgagaaggaggaggaggccggggctgctgctgtggtggatgtggccgagggggaggaggaggaggaggagaatgaagacctgtactatgagggcgccatgcctgaggtgtctgtgctggtgctgagccgccacagctggcctgtggccagcatctgccacaccctgaaccccaggacctgcctgcccagctacctgcggggcaccctgaaccgctacagcaacttctacaacaagagccagagccacccagccctggagcggggcagccagaggcggctgcagtggacctggctgggctgggccgagctgcagtttggaaaccagaccctgcacgtgtccacagtgcagatgtggctgctgctgtacctgaatgacctgaaggctgtgtctgtggagagcctgctggccttcagcggcctgtctgctgacatgctgaaccaggccatcggccccctgaccagcagccggggccccctggacctgcacgagcagaaggacatccctggaggagtgctgaagatcagagatggcagcaaggagcccaggagccgctgggacatcgtgcggctcatccccccccagacctacctgcaggccgagggagaagatggccagaacctggagaagagaagaaacctgctgaactgcctgattgtgcgcatcctgaaggcccatggagatgagggcctgcacatcgaccagctggtgtgcctggtgctggaggcctggcagaagggcccctgccccccccggggcctggtgagcagcctgggcaagggcagcgcctgcagcagcacagatgtgctgagctgcatcctgcacctgctgggcaagggcaccctgcggagacatgatgaccggccccaggtgctgtcctatgctgtgcctgtgacagtgatggagccccacacagagagcctgaaccctggcagcagcggccccaacccccccctgaccttccacaccctgcagatccgcagccggggcgtgccctatgccagctgcacagccacccagagcttcagcaccttcagatag

SEQ ID NO: 148758 - DNA, 435 bp, Artificial Sequence
  Description of Artificial Sequence: Synthetic coding sequence
atgggcgtgctgcaggtggtgaagcagagcgtgcagatccctgtgtttgtgatgatccggccccggggcggggacttcctgtacagcgaccgggagattgaggtgatgaaggctgacatccggctggccaagctgtatggagcagatggcctggtgtttggagccctgacagaagatggccacatcgacaaggagctgtgcatgagcctgatggccatctgccggcccctgcctgtgaccttccaccgggcctttgacatggtgcatgaccccatggccgccctggagaccctgctgaccctgggctttgagcgggtgctgaccagcggctgtgacagcagcgccctggagggcctgcccctcatcaagaggctcatcgagcaggccaagggcagaattgtggtgatgcctgggggcggcatcacagacagatag

SEQ ID NO: 148759 - DNA, 822 bp, Artificial Sequence
  Description of Artificial Sequence: Synthetic coding sequence
atgaagaggcagggcgccagcagcgagaggaagagggcccgcatccccagcggcaaggccggggccgccaacggcttcctgatggaggtgtgtgtggacagcgtggagagcgctgtgaatgctgagcggggcggcgctgacagaattgagctgtgcagcggcctgtctgagggcggcaccacccccagcatgggcgtgctgcaggtggtgaagcagagcgtgcagatccctgtgtttgtgatgatccggccccggggcggggacttcctgtacagcgaccgggagattgaggtgatgaaggctgacatccggctggccaagctgtatggagcagatggcctggtgtttggagccctgacagaagatggccacatcgacaaggagctgtgcatgagcctgatggccatctgccggcccctgcctgtgaccttccaccgggcctttgacatggtgcatgaccccatggccgccctggagaccctgctgaccctgggctttgagcgggtgctgaccagcggctgtgacagcagcgccctggagggcctgcccctcatcaagaggctgattgagcaggccaagggccgcatcgtggtgatgcctgggggcggcatcacagacaggaacctgcagaggatcctggagggcagcggggccacagagttccactgcagcgcccggagcacccgggacagcggcatgaagttcaggaacagctctgtggccatgggcgccagcctgagctgcagcgagtacagcctgaaggtgacagatgtgaccaaggtgaggaccctgaatgccatcgccaagaacatcctggtgtag

SEQ ID NO: 148760 - DNA, 1122 bp, Artificial Sequence
  Description of Artificial Sequence: Synthetic coding sequence
atgagcctgctgctgctgctgctgctggtgtcctactacgtgggcaccctgggcacccacacagagatcaagagggtggccgaggagaaggtgaccctgccctgccaccaccagctgggcctgcctgagaaggacaccctggacatcgagtggctgctgacagacaatgaaggcaaccagaaggtggtgatcacctacagcagccgccacgtgtacaacaacctgacagaggagcagaagggccgggtggcctttgccagcaacttcctggccggagatgccagcctgcagatcgagcccctgaagcccagtgatgagggccgctacacctgcaaggtgaagaacagcggccgctacgtgtggagccacgtgatcctgaaggtgctggtgcggcccagcaagcccaagtgtgagctggagggggagctgacagagggcagtgacctgaccctgcagtgtgagagcagcagcggcacagagcccatcgtgtactactggcagaggatccgggagaaggagggagaagatgagcggctgccccccaagagcagaattgactacaaccaccctggccgggtgctgctgcagaacctgaccatgagctacagcggcctgtaccagtgcacagctggaaatgaggccggcaaggagagctgtgtggtgcgggtgacagtgcagtatgtgcagagcatcggcatggtggccggggctgtgactggaattgtggccggggccctgctgatcttcctgctggtgtggctgctgatccggaggaaggacaaggagagatatgaggaggaggagcggcccaatgagatcagagaagatgctgaggcccccaaggcccggctggtgaagcccagcagcagcagcagcggcagccgcagcagccgcagcggcagcagcagcaccaggagcacagccaacagcgccagccgcagccagaggaccctgagcacagatgctgccccccagcccggcctggccacccaggcctacagcctggtgggccctgaggtgcggggcagcgagcccaagaaggtgcaccacgccaacctgaccaaggccgagaccacccccagcatgatccccagccagagccgggccttccagacagtgtag

SEQ ID NO: 148761 - DNA, 597 bp, Artificial Sequence
  Description of Artificial Sequence: Synthetic coding sequence
atgcaccacagaaatgacagccagaggctgggcaaggccggctgccccccagagcccagcctgcagatggccaacaccaacttcctgagcaccctgagccctgagcactgccggcccctggccggggagtgcatgaacaagctgaagtgtggggctgctgaggccgagatcatgaacctgcctgagcgggtgggcaccttcagcgccatcccagccctgggcggcatcagcctgcccccaggagtgattgtgatgacagccctgcacagccctgctgctgccagcgctgctgtgacagattctgccttccagatcgccaacctggccgactgcccccagaaccacagcagcagcagcagcagcagcagtggaggagctgggggcgccaacccagccaagaagaagaggaagagatgtggggtgtgtgtgccctgcaagaggctcatcaactgtggggtgtgcagcagctgcaggaacaggaagacaggccaccagatctgcaagttcagaaaatgtgaggagctgaagaagaagccaggcaccagcctggagaggacccctgtgcccagcgctgaggccttccgctggttcttctag

SEQ ID NO: 148762 - DNA, 597 bp, Artificial Sequence; identical to SEQ ID NO: 148761
  Description of Artificial Sequence: Synthetic coding sequence

SEQ ID NO: 148763 - DNA, 969 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgctgacaaggccacagctgctgctgctgctgccagcctgctggccaatggacatgacctggccgccgccatggctgtggacaagagcaaccccaccagcaagcacaagagcggggctgtggccagcctgctgagcaaggccgagcgggccacagagctggccgctgagggccagctgaccctgcagcagtttgcccagagcacagagatgctgaagagggtggtgcaggagcacctgcccctgatgtctgaggccggggccggcctgcctgacatggaggccgtggccggggctgaggccctgaatggccagagcgacttcccctacctgggcgccttccccatcaaccctggcctcttcatcatgaccccagctggggtcttcctggccgagagcgccctgcacatggccggcctggccgagtaccccatgcagggcgagctggccagcgccatcagcagcggcaagaagaagaggaagagatgtggcatgtgtgccccctgcagaagacgcatcaactgtgagcagtgcagcagctgcaggaacaggaagacaggccaccagatctgcaagttcagaaaatgtgaggagctgaagaagaagcccagcgctgccctggagaaggtgatgctgcccaccggggccgccttccgctggttccagtag

SEQ ID NO: 148764 - DNA, 210 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgtag

SEQ ID NO: 148765 - DNA, 243 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgtcctag

SEQ ID NO: 148766 - DNA, 546 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgctgacaaggccacagctgctgctgctgctgccagcctgctggccaatggacatgacctggccgccgccatggctgtggacaagagcaaccccaccagcaagcacaagagcggggctgtggccagcctgctgagcaaggccgagcgggccacagagctggccgctgagggccagctgaccctgcagcagtttgcccagagcacagagatgctgaagagggtggtgcaggagcacctgccctag

SEQ ID NO: 148767 - DNA, 252 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagctag

SEQ ID NO: 148768 - DNA, 486 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgctgacaaggccacagctgctgctgctgctgccagcctgctggccaatggacatgacctggccgccgccatggctgtggacaagagcaaccccaccagcaagcacaagagcggggctgtggccagcctgctgagcaaggccgagcgggccacagagctggccgctgagggccagctgacctag

SEQ ID NO: 148769 - DNA, 309 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgcctag

SEQ ID NO: 148770 - DNA, 36 bp, Artificial Sequence
  Description of Artificial Sequence: Synthetic coding sequence
atgagcagcctgggcggcggcagccaggatgcctag

SEQ ID NO: 148771 - DNA, 297 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggctag

SEQ ID NO: 148772 - DNA, 969 bp, Artificial Sequence; identical to SEQ ID NO: 148763
  Description of Artificial Sequence: Synthetic coding sequence

SEQ ID NO: 148773 - DNA, 594 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgctgacaaggccacagctgctgctgctgctgccagcctgctggccaatggacatgacctggccgccgccatggctgtggacaagagcaaccccaccagcaagcacaagagcggggctgtggccagcctgctgagcaaggccgagcgggccacagagctggccgctgagggccagctgaccctgcagcagtttgcccagagcacagagatgctgaagagggtggtgcaggagcacctgcccctgatgtctgaggccggggccggcctgcctgacatggaggccgtggcctag

SEQ ID NO: 148774 - DNA, 27 bp, Artificial Sequence
  Description of Artificial Sequence: Synthetic coding sequence
atgagcagcctgggcggcggcagctag

SEQ ID NO: 148775 - DNA, 222 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgtag

SEQ ID NO: 148776 - DNA, 414 bp, Artificial Sequence
  Description of Artificial Sequence: Synthetic coding sequence
atgagcagcctgggcggcggcagccaggatgctgggggcagcagcagcagcagcaccaacggcagcggcggcagcggcagcagcggccccaaggccggggctgctgacaagtctgctgtggtggccgccgccgccccagcctctgtggctgatgacaccccacctcctgagaggaggaacaagagcggcatcatcagcgagcccctgaacaagagcctgcggcgcagccggcccctgagccactacagcagctttggcagcagcggcggcagcggcggcggctccatgatgggcggggagagcgctgacaaggccacagctgctgctgctgctgccagcctgctggccaatggacatgacctggccgccgccatggctgtggacaagagcaaccccaccagcaagcacaagtag

SEQ ID NO: 148777 - DNA, 2073 bp, Artificial Sequence
  Description of Artificial Sequence: Synthetic coding sequence
atgaagctgtccatgaagaacaacatcatcaacacccagcagagctttgtgaccatgcccaacgtgattgtgcctgacatcgagaaggagatccggaggatggagaatggagcctgcagcagcttctctgaagatgatgacagcgccagcaccagcgaggagagtgaaaatgaaaacccccacgcccggggcagcttctcctacaagagcctgaggaaaggaggccccagccagcgggagcagtacctgcccggggccatcgccctcttcaacgtgaacaacagcagcaacaaggaccaggagcctgaggagaagaagaagaagaagaaggagaagaagagcaagagtgatgacaagaatgaaaacaagaatgaccctgagaagaagaagaagaagaaggacaaggagaagaagaagaaggaggagaagagcaaggacaagaaggaggaggagaagaaggaggtggtggtgattgaccccagcggcaacacctactacaactggctgttctgcatcaccctgcctgtgatgtacaactggaccatggtgattgcccgggcctgctttgatgagctgcagagcgactacctggagtactggctgatcctggactatgtgtctgacatcgtgtacctgattgacatgtttgtgaggaccaggacaggctacctggagcagggcctgctggtgaaggaggagctgaagctgatcaacaagtacaagagcaacctgcagttcaagctggatgtgctgagcctcatccccacagacctgctgtacttcaagctgggctggaactacccagagatccggctgaaccggctgctgcgcttcagcaggatgtttgagttcttccagaggacagagaccaggaccaactaccccaacatcttccgcatcagcaacctggtgatgtacatcgtcatcatcatccactggaatgcctgtgtgttctacagcatcagcaaggccatcggctttggaaatgacacctgggtgtacccagacatcaatgaccctgagtttggccgcctggccaggaaatatgtgtacagcctgtactggagcaccctgaccctgaccaccatcggggagaccccacctcctgtgcgggacagtgaatatgtgtttgtggtggtggacttcctgattggagtgctgatctttgccaccatcgtgggcaacatcggctccatgatcagcaacatgaatgctgcccgggcagagttccaggccagaattgatgccatcaagcagtacatgcacttcagaaatgtgtccaaggacatggagaagagggtcatcaagtggtttgactacctgtggaccaacaagaagacagtggatgagaaggaggtgctgaagtacctgcctgacaagctgcgggcagaaattgccatcaacgtgcacctggacaccctgaagaaggtgcgcatctttgctgactgtgaggccggcctgctggtggagctggtgctgaagctgcagccccaggtgtacagccctggggactacatctgcaagaagggggacatcggccgggagatgtacatcatcaaggagggcaagctggccgtggtggctgatgatggagtgacccagtttgtggtgctgagtgatggcagctactttggagagatcagcatcctgaacatcaagggcagcaaggccggcaacagaagaacagccaacatcaagagcatcggctacagcgacctcttctgcctgagcaaggatgacctgatggaggccctgacagagtacccagatgccaagaccatgctggaggagaagggcaagcagatcctgatgaaggatggcctgctggacctgaacatcgccaatgccggcagtgaccccaaggacctggaggagaaggtgaccaggatggagggctctgtggacctgctgcagaccaggtttgcccgcatcctggccgagtatgagagcatgcagcagaagctgaagcagaggctgaccaaggtggagaagttcctgaagcccctgattgacacagagttcagcagcattgagggccctggagctgagagcggccccatcgacagcacctag

SEQ ID NO: 148778 - DNA, 2280 bp, Artificial Sequence
  Description of Artificial Sequence: Synthetic coding sequence
atggagagccgcagcagcccccggctggagtgcagcggggccatcagcgcccactgcagcctgcacctgcctgacagcagtgacttccagctgatctttgtgttcctggtggagatgggcttccaccacgtgggccaggccggcctggagctgctgatcagcagtgacctgcccaccagcgccagccagagcgctggcatcacagacatgaagctgtccatgaagaacaacatcatcaacacccagcagagctttgtgaccatgcccaacgtcatcgtgcctgacatcgagaaggagatccggaggatggagaatggagcctgcagcagcttctctgaagatgatgattctgccagcaccagcgaggagagtgaaaatgaaaacccccacgcccggggcagcttctcctacaagagcctgaggaagggcggccccagccagcgggagcagtacctgcccggggccatcgccctcttcaacgtgaacaacagcagcaacaaggaccaggagcctgaggagaagaagaagaagaagaaggagaagaagagcaagagtgatgacaagaatgaaaacaagaatgaccctgagaagaagaagaagaagaaggacaaggagaagaagaagaaggaggagaagagcaaggacaagaaggaggaggagaagaaggaggtggtggtgattgaccccagcggcaacacctactacaactggctgttctgcatcaccctgcctgtgatgtacaactggaccatggtgattgcccgggcctgctttgatgagctgcagagcgactacctggagtactggctgatcctggactatgtgtctgacatcgtgtacctgattgacatgtttgtgaggaccaggacaggctacctggagcagggcctgctggtgaaggaggagctgaagctgatcaacaagtacaagagcaacctgcagttcaagctggatgtgctgagcctcatccccacagacctgctgtacttcaagctgggctggaactacccagagatccggctgaaccggctgctgcgcttcagcaggatgtttgagttcttccagaggacagagaccaggaccaactaccccaacatcttccgcatcagcaacctggtgatgtacatcgtcatcatcatccactggaatgcctgtgtgttctacagcatcagcaaggccatcggctttggaaatgacacctgggtgtacccagacatcaatgaccctgagtttggccgcctggccaggaaatatgtgtacagcctgtactggagcaccctgaccctgaccaccatcggggagaccccacctcctgtgcgggacagtgaatatgtgtttgtggtggtggacttcctgattggagtgctgatctttgccaccatcgtgggcaacatcggctccatgatcagcaacatgaatgctgcccgggcagagttccaggccagaattgatgccatcaagcagtacatgcacttcagaaatgtgtccaaggacatggagaagagggtcatcaagtggtttgactacctgtggaccaacaagaagacagtggatgagaaggaggtgctgaagtacctgcctgacaagctgcgggcagagatcgccatcaacgtgcacctggacaccctgaagaaggtgcgcatctttgctgactgtgaggccggcctgctggtggagctggtgctgaagctgcagccccaggtgtacagccctggggactacatctgcaagaagggggacatcggccgggagatgtacatcatcaaggagggcaagctggccgtggtggctgatgatggagtgacccagtttgtggtgctgagtgatggcagctactttggagagatcagcatcctgaacatcaagggcagcaaggccggcaacagaagaacagccaacatcaagagcatcggctacagcgacctcttctgcctgagcaaggatgacctgatggaggccctgacagagtacccagatgccaagaccatgctggaggagaagggcaagcagatcctgatgaaggatggcctgctggacctgaacatcgccaatgccggcagtgaccccaaggacctggaggagaaggtgaccaggatggagggctctgtggacctgctgcagaccaggtttgcccgcatcctggccgagtatgaatccatgcagcagaagctgaagcagaggctgaccaaggtggagaagttcctgaagcccctgattgacacagagttcagcagcattgagggccctggagctgagagcggccccatcgacagcacctag

SEQ ID NO: 148779 - DNA, 2073 bp, Artificial Sequence; identical to SEQ ID NO: 148777
  Description of Artificial Sequence: Synthetic coding sequence

SEQ ID NO: 148780 - DNA, 387 bp, Artificial Sequence
  Description of Artificial Sequence: Synthetic coding sequence
atgaagctgtccatgaagaacaacatcatcaacacccagcagagctttgtgaccatgcccaacgtgattgtgcctgacatcgagaaggagatccggaggatggagaatggagcctgcagcagcttctctgaagatgatgacagcgccagcaccagcgaggagagtgaaaatgaaaacccccacgcccggggcagcttctcctacaagagcctgaggaaaggaggccccagccagcgggagcagtacctgcccggggccatcgccctcttcaacgtgaacaacagcagcaacaaggaccaggagcctgaggagaagaagaagaagaagaaggagaagaagagcaagagtgatgacaagaatgaaaacaagaatgaccctgagaagtag

SEQ ID NO: 148781 - DNA, 300 bp, Artificial Sequence
  Description of Artificial Sequence: Synthetic coding sequence
atgaagctgtccatgaagaacaacatcatcaacacccagcagagctttgtgaccatgcccaacgtgattgtgcctgacatcgagaaggagatccggaggatggagaatggagcctgcagcagcttctctgaagatgatgacagcgccagcaccagcgaggagagtgaaaatgaaaacccccacgcccggggcagcttctcctacaagagcctgaggaaaggaggccccagccagcgggagcagtacctgcccggggccatcgccctcttcaacgtgaacaacagcagcaacaaggactag

SEQ ID NO: 148782 - DNA, 2073 bp, Artificial Sequence; identical to SEQ ID NO: 148777
  Description of Artificial Sequence: Synthetic coding sequence

SEQ ID NO: 148783 - DNA, 300 bp, Artificial Sequence; identical to SEQ ID NO: 148781
  Description of Artificial Sequence: Synthetic coding sequence

SEQ ID NO: 148784 - DNA, 2073 bp, Artificial Sequence; identical to SEQ ID NO: 148777
  Description of Artificial Sequence: Synthetic coding sequence

SEQ ID NO: 148785 - DNA, 1995 bp, Artificial Sequence
  Description of Artificial Sequence: Synthetic coding sequence
atgacagagaagaccaacggggtgaagagcagccctgccaacaaccacaaccaccacgcccccccagccatcaaggccaacgggaaggatgaccacaggaccagcagccggccccacagcgctgctgatgatgacaccagcagcgagctgcagaggctggctgatgtggatgccccccagcagggccgcagcggcttcagaagaattgtgcggctggtgggcatcatccgggagtgggccaacaagaacttccgggaggaggagcccaggccagacagcttcctggagcgcttccggggccctgagctgcagacagtgaccacccaggagggagatggcaagggggacaaggatggagaggacaagggcaccaagaagaagtttgagctgtttgtgctggaccctgctggggactggtactactgctggctgtttgtgattgccatgcctgtgctgtacaactggtgcctgctggtggcccgggcctgcttcagtgacctgcagaagggctactacctggtgtggctggtgctggactatgtgtctgatgtggtgtacatcgctgacctcttcatccggctgaggacaggcttcctggagcagggcctgctggtgaaggacaccaagaagctgcgggacaactacatccacaccctgcagttcaagctggatgtggccagcatcatccccacagacctgatctactttgctgtggacatccacagccctgaggtgcgcttcaaccggctgctgcactttgccaggatgtttgagttctttgacagaacagagaccaggaccaactaccccaacatcttccgcatcagcaacctggtgctgtacatcctggtgatcatccactggaatgcctgcatctactatgccatcagcaagagcatcggcttcggcgtggacacctgggtgtaccccaacatcacagatcctgaatatggctacctggcccgggagtacatctactgcctgtactggagcaccctgaccctgaccaccatcggggagaccccacctcctgtgaaggatgaggagtacctgtttgtgatctttgacttcctgattggagtgctgatctttgccaccatcgtgggcaatgtgggctccatgatcagcaacatgaatgccaccagggctgagttccaggccaagattgatgctgtgaagcactacatgcagttcaggaaggtgtccaagggcatggaggccaaggtgatccgctggtttgactacctgtggaccaacaagaagacagtggatgagcgggagatcctgaagaacctgcctgccaagctgcgggcagagatcgccatcaacgtgcacctgagcaccctgaagaaggtgcgcatcttccatgactgtgaggccggcctgctggtggagctggtgctgaagctgcggccccaggtgttcagccctggggactacatctgcaggaagggggacatcggcaaggagatgtacatcatcaaggagggcaagctggccgtggtggctgatgatggagtgacccagtatgccctgctgtctgctggcagctgctttggagagatcagcatcctgaacatcaagggcagcaagatgggcaacagaagaacagccaacatccgcagcctgggctacagcgacctcttctgcctgagcaaggatgacctgatggaggccgtgacagagtacccagatgccaagaaggtgctggaggagcggggccgggagatcctgatgaaggagggcctgctggatgaaaatgaggtggccacctccatggaggtggatgtgcaggagaagctgggccagctggagaccaacatggagaccctgtacaccaggtttggccgcctgctggccgagtacacaggagcccagcagaagctgaagcagaggatcaccgtgctggagaccaagatgaagcagaacaatgaagatgactacctgagtgatggcatgaacagccctgagctggccgctgctgatgagccctag

SEQ ID NO: 148786 - DNA, 2085 bp, Artificial Sequence
  Description of Artificial Sequence: Synthetic coding sequence
atggccaagatcaacacccagtacagccaccccagcaggacccacctgaaggtgaagaccagtgaccgggacctgaacagagcagaaaatggcctgagccgggcccacagcagcagcgaggagaccagctctgtgctgcagcccggcatcgccatggagacccggggcctggccgacagcggccagggcagcttcaccggccagggcatcgcccggctgagccgcctcatcttcctgctgcggcgctgggccgcccggcacgtgcaccaccaggaccagggccctgacagcttcccagaccgcttcagaggagctgagctgaaggaggtgagcagccaggagagcaatgcccaggccaacgtgggcagccaggagcctgctgaccggggccgcagcgcctggcccctggccaagtgcaacaccaacaccagcaacaacacagaggaggagaagaagaccaagaagaaggatgccatcgtggtggaccccagcagcaacctgtactaccgctggctgacagccatcgccctgcccgtcttctacaactggtacctgctgatctgccgggcctgctttgatgagctgcagagcgagtacctgatgctgtggctggtgctggactacagcgcagatgtgctgtatgtgctggatgtgctggtgcgggccaggacaggcttcctggagcagggcctgatggtgtctgacaccaaccggctgtggcagcactacaagaccaccacccagttcaagctggatgtgctgagcctggtgcccacagacctggcctacctgaaggtgggcaccaactacccagaggtgcgcttcaaccggctgctgaagttcagccggctgtttgagttctttgacagaacagagaccaggaccaactaccccaacatgttcagaattggcaacctggtgctgtacatcctgatcatcatccactggaatgcctgcatctactttgccatcagcaagttcatcggcttcggcacagacagctgggtgtaccccaacatcagcatccctgagcacggccgcctgagcaggaagtacatctacagcctgtactggagcaccctgaccctgaccaccatcggggagaccccacctcctgtgaaggatgaggagtacctgtttgtggtggtggacttcctggtgggcgtgctgatctttgccaccatcgtgggcaatgtgggctccatgatcagcaacatgaatgccagcagagctgagttccaggccaagattgacagcatcaagcagtacatgcagttcaggaaggtgaccaaggacctggagaccagggtcatccgctggtttgactacctgtgggccaacaagaagacagtggatgagaaggaggtgctgaagagcctgcctgacaagctgaaggccgagatcgccatcaacgtgcacctggacaccctgaagaaggtgcgcatcttccaggactgtgaggccggcctgctggtggagctggtgctgaagctgcggcccaccgtcttcagccctggggactacatctgcaagaagggggacatcggcaaggagatgtacatcatcaatgaaggcaagctggccgtggtggctgatgatggagtgacccagtttgtggtgctgagtgatggcagctactttggagagatcagcatcctgaacatcaagggcagcaagagcggcaacagaagaacagccaacatccgcagcatcggctacagcgacctcttctgcctgagcaaggatgacctgatggaggccctgacagagtacccagaggccaagaaggccctggaggagaagggccggcagatcctgatgaaggacaacctgattgatgaggagctggcccgggccggggctgaccccaaggacctggaggagaaggtggagcagctgggcagcagcctggacaccctgcagaccaggtttgcccggctgctggccgagtacaatgccacccagatgaagatgaagcagaggctgagccagctggagagccaggtgaagggcggcggggacaagcccctggctgatggagaggtgcctggagatgccaccaagacagaggacaagcagcagtag

SEQ ID NO: 148787 - DNA, 2085 bp, Artificial Sequence; identical to SEQ ID NO: 148786
  Description of Artificial Sequence: Synthetic coding sequence

SEQ ID NO: 148788 - DNA, 2031 bp, Artificial Sequence
  Description of Artificial Sequence: Synthetic coding sequence
atggccaagatcaacacccagtacagccaccccagcaggacccacctgaaggtgaagaccagtgaccgggacctgaacagagcagaaaatggcctgagccgggcccacagcagcagcgaggagaccagctctgtgctgcagcccggcatcgccatggagacccggggcctggccgacagcggccagggcagcttcaccggccagggcatcgcccggctgagccgcctcatcttcctgctgcggcgctgggccgcccggcacgtgcaccaccaggaccagggccctgacagcttcccagaccgcttcagaggagctgagctgaaggaggtgagcagccaggagagcaatgcccaggccaacgtgggcagccaggagcctgctgaccggggccgcaggaagaagaccaagaagaaggatgccatcgtggtggaccccagcagcaacctgtactaccgctggctgacagccatcgccctgcccgtcttctacaactggtacctgctgatctgccgggcctgctttgatgagctgcagagcgagtacctgatgctgtggctggtgctggactacagcgcagatgtgctgtatgtgctggatgtgctggtgcgggccaggacaggcttcctggagcagggcctgatggtgtctgacaccaaccggctgtggcagcactacaagaccaccacccagttcaagctggatgtgctgagcctggtgcccacagacctggcctacctgaaggtgggcaccaactacccagaggtgcgcttcaaccggctgctgaagttcagccggctgtttgagttctttgacagaacagagaccaggaccaactaccccaacatgttcagaattggcaacctggtgctgtacatcctgatcatcatccactggaatgcctgcatctactttgccatcagcaagttcatcggcttcggcacagacagctgggtgtaccccaacatcagcatccctgagcacggccgcctgagcaggaagtacatctacagcctgtactggagcaccctgaccctgaccaccatcggggagaccccacctcctgtgaaggatgaggagtacctgtttgtggtggtggacttcctggtgggcgtgctgatctttgccaccatcgtgggcaatgtgggctccatgatcagcaacatgaatgccagcagagctgagttccaggccaagattgacagcatcaagcagtacatgcagttcaggaaggtgaccaaggacctggagaccagggtcatccgctggtttgactacctgtgggccaacaagaagacagtggatgagaaggaggtgctgaagagcctgcctgacaagctgaaggccgagatcgccatcaacgtgcacctggacaccctgaagaaggtgcgcatcttccaggactgtgaggccggcctgctggtggagctggtgctgaagctgcggcccaccgtcttcagccctggggactacatctgcaagaagggggacatcggcaaggagatgtacatcatcaatgaaggcaagctggccgtggtggctgatgatggagtgacccagtttgtggtgctgagtgatggcagctactttggagagatcagcatcctgaacatcaagggcagcaagagcggcaacagaagaacagccaacatccgcagcatcggctacagcgacctcttctgcctgagcaaggatgacctgatggaggccctgacagagtacccagaggccaagaaggccctggaggagaagggccggcagatcctgatgaaggacaacctgattgatgaggagctggcccgggccggggctgaccccaaggacctggaggagaaggtggagcagctgggcagcagcctggacaccctgcagaccaggtttgcccggctgctggccgagtacaatgccacccagatgaagatgaagcagaggctgagccagctggagagccaggtgaagggcggcggggacaagcccctggctgatggagaggtgcctggagatgccaccaagacagaggacaagcagcagtag

SEQ ID NO: 148789 - DNA, 3756 bp, Artificial Sequence
  Description of Artificial Sequence: Synthetic coding sequence
atgctgggctgggtgcagagggtgctgccccagcccccaggcacccccaggaagaccaagatgcaggaggaggaggaggtggagcctgagcctgagatggaggccgaggtggagcctgagcccaaccctgaggaggccgagacagagagcgagagcatgcctcctgaggagagcttcaaggaggaggaggtggccgtggccgaccccagcccccaggagaccaaggaggccgccctgaccagcaccatcagcctgcgggcccagggcgctgagatcagcgagatgaacagccccagccggcgggtgctgacctggctgatgaagggcgtggagaaggtgatcccccagcctgtgcacagcatcacagaagatcctgcccagatcctgggccacggcagcactggagacaccggctgcacagatgagcccaatgaggccctggaggcccaggacacccggcccggcctgcggctgctgctgtggctggagcagaacctggagcgggtgctgccccagccccccaagagcagcgaggtgtggagagatgagcctgctgtggccaccggggccgccagtgaccctgcccctcctggccggccccaggagatgggccccaagctgcaggcccgggagacccccagcctgcccacccccatccccctgcagcccaaggaggagcccaaggaggccccagcccctgagccccagcccggcagccaggcccagaccagcagcctgccccccacccgggaccctgcccggctggtggcctgggtgctgcaccggctggagatggccctgccccagcctgtgctgcacggcaagatcggggagcaggagccagacagccctggcatctgtgatgtgcagaccatcagcatcctgcccggcggccaggtggagccagacctggtgctggaggaggtggagcccccctgggaggatgcccaccaggatgtgtccaccagcccccagggcacagaggtggtgcctgcctatgaggaggagaacaaggctgtggagaagatgccccgggagctgagccgcatcgaggaggagaaggaggatgaggaggaggaggaggaggaggaggaggaggaggaggaggaggaggtgacagaggtgctgctggacagctgtgtggtgtcccaggtgggcgtgggccagagcgaggaggatggcacccggccccagagcaccagtgaccagaagctgtgggaggaggtgggggaggaggccaagaaggaggccgaggagaaggccaaggaggaggccgaggaggtggccgaggaggaggccgagaaggagccccaggactgggccgagaccaaggaggagcctgaggccgaggccgaggccgccagcagcggcgtgcctgccaccaagcagcaccctgaggtgcaggtggaggacacagatgctgacagctgccccctgatggccgaggagaacccccccagcacagtgctgcccccacccagccctgccaagagtgacaccctcatcgtgcccagcagcgccagcggcacccacaggaagaagctgcccagtgaagatgatgaggccgaggagctgaaggccctgagccctgctgagagccctgtggtggcctggagcgaccccaccacccccaaggacacagatggccaggacagagctgccagcacagccagcaccaacagcgccatcatcaatgaccggctgcaggagctggtgaagctgttcaaggagaggacagagaaggtgaaggagaagctgattgatcctgatgtgaccagtgatgaggagagccccaagcccagccctgccaagaaggcccctgagcccgccccagacaccaagccagctgaggccgagcctgtggaggaggagcactactgtgacatgctgtgctgcaagttcaagcaccggccctggaagaagtaccagttcccccagagcattgaccccctgaccaacctgatgtatgtgctgtggctgttctttgtggtgatggcctggaactggaactgctggctgatccctgtgcgctgggccttcccctaccagaccccagacaacatccaccactggctgctgatggactacctgtgtgacctgatctacttcctggacatcaccgtcttccagacccggctgcagtttgtgcggggcggggacatcatcacagacaagaaggacatgaggaacaactacctgaagagccgccgcttcaagatggacctgctgagcctgctgcccctggacttcctgtacctgaaggtgggcgtgaaccccctgctgcggctgccccgctgcctgaagtacatggccttctttgagttcaacagccggctggagagcatcctgagcaaggcctacgtgtacagagtcatccgcaccacagcctacctgctgtacagcctgcacctgaacagctgcctgtactactgggccagcgcctaccagggcctgggcagcacccactgggtgtatgatggagtgggcaacagctacatccgctgctactactttgctgtgaagaccctcatcaccatcggcggcctgcctgaccccaagaccctgtttgagatcgtgttccagctgctgaactacttcaccggggtgtttgccttctctgtgatgattggccagatgagagatgtggtgggcgccgccacagctggccagacctactaccgcagctgcatggacagcacagtgaagtacatgaacttctacaagatccccaagtctgtgcagaacagagtgaagacctggtatgagtacacctggcacagccagggcatgctggatgagagcgagctgatggtgcagctgcctgacaagatgaggctggacctggccattgatgtgaactacaacatcgtgtccaaggtggccctcttccagggctgtgaccggcagatgatctttgacatgctgaagaggctgcggtctgtggtgtacctgcccaatgactatgtgtgcaagaagggggagatcggccgggagatgtacatcatccaggccggccaggtgcaggtgctgggcggcccagatggcaagtctgtgctggtgaccctgaaggccggctctgtgtttggagagatcagcctgctggccgtgggcggcggcaacagaagaacagccaacgtggtggcccacggcttcaccaacctcttcatcctggacaagaaggacctgaatgagatcctggtgcactacccagagagccagaagctgctgaggaagaaggcccggaggatgctgcggagcaacaacaagcccaaggaggagaagtctgtgctgatcctgccccccagggctggcacccccaagctgttcaatgctgccctggccatgaccgggaagatgggcggcaagggggccaagggcggcaagctggcccacctgcgggcccggctgaaggagctggccgccctggaggccgccgccaagcagcaggagctggtggagcaggccaagagcagccaggatgtgaagggggaggagggcagcgctgccccagaccagcacacccaccccaaggaggccgccacagatcctccagcccccaggaccccacctgagcccccaggcagcccccccagcagccccccaccagccagcctgggccggcctgagggggaggaggagggccctgctgagcctgaggagcacagcgtgcgcatctgcatgagccctggccctgagcctggagagcagatcctgtctgtgaagatgcctgaggagcgggaggagaaggccgagtag

SEQ ID NO: 148790 - DNA, 900 bp, Artificial Sequence
  Description of Artificial Sequence: Synthetic coding sequence
atgctgggctgggtgcagagggtgctgccccagcccccaggcacccccaggaagaccaagatgcaggaggaggaggaggtggagcctgagcctgagatggaggccgaggtggagcctgagcccaaccctgaggaggccgagacagagagcgagagcatgcctcctgaggagagcttcaaggaggaggaggtggccgtggccgaccccagcccccaggagaccaaggaggccgccctgaccagcaccatcagcctgcgggcccagggcgctgagatcagcgagatgaacagccccagccggcgggtgctgacctggctgatgaagggcgtggagaaggtgatcccccagcctgtgcacagcatcacagaagatcctgcccagatcctgggccacggcagcactggagacaccggctgcacagatgagcccaatgaggccctggaggcccaggacacccggcccggcctgcggctgctgctgtggctggagcagaacctggagcgggtgctgccccagccccccaagagcagcgaggtgtggagagatgagcctgctgtggccaccggggccgccagtgaccctgcccctcctggccggccccaggagatgggccccaagctgcaggcccgggagacccccagcctgcccacccccatccccctgcagcccaaggaggagcccaaggaggccccagcccctgagccccagcccggcagccaggcccagaccagcagcctgccccccacccgggaccctgcccggctggtggcctgggtgctgcaccggctggagatggccctgccccagcctgtgctgcacggcaagatcggggagcaggagccagacagccctggcatctgtgatgtgcagaccagggtgatgggcgctgggggcctgtag

SEQ ID NO: 148791 - DNA, 2430 bp, Artificial Sequence
  Description of Artificial Sequence: Synthetic coding sequence
atgttcaagagcctgaccaaggtgaacaaggtgaagcccatcggggagaacaatgaaaatgagcagagcagcagaagaaatgaggagggcagccaccccagcaaccagagccagcagaccacagcccaggaggagaacaagggggaggagaagagcctgaagaccaagagcacccctgtgaccagcgaggagccccacaccaacatccaggacaagctgagcaagaagaacagcagcggggacctgaccaccaacccagacccccagaatgctgctgagcccactggaacagtgcctgagcagaaggagatggaccccgggaaggagggccccaacagcccccagaacaagcccccagctgcccctgtgatcaatgaatatgcagatgcccagctgcacaacctggtgaagaggatgaggcagaggacagccctgtacaagaagaagctggtggagggggacctgagcagccctgaggccagcccccagacagccaagcccacagctgtgccccctgtgaaggagagtgatgacaagcccacagagcactactaccgcctgctgtggttcaaggtgaagaagatgcccctgacagagtacctgaagaggatcaagctgcccaacagcattgacagctacacagaccggctgtacctgctgtggctgctgctggtgaccctggcctacaactggaactgctgcttcatccccctgcggctggtgttcccctaccagacagctgacaacatccactactggctgattgctgacatcatctgtgacatcatctacctgtatgacatgctgttcatccagccccggctgcagtttgtgcggggcggggacatcatcgtggacagcaatgagctgaggaagcactaccgcaccagcaccaagttccagctggatgtggccagcatcatcccctttgacatctgctacctgttcttcggcttcaaccccatgttccgggccaacaggatgctgaagtacaccagcttctttgagttcaaccaccacctggagagcatcatggacaaggcctacatctacagagtcatccgcaccaccggctacctgctcttcatcctgcacatcaatgcctgtgtgtactactgggccagcaactatgagggcatcggcaccacccgctgggtgtatgatggagagggcaatgagtacctgcgctgctactactgggccgtgaggaccctcatcaccatcggcggcctgcctgagccccagaccctgtttgagatcgtgttccagctgctgaacttcttctctggagtgtttgtgttcagcagcctcatcggccagatgagagatgtgattggagctgccacagccaaccagaactacttccgggcctgcatggatgacaccatcgcctacatgaacaactacagcatccccaagctggtgcagaagagggtgaggacctggtatgagtacacctgggacagccagaggatgctggatgaaagtgacctgctgaagaccctgcccaccaccgtgcagctggccctggccattgatgtgaacttcagcatcatcagcaaggtggacctcttcaagggctgtgacacccagatgatctatgacatgctgctgcggctgaagtctgtgctgtacctgcccggggactttgtgtgcaagaagggggagatcggcaaggagatgtacatcatcaagcacggggaggtgcaggtgctgggcggcccagatggcaccaaggtgctggtgaccctgaaggccggctctgtgtttggagagatcagcctgctggccgccggcggcggcaacagaagaacagccaacgtggtggcccacggctttgccaacctgctgaccctggacaagaagaccctgcaggagatcctggtgcactacccagacagcgagcgcatcctgatgaagaaggcccgggtgctgctgaagcagaaggccaagacagctgaggccaccccacccaggaaggacctggccctgctcttcccccccaaggaggagacccccaagctgttcaagaccctgctgggcggcaccgggaaggccagcctggcccggctgctgaagctgaagcgggagcaggccgcccagaagaaggagaacagcgagggcggggaggaggagggcaaggaaaatgaagacaagcagaaggaaaatgaagacaagcagaaggaaaatgaagataaaggcaaggaaaatgaagacaaggacaagggccgggagcctgaggagaagcccctggacagaccagaatgtacagccagccccatcgctgtggaggaggagccccacagcgtgagaagaacagtgctgccccggggcaccagccggcagagcctcatcatctccatggcccccagcgctgagggcggggaggaggtgctgaccatcgaggtgaaggagaaggccaagcagtag

SEQ ID NO: 148792 - DNA, 4188 bp, Artificial Sequence
  Description of Artificial Sequence: Synthetic coding sequence
atgctgctgcccctgcccccccagagcagcaagcctgtgcccaagaagagccagagcagcaagatcgtgcccagccaccacgaccccagcgagaagacaggagagaactgccagaccaagatcagccccagcagcctgcaggagagccccagcagcctgcagggcgccctgaagaagaggtctgcctttgaggacctgaccaatgccagccagtgccagcctgtgcagcccaagaaggaggccaacaaggagtttgtgaaggtggtgtccaagaagatcaacagaaacacccacgccctgggcctggccaagaagaacaagaggaacctgaagtggcacaagctggaggtgacccctgtggtggccagcaccaccgtggtgcccaacatcatggagaagcccctcatcctggacatcagcaccaccagcaagacccccaacacagaggaggccagcctcttcaggaagcccctggtgctgaaggaggagcccaccattgaagatgagaccctcatcaacaagagcctgagcctgaagaagtgcagcaaccacgaggaggtgtccctgctggagaagctgcagcccctgcaggaggagagtgacagtgatgatgccttcgtcatcgagcccatgaccttcaagaagacccacaagacagaggaggccgccatcaccaagaagaccctgagcctgaagaagaagatgtgtgccagccagaggaagcagagctgccaggaggagagcctggccgtgcaggatgtgaacatggaggaggacagcttcttcatggagagcatgtccttcaagaagaagcccaagacagaggagagcatccccacccacaagctgagcagcctgaagaagaagtgcaccatctacggcaagatctgccacttcaggaagccccctgtgctgcagaccaccatctgtggggccatgagcagcatcaagaagcccaccacagagaaggagaccctcttccaggagctgtctgtgctgcaggagaagcacaccacagaacatgagatgagcatcctgaagaagagcctggccctgcagaagaccaacttcaaggaggacagcctggtgaaggagagcctggccttcaagaagaagcccagcacagaggaggccatcatgatgcctgtgatcctgaaggagcagtgcatgacagagggcaagaggagccggctgaagcccctggtgctgcaggagatcaccagcggggagaagagcctcatcatgaagcccctgagcatcaaggagaagcccagcacagagaaggagagcttcagccaggagcccagcgccctgcagaagaagcacaccacccaggaggaggtgtccatcctgaaggagcccagcagcctgctgaagagccccacagaggagagcccctttgatgaggccctggccttcaccaagaagtgcaccatcgaggaggccccacccaccaagaagcccctcatcctgaagaggaagcacgccacccagggcaccatgagccacctgaagaagcccctcatcctgcagaccaccagcggggagaagagcctcatcaaggagcccctgcccttcaaggaggagaaggtgtccctgaagaagaagtgcaccacccaggagatgatgagcatctgcccagagctgctggacttccaggacatgattggagaggacaagaacagcttcttcatggagcccatgtccttcaggaagaaccccaccacagaggagaccgtgctgaccaagaccagcctgagcctgcaggagaagaagatcacccagggcaagatgagccacctgaagaagcccctggtgctgcagaagatcaccagcgaggaggagagcttctacaagaagctgctgcccttcaagatgaagagcaccacagaggagaagttcctgagccaggagcccagcgccctgaaggagaagcacaccaccctgcaggaggtgtccctgagcaaggagagcctggccatccaggagaaggccaccacagaggaggagttcagccaggagctgttcagcctgcacgtgaagcacaccaacaagagcggcagcctcttccaggaggccctggtgctgcaggagaagacagatgctgaggaggacagcctgaagaacctgctggccctgcaggagaagagcaccatggaggaggagagcctcatcaacaagctgctggccctgaaggaggagctgtctgctgaggccgccaccaacatccagacccagctgagcctgaagaagaagagcaccagccacggcaaggtgttcttcctgaagaagcagctggccctgaatgagaccatcaatgaggaggagttcctgaacaagcagcccctggccctggagggctaccccagcattgctgagggggagaccctcttcaagaagctgctggccatgcaggaggagcccagcattgagaaggaggccgtgctgaaggagcccaccatcgacacagaggcccacttcaaggagcccctggccctgcaggaggagcccagcacagagaaggaggccgtgctgaaggagcccagcgtggacacagaggcccacttcaaggagaccctggccctgcaggagaagcccagcattgagcaggaggccctcttcaagaggcacagcgccctgtgggagaagcccagcacagagaaggagaccatcttcaaggagagcctggacctgcaggagaagcccagcatcaagaaggagaccctgctgaagaagcccctggccctgaagatgagcaccatcaatgaggccgtgctgtttgaggacatgattgccctgaatgagaagcccaccaccgggaaggagctgtccttcaaggagcccctggccctgcaggagagccccacctacaaggaggacaccttcctgaagaccctgctggtgccccaggtgggcaccagccccaacgtgagcagcacagcccctgagagcatcaccagcaagagcagcatcgccaccatgacctctgtgggcaagagcggcaccatcaatgaggccttcctgtttgaggacatgatcaccctgaatgagaagcccaccaccgggaaggagctgtccttcaaggagcccctggccctgcaggagagccccacctgcaaggaggacaccttcctggagaccttcctgatcccccagatcggcaccagcccctacgtgttcagcaccaccccagagagcatcacagagaagagcagcatcgccaccatgacctctgtgggcaagagcaggaccaccacagagagcagcgcctgtgagagcgccagtgacaagcctgtgagcccccaggccaagggcacccccaaggagatcaccccccgggaggacattgatgaggacagcagtgaccccagcttcaaccccatgtatgccaaggagatcttctcctacatgaaggagcgggaggagcagttcatcctgacagactacatgaaccggcagatcgagatcaccagtgacatgagggccatcctggtggactggctggtggaggtgcaggtgtcctttgagatgacccatgagaccctgtacctggccgtgaagctggtggacctgtacctgatgaaggctgtgtgcaagaaggacaagctgcagctgctgggcgccacagccttcatgattgctgccaagtttgaggagcacaacagcccccgggtggatgactttgtgtacatctgtgatgacaactaccagaggtctgaggtgctgtccatggagatcaacatcctgaatgtgctgaagtgtgacatcaacatccccatcgcctaccacttcctgcggcgctatgcccgctgcatccacaccaacatgaagaccctgaccctgagccgctacatctgtgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgcggcagctgaacaagctgctgaccttcagcagctatgacagcctgaaggctgtgtactacaagtacagccaccctgtgttctttgaggtggccaagatcccagccctggacatgctgaagctggaggagatcctgaactgtgactgtgaggcccagggcctggtgctgtag

SEQ ID NO: 148793 - DNA, 876 bp, Artificial Sequence
  Description of Artificial Sequence: Synthetic coding sequence
atgctgctgcccctgcccccccagagcagcaagcctgtgcccaagaagagccagagcagcaagatcgtgcccagccaccacgaccccagcgagaagacaggagagaactgccagaccaagatcagccccagcagcctgcaggagagccccagcagcctgcagggcgccctgaagaagaggtctgcctttgaggacctgaccaacgtgtcctttgagatgacccatgagaccctgtacctggccgtgaagctggtggacctgtacctgatgaaggctgtgtgcaagaaggacaagctgcagctgctgggcgccacagccttcatgattgctgccaagtttgaggagcacaacagcccccgggtggatgactttgtgtacatctgtgatgacaactaccagaggtctgaggtgctgtccatggagatcaacatcctgaatgtgctgaagtgtgacatcaacatccccatcgcctaccacttcctgcggcgctatgcccgctgcatccacaccaacatgaagaccctgaccctgagccgctacatctgtgagatgaccctgcaggagtaccactacgtgcaggagaaggccagcaagctggccgccgccagcctgctgctggccctgtacatgaagaagctgggctactgggtgcccttcctggagcactacagcggctacagcatcagcgagctgcaccccctggtgcggcagctgaacaagctgctgaccttcagcagctatgacagcctgaaggctgtgtactacaagtacagccaccctgtgttctttgaggtggccaagatcccagccctggacatgctgaagctggaggagatcctgaactgtgactgtgaggcccagggcctggtgctgtag

SEQ ID NO: 148794 - DNA, 876 bp, Artificial Sequence; identical to SEQ ID NO: 148793
  Description of Artificial Sequence: Synthetic coding sequence

SEQ ID NO: 148795 - DNA, 4188 bp, Artificial Sequence; identical to SEQ ID NO: 148792
  Description of Artificial Sequence: Synthetic coding sequence

SEQ ID NO: 148796 - DNA, 336 bp, Artificial Sequence
  Description of Artificial Sequence: Synthetic coding sequence
atgctgctgcccctgcccccccagagcagcaagcctgtgcccaagaagagccagagcagcaagatcgtgcccagccaccacgaccccagcgagaagacaggagagaactgccagaccaagatcagccccagcagcctgcaggagagccccagcagcctgcagggcgccctgaagaagaggtctgcctttgaggacctgaccaatgccagccagtgccagcctgtgcagcccaagaaggaggccaacaaggagtttgtgaaggtggtgtccaagaagatcaacagaaacacccacgccctgggcctggccaagaagaacaagaggaacctgaagtag

SEQ ID NO: 148797 - DNA, 1083 bp, Artificial Sequence
  Description of Artificial Sequence: Synthetic coding sequence
atggccagcgccacagccccagctgctgctgtgcccaccctggccagccccctggagcagctgcggcacctggccgaggagctgcggctgctgctgccccgggtgcgggtgggggaggcccaggagaccacagaggagttcaaccgggagatgttctggaggcggctgaatgaagctgctgtgacagtgtcccgggaggccaccaccctgaccatcgtgttcagccagctgcccctgcccagcccccaggagacccagaagttctgtgagcaggtgcacgccgccatcaaggccttcatcgctgtgtactacctgctgcccaaggaccagggcatcaccctgaggaagctggtgcggggggccaccctggacatcgtggatggcatggcccagctgatggaggtgctgtctgtgacccccacccagagcccagaaaataatgacctgatctcctacaacagcgtgtgggtggcctgccagcagatgccccagatcccccgggacaacaaggccgccgccctgctgatgctgaccaagaatgtggactttgtgaaggatgcccacgaggagatggagcaggccgtggaggagtgtgacccctacagcggcctgctgaatgacacagaggagaacaacagcgacaaccacaaccatgaagatgatgtgctgggcttccccagcaaccaggacctgtactggagcgaagatgaccaggagctgatcatcccctgcctggccctggtgcgggccagcaaggcctgcctgaagaagatccgcatgctggtggccgagaatggcaagaaggaccaggtggcccagctggatgacatcgtggacatcagtgatgagatcagccccagcgtggatgacctggccctgagcatctacccacccatgtgccacctgactgtgcgcatcaacagcgccaagctggtgtctgtgctgaagaaggccctggagatcaccaaggccagccacgtgaccccccagcctgaggacagctggatccccctgctgatcaatgccatcgaccactgcatgaaccgcatcaaggagctgacccagagcgagctggagctgtag

SEQ ID NO: 148798 - DNA, 600 bp, Artificial Sequence
  Description of Artificial Sequence: Synthetic coding sequence
atgccccagatcccccgggacaacaaggctgctgccctgctgatgctgaccaagaatgtggactttgtgaaggatgcccacgaggagatggagcaggccgtggaggagtgtgacccctacagcggcctgctgaatgacacagaggagaacaacagcgacaaccacaaccatgaagatgatgtgctgggcttccccagcaaccaggacctgtactggagcgaagatgaccaggagctgatcatcccctgcctggccctggtgcgggccagcaaggcctgcctgaagaagatccgcatgctggtggctgaaaatggcaagaaggaccaggtggcccagctggatgacatcgtggacatcagtgatgagatcagccccagcgtggatgacctggccctgagcatctacccacccatgtgccacctgactgtgcgcatcaacagcgccaagctggtgtctgtgctgaagaaggccctggagatcaccaaggccagccacgtgaccccccagccagaagattcctggatccccctgctgatcaatgccatcgaccactgcatgaaccgcatcaaggagctgacccagagcgagctggagctgtag

SEQ ID NO: 148799 - DNA, 699 bp, Artificial Sequence
  Description of Artificial Sequence: Synthetic coding sequence
atggcccagctgatggaggtgctgtctgtgacccccacccagagcccagaaaataatgacctgatctcctacaacagcgtgtgggtggcctgccagcagatgccccagatcccccgggacaacaaggccgccgccctgctgatgctgaccaagaatgtggactttgtgaaggatgcccacgaggagatggagcaggccgtggaggagtgtgacccctacagcggcctgctgaatgacacagaggagaacaacagcgacaaccacaaccatgaagatgatgtgctgggcttccccagcaaccaggacctgtactggagcgaagatgaccaggagctgatcatcccctgcctggccctggtgcgggccagcaaggcctgcctgaagaagatccgcatgctggtggccgagaatggcaagaaggaccaggtggcccagctggatgacatcgtggacatcagtgatgagatcagccccagcgtggatgacctggccctgagcatctacccacccatgtgccacctgactgtgcgcatcaacagcgccaagctggtgtctgtgctgaagaaggccctggagatcaccaaggccagccacgtgaccccccagcctgaggacagctggatccccctgctgatcaatgccatcgaccactgcatgaaccgcatcaaggagctgacccagagcgagctggagctgtag

SEQ ID NO: 148800 - DNA, 3936 bp, Artificial Sequence
  Description of Artificial Sequence: Synthetic coding sequence
atgagcctgctgcagagcgccctggacttcctggccggccctggcagcctgggcggggccagcggccgggaccagagcgactttgtgggccagacagtggagctgggggagctgcggctgcgggtgagaagagtgctggccgagggcggctttgcctttgtgtatgaggcccaggatgtgggcagcggccgggagtatgccctgaagaggctgctgagcaatgaggaggagaagaacagagccatcatccaggaggtgtgcttcatgaagaagctgagcggccaccccaacatcgtgcagttctgcagcgctgccagcatcggcaaggaggagagtgacaccggccaggccgagttcctgctgctgacagagctgtgcaagggccagctggtggagttcctgaagaagatggagagccggggccccctgagctgtgacacagtgctgaagatcttctaccagacctgcagagctgtgcagcacatgcaccggcagaagccacccatcatccaccgggacctgaaggtggagaacctgctgctgagcaaccagggcaccatcaagctgtgtgactttggcagcgccaccaccatcagccactacccagactacagctggagcgcccagaggcgggccctggtggaggaggagatcaccaggaacaccacccccatgtaccgcaccccagagatcatcgacctgtacagcaacttccccatcggggagaagcaggacatctgggccctgggctgcatcctgtacctgctgtgcttccggcagcacccctttgaagatggagccaagctgagaattgtgaatggcaagtacagcatcccccctcatgacacccagtacaccgtcttccacagcctcatccgggccatgctgcaggtgaaccctgaggagcggctgagcattgctgaggtggtgcaccagctgcaggagattgctgctgccagaaatgtgaaccccaagagccccatcacagagctgctggagcagaatggaggctacggcagcgccaccctgagccggggccccccacctcctgtgggccctgctggcagcggctacagcggcggcctggccctggccgagtatgaccagccctatggaggcttcctggacatcctgcggggcggcacagagcggctcttcaccaacctgaaggacaccagcagcaaggtgatccagagcgtggccaactatgccaagggggacctggacatctcctacatcaccagcagaattgctgtgatgtccttccctgctgagggcgtggagagcgccctgaagaacaacattgaagatgtgcggctcttcctggacagcaagcaccctggccactatgctgtgtacaacctgagccccaggacctaccggcccagccgcttccacaacagagtgtctgaatgtggctgggccgcccggcgggccccccacctgcacaccctgtacaacatctgcaggaacatgcacgcctggctgcggcaggaccacaagaatgtgtgtgtggtgcactgcatggatggccgggccgccagcgctgtggccgtgtgcagcttcctgtgcttctgccgcctcttcagcacagctgaggccgctgtgtacatgttctccatgaagcgctgccccccaggcatctggcccagccacaagcgctacatcgagtacatgtgtgacatggtggccgaggagcccatcaccccccacagcaagcccatcctggtgcgggctgtggtgatgacccctgtgcccctcttcagcaagcagaggagcggctgccggcccttctgtgaggtgtatgtgggagatgagcgggtggccagcaccagccaggagtatgacaagatgagggacttcaagattgaagatggcaaggccgtcatccccctgggcgtgacagtgcagggagatgtgctgattgtcatctaccacgcccggagcaccctgggcggccgcctgcaggccaagatggcctccatgaagatgttccagatccagttccacactggatttgtgcccagaaatgccaccaccgtgaagtttgccaagtatgacctggatgcctgtgacatccaggagaagtacccagacctcttccaggtgaacctggaggtggaggtggagccccgggaccggcccagccgggaggccccaccctgggagaacagctccatgaggggcctgaaccccaagatcctcttcagcagccgggaggagcagcaggacatcctgagcaagtttgggaagccagagctgccccggcagcccggcagcacagcccagtatgatgctggggccggcagccctgaggccgagcccacagacagcgacagcccccccagcagcagcgcagatgccagccgcttcctgcacaccctggactggcaggaggagaaggaggccgagactggagcagaaaatgccagcagcaaggagagcgagagcgccctgatggaggacagagatgagagcgaggtgtctgatgagggcggcagccccatcagcagcgagggccaggagcccagggctgaccctgagcccccaggcctggccgccggcctggtgcagcaggacctggtgtttgaggtggagaccccagctgtgctgcctgagcctgtgccccaggaggatggagtggacctgctgggcctgcacagcgaggtgggcgccggccctgctgtgcccccccaggcctgcaaggcccccagcagcaacacagacctgctgagctgcctgctgggccccccagaggccgccagccagggccccccagaggacctgctgtctgaggaccccctgctgctggccagccctgccccacccctgtctgtgcagagcaccccccggggcggccccccagctgctgctgaccccttcggccccctgctgcccagcagcggcaacaacagccagccctgcagcaacccagacctgtttggagagttcctgaacagcgacagcgtgacagtgcccccatccttccccagcgcccacagcgcccccccacccagctgcagcgctgacttcctgcacctgggggacctgcccggggagcccagcaagatgacagccagcagcagcaacccagacctgctgggcggctgggccgcctggacagaaacagctgccagcgctgtggcccccaccccagccacagagggccccctcttcagccctgggggccagcctgccccctgtggcagccaggcctcctggaccaagagccagaacccagacccctttgctgacctgggggacctgagcagcggcctgcagggcagccctgctggcttccccccaggcggcttcatccccaagacagccaccacccccaagggcagcagctcctggcagaccagccggcccccagcccagggcgcctcctggccaccccaggccaagcccccacccaaggcctgcacccagccccggcccaactatgccagcaacttcagcgtcatcggggcccgggaggagcggggcgtgcgggcccccagctttgcccagaagcccaaggtgtctgaaaatgactttgaggacctgctgagcaaccagggcttcagcagcagaagtgacaagaagggccccaagaccatcgccgagatgaggaagcaggacctggccaaggacacagaccccctgaagctgaagctgctggactggattgagggcaaggagaggaacatccgggccctgctgagcaccctgcacacagtgctgtgggatggagagagccgctggacccctgtgggcatggctgacctggtggcccctgagcaggtgaagaagcactaccgccgggctgtgctggccgtgcacccagacaaggccgccggccagccctatgagcagcacgccaagatgatcttcatggagctgaatgatgcctggagcgagtttgagaaccagggcagccggcccctcttctag

SEQ ID NO: 148801 - DNA, 1764 bp, Artificial Sequence
  Description of Artificial Sequence: Synthetic coding sequence
atgagcctgctgcagagcgccctggacttcctggccggccctggcagcctgggcggggccagcggccgggaccagagcgactttgtgggccagacagtggagctgggggagctgcggctgcgggtgagaagagtgctggccgagggcggctttgcctttgtgtatgaggcccaggatgtgggcagcggccgggagtatgccctgaagaggctgctgagcaatgaggaggagaagaacagagccatcatccaggaggtgtgcttcatgaagaagctgagcggccaccccaacatcgtgcagttctgcagcgctgccagcatcggcaaggaggagagtgacaccggccaggccgagttcctgctgctgacagagcccccaggcctggccgccggcctggtgcagcaggacctggtgtttgaggtggagaccccagctgtgctgcctgagcctgtgccccaggaggatggagtggacctgctgggcctgcacagcgaggtgggcgccggccctgctgtgcccccccaggcctgcaaggcccccagcagcaacacagacctgctgagctgcctgctgggccccccagaggccgccagccagggccccccagaggacctgctgtctgaggaccccctgctgctggccagccctgccccacccctgtctgtgcagagcaccccccggggcggccccccagctgctgctgaccccttcggccccctgctgcccagcagcggcaacaacagccagccctgcagcaacccagacctgtttggagagttcctgaacagcgacagcgtgacagtgcccccatccttccccagcgcccacagcgcccccccacccagctgcagcgctgacttcctgcacctgggggacctgcccggggagcccagcaagatgacagccagcagcagcaacccagacctgctgggcggctgggccgcctggacagaaacagctgccagcgctgtggcccccaccccagccacagagggccccctcttcagccctgggggccagcctgccccctgtggcagccaggcctcctggaccaagagccagaacccagacccctttgctgacctgggggacctgagcagcggcctgcagggcagccctgctggcttccccccaggcggcttcatccccaagacagccaccacccccaagggcagcagctcctggcagaccagccggcccccagcccagggcgcctcctggccaccccaggccaagcccccacccaaggcctgcacccagccccggcccaactatgccagcaacttcagcgtcatcggggcccgggaggagcggggcgtgcgggcccccagctttgcccagaagcccaaggtgtctgaaaatgactttgaggacctgctgagcaaccagggcttcagcagcagaagtgacaagaagggccccaagaccatcgccgagatgaggaagcaggacctggccaaggacacagaccccctgaagctgaagctgctggactggattgagggcaaggagaggaacatccgggccctgctgagcaccctgcacacagtgctgtgggatggagagagccgctggacccctgtgggcatggctgacctggtggcccctgagcaggtgaagaagcactaccgccgggctgtgctggccgtgcacccagacaaggccgccggccagccctatgagcagcacgccaagatgatcttcatggagctgaatgatgcctggagcgagtttgagaaccagggcagccggcccctcttctag

SEQ ID NO: 148802 - DNA, 2238 bp, Artificial Sequence
  Description of Artificial Sequence: Synthetic coding sequence
atgcccttccctgtgaccacccagggcagccagcagacccagcccccccagaagcactacggcatcaccagccccatcagcctggccgcccccaaggagacagactgtgtgctgacccagaagctgattgagaccctgaagccctttggagtgtttgaggaggaggaggagctgcagaggcgcatcctgatcctgggcaagctgaacaacctggtgaaggagtggatccgggagatcagcgagagcaagaacctgccccagagcgtgattgaaaatgtgggcggcaagatcttcaccttcggcagctaccgcctgggcgtgcacaccaagggagctgacattgatgccctgtgtgtggcccccaggcatgtggacagaagtgacttcttcaccagcttctatgacaagctgaagctgcaggaggaggtgaaggacctgcgggctgtggaggaggcctttgtgcctgtgatcaagctgtgctttgatggcatcgagattgacatcctgtttgcccggctggccctgcagaccatccctgaggacctggacctgagagatgacagcctgctgaagaacctggacatccgctgcatccgcagcctgaatggctgccgggtgacagatgagatcctgcacctggtgcccaacatcgacaacttccggctgaccctgcgggccatcaagctgtgggccaagaggcacaacatctacagcaacatcctgggcttcctgggcggcgtgtcctgggccatgctggtggcccggacctgccagctgtacccaaatgccatcgccagcaccctggtgcacaagttcttcctggtgttcagcaagtgggagtggcccaaccctgtgctgctgaagcagcctgaggagtgcaacctgaacctgcctgtgtgggacccccgggtgaaccccagcgaccgctaccacctgatgcccatcatcaccccagcctacccccagcagaacagcacctacaacgtgtctgtgtccaccaggatggtgatggtggaggagttcaagcagggcctggccatcacagatgagatcctgctgagcaaggccgagtggagcaagctgtttgaggcccccaacttcttccagaagtacaagcactacatcgtgctgctggccagcgcccccacagagaagcagaggctggagtgggtgggcctggtggagagcaagatccgcatcctggtgggcagcctggagaagaatgagttcatcaccctggcccacgtgaacccccagagcttccctgcccccaaggagaacccagacaaggaggagttccgcaccatgtgggtgattggcctggtgttcaagaagacagaaaattctgagaacctgtctgtggacctgacctatgacatccagagcttcacagacacagtgtaccggcaggccatcaacagcaagatgtttgaggtggacatgaagattgctgccatgcacgtgaagaggaagcagctgcaccagctgctgcccaaccacgtgctgcagaagaagaagaagcacagcacagagggcgtgaagctgacagccctgaatgacagcagcctggacctgtccatggacagcgacaacagcatgtctgtgcccagccccaccagcgccaccaagaccagccccctgaacagcagcggcagcagccagggcaggaacagccctgccccagctgtgacagctgcctctgtgaccaacatccaggccacagaggtgtctgtgccccaggtgaacagcagcgagagcagcggcggcaccagcagcgagagcatcccccagacagccacccagcctgccatcagccccccacccaagcccaccgtgtcccgggtggtgagcagcacccggctggtgaaccccccacccaggagcagtggaaatgctgccaccagcggaaatgctgccaccaagatccccacccccatcgtgggcgtgaagaggaccagcagcccccacaaggaggagagccccaagaagaccaagacagaggaggatgagaccagtgaagatgccaactgcctggccctgagcggccatgacaagacagaggccaaggagcagctggacacagagaccagcaccacccagagcgagaccatccagacagctgccagcctgctggccagccagaagaccagcagcacagacctgagtgacatcccagccctgcctgccaaccccatccctgtgatcaagaacagcatcaagctgcggctgaacagatag

SEQ ID NO: 148803 - DNA, 1080 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagacccccaagaagtgcaaggacatcatcaagacagcccggagcctgctgaatgatgtgcagtttggccagtttggagatgaccccaaggaggaggtgatggtgctggagcgcatcctgctgcagaccatcaagtttgacctgcaggtggagcacccctaccagttcctgctgaagtatgccaagcagctgaagggggacaagaacaagatccagaagctggtgcagatggcctggacctttgtgaatgacaggaccagcctgtgcaccaccctgagcctgcagtgggagcctgagatcatcgctgtggccgtgatgtacctggccggccgcctgtgcaagtttgagatccaggagtggaccagcaagcccatgtaccgccgctggtgggagcagtttgtgcaggatgtgcctgtggatgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcctgcccagcagcagcagcctgcccagcagcccaagaagcccagcccccagcccagcagcccccggcaggtgaagagagctgtggtggtgagccccaaggaggagaacaaggccgccggcaaggccagcctgaagcacacctggtag

SEQ ID NO: 148804 - DNA, 1743 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagacccccaagaagtgcaaggacatcatcaagacagcccggagcctgctgaatgatgtgcagtttggccagtttggagatgaccccaaggaggaggtgatggtgctggagcgcatcctgctgcagaccatcaagtttgacctgcaggtggagcacccctaccagttcctgctgaagtatgccaagcagctgaagggggacaagaacaagatccagaagctggtgcagatggcctggacctttgtgaatgacagcctgtgcaccaccctgagcctgcagtgggagcctgagatcatcgctgtggccgtgatgtacctggccggccgcctgtgcaagtttgagatccaggagtggaccagcaagcccatgtaccgccgctggtgggagcagtttgtgcaggatgtgcctgtggatgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcctgcccagcagcagcagcctgcccagcagcccaagaagcccagcccccagcccagcagcccccggcaggtgaagagagctgtggtggtgagccccaaggaggagaacaaggctgctgagcccccaccacccaagatccccaagattgagaccacccacccccccctgcccccagcccaccccccaccagacaggaagccacccctggccgccgccctgggggaggccgagcccccaggccctgtggatgccacagacctgcccaaggtgcagatccccccaccagcccacccagcccctgtgcaccagcccccacccctgccccaccggcccccacctcctccacccagcagctacatgacaggcatgagcaccaccagcagctacatgtctggagagggctaccagagcctgcagagcatgatgaagacagagggccccagctatggagccctgcccccagcctacggccccccagcccacctgccctaccacccccacgtgtacccacccaaccccccacctcctcctgtgcccccacctccagccagcttccccccaccagccatccccccacccaccccaggctacccacctcctccacccacctacaaccccaacttccccccacctccaccccggctgccccccacccatgctgtgcccccccaccccccacctggcctgggcctgcccccagccagctacccacctcctgctgtgcccccaggcggccagccccctgtgcccccacccatccccccacctggcatgcctcctgtgggcggcctgggccgggccgcctggatgaggtag

SEQ ID NO: 148805 - DNA, 1803 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagacccccaagaagtgcaaggacatcatcaagacagcccggagcctgctgaatgatgtgcagtttggccagtttggagatgaccccaaggaggaggtgatggtgctggagcgcatcctgctgcagaccatcaagtttgacctgcaggtggagcacccctaccagttcctgctgaagtatgccaagcagctgaagggggacaagaacaagatccagaagctggtgcagatggcctggacctttgtgaatgacagcctgtgcaccaccctgagcctgcagtgggagcctgagatcatcgctgtggccgtgatgtacctggccggccgcctgtgcaagtttgagatccaggagtggaccagcaagcccatgtaccgccgctggtgggagcagtttgtgcaggatgtgcctgtggatgtgctggaggacatctgccaccagatcctggacctgtacagccagggcaagcagcagatgccccaccacaccccccaccagctgcagcagccccccagcctgcagcccaccccccaggtgccccaggtgcagcagagccagcccagccagagcagcgagcccagccagccccagcagaaggacccccagcagcctgcccagcagcagcagcctgcccagcagcccaagaagcccagcccccagcccagcagcccccggcaggtgaagagagctgtggtgtctggcctgaagcaggccctgggccgggccggcttccctgggggcggcaacaccaccgtggtgagccccaaggaggagaacaaggctgctgagcccccaccacccaagatccccaagattgagaccacccacccccccctgcccccagcccaccccccaccagacaggaagccacccctggccgccgccctgggggaggccgagcccccaggccctgtggatgccacagacctgcccaaggtgcagatccccccaccagcccacccagcccctgtgcaccagcccccacccctgccccaccggcccccacctcctccacccagcagctacatgacaggcatgagcaccaccagcagctacatgtctggagagggctaccagagcctgcagagcatgatgaagacagagggccccagctatggagccctgcccccagcctacggccccccagcccacctgccctaccacccccacgtgtacccacccaaccccccacctcctcctgtgcccccacctccagccagcttccccccaccagccatccccccacccaccccaggctacccacctcctccacccacctacaaccccaacttccccccacctccaccccggctgccccccacccatgctgtgcccccccaccccccacctggcctgggcctgcccccagccagctacccacctcctgctgtgcccccaggcggccagccccctgtgcccccacccatccccccacctggcatgcctcctgtgggcggcctgggccgggccgcctggatgaggtag

SEQ ID NO: 148806 - DNA, 333 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagaccccctag

SEQ ID NO: 148807 - DNA, 684 bp, Artificial Sequence
  Description of Artificial Sequence: Synthetic coding sequence
atgaaggagaacaaggagaacagcagccccagcgtgaccagcgccaacctggaccacaccaagccctgctggtactgggacaagaaggacctggcccacacccccagccagctggagggcctggaccctgccacagaggcccgctaccgccgggagggcgcccgcttcatctttgatgtgggcacccggctgggcctgcactatgacaccctggccaccggcatcatctacttccaccgcttctacatgttccacagcttcaagcagttccccaggtatgtgactggagcctgctgcctcttcctggccggcaaggtggaggagacccccaagaagtgcaaggacatcatcaagacagcccggagcctgctgaatgatgtgcagtttggccagtttggagatgaccccaaggaggaggtgatggtgctggagcgcatcctgctgcagaccatcaagtttgacctgcaggtggagcacccctaccagttcctgctgaagtatgccaagcagctgaagggggacaagaacaagatccagaagctggtgcagatggcctggacctttgtgaatgacagcctgtgcaccaccctgagcctgcagtgggagcctgagatcatcgctgtggccgtgatgtacctggccggccgcctgtgcaagtttgagatccaggagtggaccagctag

SEQ ID NO: 148808 - DNA, 519 bp, Artificial Sequence
  Description of Artificial Sequence: Synthetic coding sequence
atggccagcggcccccacagcacagccacagctgctgctgctgccagcagcgctgcccccagcgctgggggcagcagcagcggcaccaccaccaccaccaccaccaccactggaggcatcctgattggagaccggctgtacagcgaggtgtccctgaccatcgaccacagcctcatccctgaggagcggctgagccccacccccagcatgcaggacggcctggacctgcccagcgagacagacctgcgcatcctgggctgtgagctgatccaggccgccggcatcctgctgcggctgccccaggtggccatggccaccggccaggtgctcttccaccgcttcttctacagcaagagctttgtgaagcacagctttgaaattgtggccatggcctgcatcaacctggccagcaagattgaggaggccccccggcgcatcagagatgtgatcaacgtgttccaccacctgcggcagctgcggggcaagagtgaccagctgcacctgcccaagccaggatag

SEQ ID NO: 148809 - DNA, 1581 bp, Artificial Sequence
  Description of Artificial Sequence: Synthetic coding sequence
atggccagcggcccccacagcacagccacagctgctgctgctgccagcagcgctgcccccagcgctgggggcagcagcagcggcaccaccaccaccaccaccaccaccactggaggcatcctgattggagaccggctgtacagcgaggtgtccctgaccatcgaccacagcctcatccctgaggagcggctgagccccacccccagcatgcaggacggcctggacctgcccagcgagacagacctgcgcatcctgggctgtgagctgatccaggccgccggcatcctgctgcggctgccccaggtggccatggccaccggccaggtgctcttccaccgcttcttctacagcaagagctttgtgaagcacagctttgaaattgtggccatggcctgcatcaacctggccagcaagattgaggaggccccccggcgcatcagagatgtgatcaacgtgttccaccacctgcggcagctgcggggcaagaggacccccagccccctcatcctggaccagaactacatcaacaccaagaaccaggtgatcaaggccgagcggcgggtgctgaaggagctgggcttctgtgtgcacgtgaagcacccccacaagatcatcgtgatgtacctgcaggtgctggagtgtgagaggaaccagaccctggtgcagacagcctggaactacatgaatgacagcctgcggaccaacgtgtttgtgcgcttccagcctgagaccatcgcctgtgcctgcatctacctggccgcccgggccctgcagatccccctgcccacccggccccactggttcctgctgtttggcaccacagaggaggagatccaggagatctgcatcgagaccctgcggctgtacaccaggaagaagcccaactatgagctgctggagaaggaggtggagaagaggaaggtggccctgcaggaggccaagctgaaggccaagggcctgaacccagatggcaccccagccctgagcaccctgggcggcttcagccctgccagcaagcccagcagcccccgggaggtgaaggccgaggagaagagccccatcagcatcaacgtgaagacagtgaagaaggagcctgaggaccggcagcaggccagcaagagcccctacaatggagtgaggaaggacagcaagaggagcaggaacagccgcagcgccagccgcagccgcagcaggaccaggagccgcagccgcagccacaccccaagaagacactacaacaacagaagaagccgcagcggcacctacagcagccgcagccgcagccgcagccgcagccacagcgagagcccccggcggcaccacaaccacggcagcccccacctgaaggccaagcacaccagagatgacctgaagagcagcaacagacatggccacaagaggaagaagagccgcagccgcagccagagcaagagccgggaccacagtgatgctgccaagaagcacagacatgagcggggccaccaccgggaccggcgggagaggagccgcagctttgagaggagccacaagagcaagcaccacggcggcagccgcagcggccacggccgccacagaagatag

SEQ ID NO: 148810 - DNA, 1563 bp, Artificial Sequence
  Description of Artificial Sequence: Synthetic coding sequence
atggctgctgctgctgctgctgctggagctgctggcagcgctgccccagctgctgctgctggggcccctggcagcggcggggcccccagcggcagccagggcgtgctgattggagaccggctgtacagcggcgtgctgatcaccctggagaactgcctgctgcctgatgacaagctgcgcttcacccccagcatgagcagcggcctggacacagacacagaaacagacctgcgggtggtgggctgtgagctgatccaggccgccggcatcctgctgcggctgccccaggtggccatggccaccggccaggtgctcttccagcgcttcttctacaccaagagctttgtgaagcacagcatggagcacgtgtccatggcctgtgtgcacctggccagcaagattgaggaggccccccggcgcatcagagatgtgatcaacgtgttccaccggctgcggcagctgcgggacaagaagaagcctgtgcccctgctgctggaccaggactatgtgaacctgaagaaccagatcatcaaggccgagaggagagtgctgaaggagctgggcttctgtgtgcacgtgaagcacccccacaagatcatcgtgatgtacctgcaggtgctggagtgtgaaagaaaccagcacctggtgcagacctcctggaactacatgaatgacagcctgaggacagatgtgtttgtgcgcttccagcctgagagcatcgcctgtgcctgcatctacctggccgcccggaccctggagatccccctgcccaaccggccccactggttcctgctgtttggagccacagaggaggagatccaggagatctgcctgaagatcctgcagctgtatgccaggaagaaggtggacctgacccacctggagggggaggtggagaagaggaagcacgccatcgaggaggccaaggcccaggcccggggcctgctgcccggcggcacccaggtgctggatggcaccagcggcttctccccagcccccaagctggtggagagccccaaggagggcaagggcagcaagcccagccccctgtctgtgaagaacaccaagaggcggctggagggcgccaagaaggccaaggctgacagccctgtgaatggcctgcccaagggccgggagagccgcagccgcagccgcagccgggagcagagctacagccgcagccccagccgcagcgccagccccaagaggaggaagagtgacagcggcagcaccagcggcggcagcaagagccagagccgcagccgcagcagaagtgacagccccccccggcaggcccccaggtctgccccctacaagggcagcgagatccggggcagcaggaagagcaaggactgcaagtacccccagaagccccacaagagccgcagccgcagcagcagccgcagccgcagccgcagccgggagagagctgacaaccctgggaagtacaagaagaagagccactactacagagaccagaggcgggagaggagccgctcctatgaaagaacaggccgccgctatgaaagagaccaccctggccacagccgccacagaagatag

SEQ ID NO: 148811 - DNA, 681 bp, Artificial Sequence
  Description of Artificial Sequence: Synthetic coding sequence
atggctgctgctgctgctgctgctggagctgctggcagcgctgccccagctgctgctgctggggcccctggcagcggcggggcccccagcggcagccagggcgtgctgattggagaccggctgtacagcggcgtgctgatcaccctggagaactgcctgctgcctgatgacaagctgcgcttcacccccagcatgagcagcggcctggacacagacacagaaacagacctgcgggtggtgggctgtgagctgatccaggccgccggcatcctgctgcggctgccccaggtggccatggccaccggccaggtgctcttccagcgcttcttctacaccaagagctttgtgaagcacagcatggagcacgtgtccatggcctgtgtgcacctggccagcaagattgaggaggccccccggcgcatcagagatgtgatcaacgtgttccaccggctgcggcagctgcgggacaagaagaagcctgtgcccctgctgctggaccaggactatgtgaacctgaagaaccagatcatcaaggccgagaggagagtgctgaaggagctgggcttctgtgtgcacgtgaagcacccccacaagatcatcgtgatgtacctgcaggtgctggagtgtgaaagaaaccagcacctggtgcagacctcctgggtggccagcgagggcaagtag

SEQ ID NO: 148812 - DNA, 1044 bp, Artificial Sequence
  Description of Artificial Sequence: Synthetic coding sequence
atgaatgacagcctgaggacagatgtgtttgtgcgcttccagcctgagagcatcgcctgtgcctgcatctacctggccgcccggaccctggagatccccctgcccaaccggccccactggttcctgctgtttggagccacagaggaggagatccaggagatctgcctgaagatcctgcagctgtatgccaggaagaaggtggacctgacccacctggagggggaggtggagaagaggaagcacgccatcgaggagggccccagccctggccctgtggcctggggccacactggagctggctggtacctgggcgtgctgagctgcccccaggccggctgctgggactacagcctggagtgcagcggggccatctgggaccactgcaagctgcggctgcctgattctggggacagctgtgccagcgccagccaggtggccggcattgctggggcccaccaccacgcccagagcctggccgtgctgcctgtggagagccccaaggagggcaagggcagcaagcccagccccctgtctgtgaagaacaccaagaggcggctggagggcgccaagaaggccaaggctgacagccctgtgaatggcctgcccaagggccgggagagccgcagccgcagccgcagccgggagcagagctacagccgcagccccagccgcagcgccagccccaagaggaggaagagtgacagcggcagcaccagcggcggcagcaagagccagagccgcagccgcagcagaagtgacagccccccccggcaggcccccaggtctgccccctacaagggcagcgagatccggggcagcaggaagagcaaggactgcaagtacccccagaagccccacaagagccgcagccgcagcagcagccgcagccgcagccgcagccgggagagagctgacaaccctgggaagtacaagaagaagagccactactacagagaccagaggcgggagaggagccgctcctatgaaagaactggaagaagatatgagcgggaccaccctggccacagccgccacagaagatag

SEQ ID NO: 148813 - DNA, 2856 bp, Artificial Sequence
  Description of Artificial Sequence: Synthetic coding sequence
atggctgctgctgctgctgctgctgctgctgtgggcgtgcggctgcgggactgctgcagcagaggagctgtgctgctgctcttcttcagcctgagccccaggcctcctgctgctgctgcctggctgctgggcctgcggcctgaggacacagctgggggccgggtgtccctggagggcggcaccctgcgggctgctgagggcaccagcttcctgctgcgggtgtacttccagcccggccccccagccacagctgcccctgtgcccagccccaccctgaacagcggggagaatggaactggagactgggccccccggctggtgttcatcgaggagcccccaggcggcggcggcgtggcccccagcgctgtgcccaccaggcctcctggcccccagcgctgccgggagcagagcgactgggccagtgatgtggaggtgctgggccccctgcggcctggaggagtggccggcagcgccctggtgcaggtgcgggtgcgggagctgaggaaaggagaggccgagcggggcggggccggcggcggcggcaagctgttcagcctgtgtgcctgggatggccgggcctggcaccaccacggggccgccggcggcttcctgctgcgggtgcggccccggctgtatggccctggaggagacctgctgcccccagcctggctgcgggccctgggcgccctgctgctgctggccctgagcgccctcttcagcggcctgcggctgagcctgctgagcctggaccctgtggagctgcgggtgctgaggaacagcggcagcgctgctgagcaggagcaggcccggcgggtgcaggccgtgcggggccggggcacccacctgctgtgcaccctgctgctgggccaggccggggccaatgctgccctggccggctggctgtacaccagcctgcccccaggctttggaggcaccggggaggactacagcgaggagggcatccacttcccctggctgcctgccctggtgtgcaccggggctgtgttcctgggcgctgagatctgcccctacagcgtgtgcagccgccacggcctggccatcgccagccacagcgtgtgcctgacccggctgctgatggccgccgccttccctgtgtgctaccccctgggccgcctgctggactgggccctgcggcaggagatcagcaccttctacacccgggagaagctgctggagaccctgcgggctgctgacccctacagcgacctggtgaaggaggagctgaacatcatccagggcgccctggagctgcggaccaaggtggtggaggaggtgctgacccccctgggggactgcttcatgctgcggagtgatgctgtgctggactttgccaccgtgtctgagatcctgcggagcggctacacccgcatccctgtgtatgaaggagaccagaggcacaacatcgtggacatcctgtttgtgaaggacctggcctttgtggaccctgatgactgcacccccctgctgactgtgacccgcttctacaaccggcccctgcactgtgtgttcaatgacacccggctggacacagtgctggaggagttcaagaagggcaagagccacctggccatcgtgcagagggtgaacaatgaaggagagggggaccccttctatgaggtgatgggcatcgtgaccctggaggacatcatcgaggagatcatcaagtctgagatcctggatgaaacagacctgtacacagacaacaggaagaagcagagggtgccccagcgggagaggaagagacatgacttcagcctcttcaagctgagtgacacagagatgagggtgaagatcagcccccagctgctgctggccacccaccgcttcatggccacagaggtggagcccttcaagagcctgtacctgtctgagaagatcctgctgcggctgctgaagcaccccaacgtcatccaggagctgaagtttgatgagaagaacaagaaggcccctgagcactacctgtaccagaggaacagacctgtggactactttgtgctgctgctgcagggcaaggtggaggtggaggtgggcaaggagggcctgcgctttgaaaatggagccttcacctactacggcgtgcctgccatcatgaccacagcctgcagcgacaatgatgtgaggaaggtgggcagcctggccggcagctctgtgttcctgaacagaagccccagccgctgcagcggcctgaacagaagtgagagccccaaccgggagaggagtgactttggaggcagcaacacccagctgtacagcagcagcaacaacctgtacatgccagactacagcgtgcacatcctgagtgatgtgcagtttgtgaagatcacccggcagcagtaccagaatgccctgacagcctgccacatggacagcagcccccagagcccagacatggaggccttcacagatggagacagcaccaaggcccccaccacccggggcaccccccagacccccaaggatgatcctgccatcaccctgctgaacaacagaaacagcctgccctgcagcagaagtgatggcctgcggagccccagcgaggtggtgtacctgaggatggaggagctggccttcacccaggaggagatgacagactttgaggagcacagcacccagcagctgaccctgagccctgctgctgtgcccaccagggctgccagtgacagcgagtgctgcaacatcaacctggacacagagaccagcccctgcagcagtgactttgaagaaaatgtgggcaagaagctgctgcggaccctgagcggccagaagaggaagaggagccctgagggggagaggaccagcgaggacaacagcaacctgacccccctcatcacctag

SEQ ID NO: 148814 - DNA, 2493 bp, Artificial Sequence
  Description of Artificial Sequence: Synthetic coding sequence
atggctgctgctgctgctgctgctgctgctgtgggcgtgcggctgcgggactgctgcagcagaggagctgtgctgctgctcttcttcagcctgagccccaggcctcctgctgctgctgcctggctgctgggcctgcggcctgaggacacagctgggggccgggtgtccctggagggcggcaccctgcgggctgctgagggcaccagcttcctgctgcgggtgtacttccagcccggccccccacgctgccgggagcagagcgactgggccagtgatgtggaggtgctgggccccctgcggcctggaggagtggccggcagcgccctggtgcagctgttcagcctgtgtgcctgggatggccgggcctggcaccaccacggggctgctgggggcttcctgctgcgggtgcggccccggctgtatggccctggaggagacctgctgcccccagcctggctgcgggccctgggcgccctgctgctgctggccctgagcgccctcttcagcggcctgcggctgagcctgctgagcctggaccctgtggagctgcgggtgctgagaaattctggcagcgctgctgagcaggagcaggccaggagagtgcaggccgtgcggggccggggcacccacctgctgtgcaccctgctgctgggccaggccggggccaatgctgccctggccggctggctgtacaccagcctgcccccaggctttggaggcactggagaggactacagcgaggagggcatccacttcccctggctgcctgccctggtgtgcacaggagctgtgttcctgggcgctgagatctgcccctacagcgtgtgcagcagacatggcctggccatcgccagccacagcgtgtgcctgacccggctgctgatggctgctgccttccctgtgtgctaccccctgggccgcctgctggactgggccctgcggcaggagatcagcaccttctacacccgggagaagctgctggagaccctgcgggctgctgacccctacagcgacctggtgaaggaggagctgaacatcatccagggcgccctggagctgcggaccaaggtggtggaggaggtgctgacccccctgggggactgcttcatgctgcggagtgatgctgtgctggactttgccaccgtgtctgagatcctgcggagcggctacacccgcatccctgtgtatgaaggagaccagaggcacaacatcgtggacatcctgtttgtgaaggacctggcctttgtggaccctgatgactgcacccccctgctgactgtgacccgcttctacaaccggcccctgcactgtgtgttcaatgacacccggctggacacagtgctggaggagttcaagaagggcaagagccacctggccatcgtgcagagggtgaacaatgaaggagagggggaccccttctatgaggtgatgggcatcgtgaccctggaggacatcatcgaggagatcatcaagtctgagatcctggatgaaacagacctgtacacagacaacaggaagaagcagagggtgccccagcgggagaggaagagacatgacttcagcctcttcaagctgagtgacacagagatgagggtgaagatcagcccccagctgctgctggccacccaccgcttcatggccacagaggtggagcccttcaagagcctgtacctgtctgagaagatcctgctgcggctgctgaagcaccccaacgtcatccaggagctgaagtttgatgagaagaacaagaaggcccctgagcactacctgtaccagaggaacagacctgtggactactttgtgctgctgctgcagggcaaggtggaggtggaggtgggcaaggagggcctgcgctttgaaaatggagccttcacctactatggagtgcctgccatcatgaccacagcctgcagcgacaatgatgtgaggaaggtgggcagcctggccggcagcagcgtcttcctgaacagaagccccagccgctgcagcggcctgaacagaagtgagagccccaaccgggagaggagtgactttggaggcagcaacacccagctgtacagcagcagcaacaacctgtacatgccagactacagcgtgcacatcctgagtgatgtgcagtttgtgaagatcacccggcagcagtaccagaatgccctgacagcctgccacatggacagcagcccccagagcccagacatggaggccttcacagatggagacagcaccaaggcccccaccacccggggcaccccccagacccccaaggatgatcctgccatcaccctgctgaacaacagaaacagcctgcccagcagtgacagcgagtgctgcaacatcaacctggacacagagaccagcccctgcagcagtgactttgaggagaatgtgggcaagaagctgctgcggaccctgagcggccagaagaggaagaggagccctgagggggagaggaccagcgaggacaacagcaacctgacccccctcatcacctag

SEQ ID NO: 148815 - DNA, 1824 bp, Artificial Sequence
  Description of Artificial Sequence: Synthetic coding sequence
atggctgctgccttccctgtgtgctaccccctgggccgcctgctggactgggccctgcggcaggagatcagcaccttctacacccgggagaagctgctggagaccctgcgggctgctgacccctacagcgacctggtgaaggaggagctgaacatcatccagggcgccctggagctgcggaccaaggtggtggaggaggtgctgacccccctgggggactgcttcatgctgcggagtgatgctgtgctggactttgccaccgtgtctgagatcctgcggagcggctacacccgcatccctgtgtatgaaggagaccagaggcacaacatcgtggacatcctgtttgtgaaggacctggcctttgtggaccctgatgactgcacccccctgctgactgtgacccgcttctacaaccggcccctgcactgtgtgttcaatgacacccggctggacacagtgctggaggagttcaagaagggcaagagccacctggccatcgtgcagagggtgaacaatgaaggagagggggaccccttctatgaggtgatgggcatcgtgaccctggaggacatcatcgaggagatcatcaagtctgagatcctggatgaaacagacctgtacacagacaacaggaagaagcagagggtgccccagcgggagaggaagagacatgacttcagcctcttcaagctgagtgacacagagatgagggtgaagatcagcccccagctgctgctggccacccaccgcttcatggccacagaggtggagcccttcaagagcctgtacctgtctgagaagatcctgctgcggctgctgaagcaccccaacgtcatccaggagctgaagtttgatgagaagaacaagaaggcccctgagcactacctgtaccagaggaacagacctgtggactactttgtgctgctgctgcagggcaaggtggaggtggaggtgggcaaggagggcctgcgctttgaaaatggagccttcacctactatggagtgcctgccatcatgaccacagcctgcagcgacaatgatgtgaggaaggtgggcagcctggccggcagcagcgtcttcctgcctgtgtctgtgtccaggacctttgctgtgtccagaggagacagcctggccggcagccctgtgaacagaagccccagccgctgcagcggcctgaacagaagtgagagccccaaccgggagaggagtgactttggaggcagcaacacccagctgtacagcagcagcaacaacctgtacatgccagactacagcgtgcacatcctgagtgatgtgcagtttgtgaagatcacccggcagcagtaccagaatgccctgacagcctgccacatggacagcagcccccagagcccagacatggaggccttcacagatggagacagcaccaaggcccccaccacccggggcaccccccagacccccaaggatgatcctgccatcaccctgctgaacaacagaaacagcctgccctgcagcagaagtgatggcctgcggagccccagcgaggtggtgtacctgaggatggaggagctggccttcacccaggaggagatgacagactttgaggagcacagcacccagcagctgaccctgagccctgctgctgtgcccaccagggctgccagtgacagcgagtgctgcaacatcaacctggacacagagaccagcccctgcagcagtgactttgaagaaaatgtgggcaagaagctgctgcggaccctgagcggccagaagaggaagaggagccctgagggggagaggaccagcgaggacaacagcaacctgacccccctcatcacctag

SEQ ID NO: 148816 - DNA, 2643 bp, Artificial Sequence
  Description of Artificial Sequence: Synthetic coding sequence
atggctgctgctgctgctgctgctgctgctgtgggcgtgcggctgcgggactgctgcagcagaggagctgtgctgctgctcttcttcagcctgagccccaggcctcctgctgctgctgcctggctgctgggcctgcggcctgaggacacagctgggggccgggtgtccctggagggcggcaccctgcgggctgctgagggcaccagcttcctgctgcgggtgtacttccagcccggccccccacgctgccgggagcagagcgactgggccagtgatgtggaggtgctgggccccctgcggcctggaggagtggccggcagcgccctggtgcagctgttcagcctgtgtgcctgggatggccgggcctggcaccaccacggggctgctgggggcttcctgctgcgggtgcggccccggctgtatggccctggaggagacctgctgcccccagcctggctgcgggccctgggcgccctgctgctgctggccctgagcgccctcttcagcggcctgcggctgagcctgctgagcctggaccctgtggagctgcgggtgctgagaaattctggcagcgctgctgagcaggagcaggccaggagagtgcaggccgtgcggggccggggcacccacctgctgtgcaccctgctgctgggccaggccggggccaatgctgccctggccggctggctgtacaccagcctgcccccaggctttggaggcactggagaggactacagcgaggagggcatccacttcccctggctgcctgccctggtgtgcacaggagctgtgttcctgggcgctgagatctgcccctacagcgtgtgcagcagacatggcctggccatcgccagccacagcgtgtgcctgacccggctgctgatggctgctgccttccctgtgtgctaccccctgggccgcctgctggactgggccctgcggcaggagatcagcaccttctacacccgggagaagctgctggagaccctgcgggctgctgacccctacagcgacctggtgaaggaggagctgaacatcatccagggcgccctggagctgcggaccaaggtggtggaggaggtgctgacccccctgggggactgcttcatgctgcggagtgatgctgtgctggactttgccaccgtgtctgagatcctgcggagcggctacacccgcatccctgtgtatgaaggagaccagaggcacaacatcgtggacatcctgtttgtgaaggacctggcctttgtggaccctgatgactgcacccccctgctgactgtgacccgcttctacaaccggcccctgcactgtgtgttcaatgacacccggctggacacagtgctggaggagttcaagaagggcaagagccacctggccatcgtgcagagggtgaacaatgaaggagagggggaccccttctatgaggtgatgggcatcgtgaccctggaggacatcatcgaggagatcatcaagtctgagatcctggatgaaacagacctgtacacagacaacaggaagaagcagagggtgccccagcgggagaggaagagacatgacttcagcctcttcaagctgagtgacacagagatgagggtgaagatcagcccccagctgctgctggccacccaccgcttcatggccacagaggtggagcccttcaagagcctgtacctgtctgagaagatcctgctgcggctgctgaagcaccccaacgtcatccaggagctgaagtttgatgagaagaacaagaaggcccctgagcactacctgtaccagaggaacagacctgtggactactttgtgctgctgctgcagggcaaggtggaggtggaggtgggcaaggagggcctgcgctttgaaaatggagccttcacctactatggagtgcctgccatcatgaccacagcctgcagcgacaatgatgtgaggaaggtgggcagcctggccggcagcagcgtcttcctgaacagaagccccagccgctgcagcggcctgaacagaagtgagagccccaaccgggagaggagtgactttggaggcagcaacacccagctgtacagcagcagcaacaacctgtacatgccagactacagcgtgcacatcctgagtgatgtgcagtttgtgaagatcacccggcagcagtaccagaatgccctgacagcctgccacatggacagcagcccccagagcccagacatggaggccttcacagatggagacagcaccaaggcccccaccacccggggcaccccccagacccccaaggatgatcctgccatcaccctgctgaacaacagaaacagcctgccctgcagcagaagtgatggcctgcggagccccagcgaggtggtgtacctgaggatggaggagctggccttcacccaggaggagatgacagactttgaggagcacagcacccagcagctgaccctgagccctgctgctgtgcccacccgggccgccagtgacagcgagtgctgcaacatcaacctggacacagagaccagcccctgcagcagtgactttgaggagaatgtgggcaagaagctgctgcggaccctgagcggccagaagaggaagaggagccctgagggggagaggaccagcgaggacaacagcaacctgacccccctcatcacctag

SEQ ID NO: 148817 - DNA, 1215 bp, Artificial Sequence
  Description of Artificial Sequence: Synthetic coding sequence
atgggcatcgtgaccctggaggacatcatcgaggagatcatcaagtctgagatcctggatgaaacagacctgtacacagacaacaggaagaagcagagggtgccccagcgggagaggaagagacatgacttcagcctcttcaagctgagtgacacagagatgagggtgaagatcagcccccagctgctgctggccacccaccgcttcatggccacagaggtggagcccttcaagagcctgtacctgtctgagaagatcctgctgcggctgctgaagcaccccaacgtcatccaggagctgaagtttgatgagaagaacaagaaggcccctgagcactacctgtaccagaggaacagacctgtggactactttgtgctgctgctgcagggcaaggtggaggtggaggtgggcaaggagggcctgcgctttgaaaatggagccttcacctactatggagtgcctgccatcatgaccacagcctgcagcgacaatgatgtgaggaaggtgggcagcctggccggcagcagcgtcttcctgaacagaagccccagccgctgcagcggcctgaacagaagtgagagccccaaccgggagaggagtgactttggaggcagcaacacccagctgtacagcagcagcaacaacctgtacatgccagactacagcgtgcacatcctgagtgatgtgcagtttgtgaagatcacccggcagcagtaccagaatgccctgacagcctgccacatggacagcagcccccagagcccagacatggaggccttcacagatggagacagcaccaaggcccccaccacccggggcaccccccagacccccaaggatgatcctgccatcaccctgctgaacaacagaaacagcctgccctgcagcagaagtgatggcctgcggagccccagcgaggtggtgtacctgaggatggaggagctggccttcacccaggaggagatgacagactttgaggagcacagcacccagcagctgaccctgagccctgctgctgtgcccacccgggccgccagtgacagcgagtgctgcaacatcaacctggacacagagaccagcccctgcagcagtgactttgaggagaatgtgggcaagaagctgctgcggaccctgagcggccagaagaggaagaggagccctgagggggagaggaccagcgaggacaacagcaacctgacccccctcatcacctag

SEQ ID NO: 148818 - DNA, 2562 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaagggcaagagccacctggccatcgtgcagagggtgaacaatgaaggagagggggaccccttctatgaggtgctgggcatcgtgaccctggaggatgtgattgaggagatcatcaagtctgagatcctggatgaaacagacctgtacacagacaacagaaccaagaagaaggtggcccaccgggagaggaagcaggacttcagcgccttcaagcagacagacagcgagatgaaggtgaagatcagcccccagctgctgctggccatgcaccgcttcctggccacagaggtggaggccttcagccccagccagatgtctgagaagatcctgctgcggctgctgaagcaccccaacgtcatccaggagctgaagtatgatgagaagaacaagaaggcccctgagtactacctgtaccagaggaacaagcctgtggactactttgtgctgatcctgcagggcaaggtggaggtggaggccggcaaggagggcatgaagtttgaggccagcgccttctcctactatggagtgatggccctgacagccagccctggagagaacaagagccccccccggccctgtggcctgaaccacagcgacagcctgagcagaagtgacagaattgatgctgtgacccccaccctgggcagcagcaacaaccagctgaacagcagcctgctgcaggtgtacatcccagactacagcgtgcgggccctgagtgacctgcagtttgtgaagatcagccggcagcagtaccagaatgccctgatggccagcaggatggacaagaccccccagagcagtgacagcgagaacaccaagattgagctgaccctgacagagctgcatgatggcctgcctgatgaaacagccaacctgctgaatgagcagaactgtgtgacccacagcaaggccaaccacagcctgcacaatgaaggagccatctag

SEQ ID NO: 148819 - DNA, 1659 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaaggagcacaccaacaagaagcccaagagctaccagcactag

SEQ ID NO: 148820 - DNA, 2628 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaagggcaagagccacctggccatcgtgcagagggtgaacaatgaaggagagggggaccccttctatgaggtgctgggcatcgtgaccctggaggatgtgattgaggagatcatcaagtctgagatcctggatgaaacagacctgtacacagacaacagaaccaagaagaaggtggcccaccgggagaggaagcaggacttcagcgccttcaagcagacagacagcgagatgaaggtgaagatcagcccccagctgctgctggccatgcaccgcttcctggccacagaggtggaggccttcagccccagccagatgtctgagaagatcctgctgcggctgctgaagcaccccaacgtcatccaggagctgaagtatgatgagaagaacaagaaggcccctgagtactacctgtaccagaggaacaagcctgtggactactttgtgctgatcctgcagggcaaggtggaggtggaggccggcaaggagggcatgaagtttgaggccagcgccttctcctactatggagtgatggccctgacagccagccctgtgcccctgagcctgagcaggacctttgtggtgtccaggacagagctgctggccgccggcagccctggagagaacaagagccccccccggccctgtggcctgaaccacagcgacagcctgagcagaagtgacagaattgatgctgtgacccccaccctgggcagcagcaacaaccagctgaacagcagcctgctgcaggtgtacatcccagactacagcgtgcgggccctgagtgacctgcagtttgtgaagatcagccggcagcagtaccagaatgccctgatggccagcaggatggacaagaccccccagagcagtgacagcgagaacaccaagattgagctgaccctgacagagctgcatgatggcctgcctgatgaaacagccaacctgctgaatgagcagaactgtgtgacccacagcaaggccaaccacagcctgcacaatgaaggagccatctag

SEQ ID NO: 148821 - DNA, 2565 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaagggcaagagccacctggccatcgtgcagagggtgaacaatgaaggagagggggaccccttctatgaggtgctgggcatcgtgaccctggaggatgtgattgaggagatcatcaagtctgagatcctggatgaaacagacctgtacacagacaacagaaccaagaagaaggtggcccaccgggagaggaagcaggacttcagcgccttcaagcagacagacagcgagatgaaggtgaagatcagcccccagctgctgctggccatgcacctggtgttcatcagcattgaggtggaggccttcagccccagccagatgtctgagaagatcctgctgcggctgctgaagcaccccaacgtcatccaggagctgaagtatgatgagaagaacaagaaggcccctgagtactacctgtaccagaggaacaagcctgtggactactttgtgctgatcctgcagggcaaggtggaggtggaggccggcaaggagggcatgaagtttgaggccagcgccttctcctactacggcgtgatggccctgacagccagccctggagagaacaagagccccccccggccctgtggcctgaaccacagcgacagcctgagcagaagtgacagaattgatgctgtgacccccaccctgggcagcagcaacaaccagctgaacagcagcctgctgcaggtgtacatcccagactacagcgtgcgggccctgagtgacctgcagtttgtgaagatcagccggcagcagtaccagaatgccctgatggccagcaggatggacaagaccccccagagcagtgacagcgagaacaccaagattgagctgaccctgacagagctgcatgatggcctgcctgatgaaacagccaacctgctgaatgagcagaactgtgtgacccacagcaaggccaaccacagcctgcacaatgaaggagccatctag

SEQ ID NO: 148822 - DNA, 2631 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaagggcaagagccacctggccatcgtgcagagggtgaacaatgaaggagagggggaccccttctatgaggtgctgggcatcgtgaccctggaggatgtgattgaggagatcatcaagtctgagatcctggatgaaacagacctgtacacagacaacagaaccaagaagaaggtggcccaccgggagaggaagcaggacttcagcgccttcaagcagacagacagcgagatgaaggtgaagatcagcccccagctgctgctggccatgcacctggtgttcatcagcattgaggtggaggccttcagccccagccagatgtctgagaagatcctgctgcggctgctgaagcaccccaacgtcatccaggagctgaagtatgatgagaagaacaagaaggcccctgagtactacctgtaccagaggaacaagcctgtggactactttgtgctgatcctgcagggcaaggtggaggtggaggccggcaaggagggcatgaagtttgaggccagcgccttctcctactacggcgtgatggccctgacagccagccctgtgcccctgagcctgagcaggacctttgtggtgtccaggacagagctgctggccgccggcagccctggagagaacaagagccccccccggccctgtggcctgaaccacagcgacagcctgagcagaagtgacagaattgatgctgtgacccccaccctgggcagcagcaacaaccagctgaacagcagcctgctgcaggtgtacatcccagactacagcgtgcgggccctgagtgacctgcagtttgtgaagatcagccggcagcagtaccagaatgccctgatggccagcaggatggacaagaccccccagagcagtgacagcgagaacaccaagattgagctgaccctgacagagctgcatgatggcctgcctgatgaaacagccaacctgctgaatgagcagaactgtgtgacccacagcaaggccaaccacagcctgcacaatgaaggagccatctag

SEQ ID NO: 148823 - DNA, 1725 bp, Artificial Sequence
  Description of Artificial Sequence: Synthetic coding sequence
atgattggctgtggggcctgtgagcccaaggtgaagatggccggcggccaggccgccgccgccctgcccacctggaagatggccgcccggcgcagcctgagcgcccggggccggggcatcctgcaggccgctgctggccgcctgctgcccctgctgctgctgagctgctgctgcggggccggcggctgtgccgctgtgggggagaatgaggagaccgtcatcatcggcctgcggctggaggacaccaatgatgtgtccttcatggagggcggggccctgcgggtgtctgagaggaccagggtgaagctgcgggtgtatggccagaacatcaacaatgagacctggagccgcatcgccttcacagaacatgaaagaagaagacacagccctggagagcggggcctgggcggccctgcccctcctgagccagattctggcccccagagatgtggcatccgcaccagtgacatcatcatcctgccccacatcatcctgaacagaaggaccagcggcatcattgaaattgagatcaagcccctgaggaagatggagaagagcaagagctactacctgtgcaccagcctgagcaccccagccctgggcgctgggggcagcggcagcactggaggagctgtgggcggcaaaggaggcagcggcgtggccggcctgcccccaccaccctgggccgagaccacctggatctaccatgatggagaggacaccaagatgattgtgggggaggagaagaagttcctgctgcccttctggctgcaggtgatcttcatcagcctgctgctgtgcctgagcggcatgttttctggcctgaacctgggcctgatggccctggaccccatggagctgagaattgtgcagaactgtggcacagagaaggagaagaactatgccaagagaattgagcctgtgcggcggcagggcaactacctgctgtgcagcctgctgctgggcaatgtgctggtgaacaccaccctgaccatcctgctggatgacattgctggcagcggcctggtggccgtggtggtgtccaccatcggcatcgtcatctttggagagatcgtgccccaggccatctgcagcagacatggcctggccgtgggcgccaacaccatcttcctgaccaagttcttcatgatgatgaccttccctgccagctaccctgtgtccaagctgctggactgtgtgctgggccaggagattggaacagtgtacaaccgggagaagctgctggagatgctgcgggtgacagacccctacaatgacctggtgaaggaggagctgaacatcatccagggcgccctggagctgcggaccaagacagtggaggatgtgatgacccccctgcgggactgcttcatgatcaccggggaggccatcctggacttcaacaccatgtctgagatcatggagagcggctacacccgcatccctgtgtttgaaggagagaggagcaacatcgtggacctgctgtttgtgaaggacctggcctttgtggaccctgatgactgcacccccctgaagaccatcaccaagttctacaaccaccccctgcactttgtgttcaatgacaccaagctggatgccatgctggaggagttcaagaaggagcacaccaacaagaagcccaagagctaccagcactgcaatgagcagaactgtgtgacccacagcaaggccaaccacagcctgcacaatgaaggagccatctag

SEQ ID NO: 148824 - DNA, 2124 bp, Artificial Sequence
  Description of Artificial Sequence: Synthetic coding sequence
atggctgctgctgtggccgccgccggccgcctgggctggctgtttgctgccctgtgcctgggcaatgctgctggggaggccgcccctggcccccgggtgctgggcttctgcctggaggaggatggagctgctggggccggctgggtgcggggcggggccgcccgggacaccccagatgccaccttcctgctgcggctgtttggacctggctttgccaacagctcctggagctgggtggcccctgagggcgccggctgccgggaggaggccgccagccctgctggggagtggagggccctgctgcggctgcggctgcgggcagaggccgtgcggccccacagcgccctgctggccgtgcgggtggagcccggcggcggcgctgctgaggaggccgccccaccctgggccctgggcctgggcgccgccggcctgctggccctggccgccctggcccggggcctgcagctgagcgccctggccctggccccagctgaggtgcaggtgctgcgggagagcggcagcgaggccgagagagctgctgcccggcggctggagcccgcccggcgctgggccggctgtgccctgggcgccctgctgctgctggccagcctggcccaggccgccctggccgtgctgctgtacagagctgctggccagagagctgtgcctgctgtgctgggcagcgctggcctggtgttcctggtgggggaggtggtgcctgctgctgtgtctggccgctggaccctggccctggccccccgggccctgggcctgagccggctggccgtgctgctgaccctgcctgtggccctgcctgtgggccagctgctggagctggccgcccggcccggccgcctgcgggagcgggtgctggagctggcccggggcggcggggacccctacagcgacctgagcaagggcgtgctgcgctgcaggacagtggaggatgtgctgacccccctggaggactgcttcatgctggatgccagcacagtgctggactttggagtgctggccagcatcatgcagagcggccacacccgcatccctgtgtatgaggaggagaggagcaacatcgtggacatgctgtacctgaaggacctggcctttgtggaccctgaggactgcacccccctgagcaccatcacccgcttctacaaccaccccctgcactttgtgttcaatgacaccaagctggatgctgtgctggaggagttcaagaggggcaagagccacctggccatcgtgcagaaggtgaacaatgaaggagagggggaccccttctatgaggtgctgggcctggtgaccctggaggatgtgattgaggagatcatccgctctgagatcctggatgaaagtgaggactacagagacacagtggtgaagaggaagccagccagcctgatggcccccctgaagaggaaggaggagttcagcctcttcaaggtgtctgatgatgagtacaaggtgaccatcagcccccagctgctgctggccacccagcgcttcctgagccgggaggtggatgtgttcagccccctgcgcatcagcgagaaggtgctgctgcacctgctgaagcaccccagcgtgaaccaggaggtgcgctttgatgagagcaaccggctggccacccaccactacctgtaccagaggagccagcctgtggactacttcatcctgatcctgcagggccgggtggaggtggagatcggcaaggagggcctgaagtttgaaaatggagccttcacctactatggagtgtctgccctgactgtgcccagctctgtgcaccagagccctgtgagcagcctgcagcccatcagacatgacctgcagcctgaccctggagatggcacccacagcagcgcctactgcccagactacacagtgcgggccctgagtgacctgcagctgatcaaggtgacccggctgcagtacctgaatgccctgctggccacccgggcccagaacctgccccagagcccagaaaatacagacctgcaggtgattcctggcagccagacccggctgctgggggagaagaccaccacagctgctggcagcagccacagcaggcctggggtgcctgtggagggcagccctggaagaaatcctggggtgtag

SEQ ID NO: 148825 - DNA, 1980 bp, Artificial Sequence
  Description of Artificial Sequence: Synthetic coding sequence
atggctgctgctgtggccgccgccggccgcctgggctggctgtttgctgccctgtgcctgggcaatgctgctggggaggccgcccctggcccccgggtgctgggcttctgcctggaggaggatggagctgctggggccggctgggtgcggggcggggccgcccgggacaccccagatgccaccttcctgctgcggctgtttggacctggctttgccaacagctcctggagctgggtggcccctgagggcgccggctgccgggaggaggccgccagccctgctggggagtggagggccctgctgcggctgcggctgcgggcagaggccgtgcggccccacagcgccctgctggccgtgcgggtggagcccggcggcggcgctgctgaggaggccgccccaccctgggccctgggcctgggcgccgccggcctgctggccctggccgccctggcccggggcctgcagctgagcgccctggccctggccccagctgaggtgcaggtgctgcgggagagcggcagcgaggccgagagagctgctgcccggcggctggagcccgcccggcgctgggccggctgtgccctgggcgccctgctgctgctggccagcctggcccaggccgccctggccgtgctgctgtacagagctgctggccagagagctgtgcctgctgtgctgggcagcgctggcctggtgttcctggtgggggaggtggtgcctgctgctgtgtctggccgctggaccctggccctggccccccgggccctgggcctgagccggctggccgtgctgctgaccctgcctgtggccctgcctgtgggccagctgctggagctggccgcccggcccggccgcctgcgggagcgggtgctggagctggcccggggcggcggggacccctacagcgacctgagcaagggcgtgctgcgctgcaggacagtggaggatgtgctgacccccctggaggactgcttcatgctggatgccagcacagtgctggactttggagtgctggccagcatcatgcagagcggccacacccgcatccctgtgtatgaggaggagaggagcaacatcgtggacatgctgtacctgaaggacctggcctttgtggaccctgaggactgcacccccctgagcaccatcacccgcttctacaaccaccccctgcactttgtgttcaatgacaccaagctggatgctgtgctggaggagttcaagagaggagacacagtggtgaagaggaagccagccagcctgatggcccccctgaagaggaaggaggagttcagcctcttcaaggtgtctgatgatgagtacaaggtgaccatcagcccccagctgctgctggccacccagcgcttcctgagccgggaggtggatgtgttcagccccctgcgcatcagcgagaaggtgctgctgcacctgctgaagcaccccagcgtgaaccaggaggtgcgctttgatgagagcaaccggctggccacccaccactacctgtaccagaggagccagcctgtggactacttcatcctgatcctgcagggccgggtggaggtggagatcggcaaggagggcctgaagtttgaaaatggagccttcacctactatggagtgtctgccctgactgtgcccagctctgtgcaccagagccctgtgagcagcctgcagcccatcagacatgacctgcagcctgaccctggagatggcacccacagcagcgcctactgcccagactacacagtgcgggccctgagtgacctgcagctgatcaaggtgacccggctgcagtacctgaatgccctgctggccacccgggcccagaacctgccccagagcccagaaaatacagacctgcaggtgattcctggcagccagacccggctgctgggggagaagaccaccacagctgctggcagcagccacagcaggcctggggtgcctgtggagggcagccctggaagaaatcctggggtgtag

SEQ ID NO: 148826 - DNA, 2043 bp, Artificial Sequence
  Description of Artificial Sequence: Synthetic coding sequence
atggctgctgctgtggccgccgccggccgcctgggctggctgtttgctgccctgtgcctgggcaatgctgctggggaggccgcccctggcccccgggtgctgggcttctgcctggaggaggatggagctgctggggccggctgggtgcggggcggggccgcccgggacaccccagatgccaccttcctgctgcggctgtttggacctggctttgccaacagctcctggagctgggtggcccctgagggcgccggctgccgggaggaggccgccagccctgctggggagtggagggccctgctgcggctgcggctgcgggcagaggccgtgcggccccacagcgccctgctggccgtgcgggtggagcccggcggcggcgctgctgaggaggccgccccaccctgggccctgggcctgggcgccgccggcctgctggccctggccgccctggcccggggcctgcagctgagcgccctggccctggccccagctgaggtgcaggtgctgcgggagagcggcagcgaggccgagagagctgctgcccggcggctggagcccgcccggcgctgggccggctgtgccctgggcgccctgctgctgctggccagcctggcccaggccgccctggccgtgctgctgtacagagctgctggccagagagctgtgcctgctgtgctgggcagcgctggcctggtgttcctggtgggggaggtggtgcctgctgctgtgtctggccgctggaccctggccctggccccccgggccctgggcctgagccggctggccgtgctgctgaccctgcctgtggccctgcctgtgggccagctgctggagctggccgcccggcccggccgcctgcgggagcgggtgctggagctggcccggggcggcggggacccctacagcgacctgagcaagggcgtgctgcgctgcaggacagtggaggatgtgctgacccccctggaggactgcttcatgctggatgccagcacagtgctggactttggagtgctggccagcatcatgcagagcggccacacccgcatccctgtgtatgaggaggagaggagcaacatcgtggacatgctgtacctgaaggacctggcctttgtggaccctgaggactgcacccccctgagcaccatcacccgcttctacaaccaccccctgcactttgtgttcaatgacaccaagctggatgctgtgctggaggagttcaagagaggagacacagtggtgaagaggaagccagccagcctgatggcccccctgaagaggaaggaggagttcagcctcttcaaggtgtctgatgatgagtacaaggtgaccatcagcccccagctgctgctggccacccagcgcttcctgagccgggaggtggatgtgttcagccccctgcgcatcagcgagaaggtgctgctgcacctgctgaagcaccccagcgtgaaccaggaggtgcgctttgatgagagcaaccggctggccacccaccactacctgtaccagaggagccagcctgtggactacttcatcctgatcctgcagggccgggtggaggtggagatcggcaaggagggcctgaagtttgaaaatggagccttcacctactatggagtgtctgccctgactgtgcccagctctgtgcaccagagccctgtgagcagcctgcagcccatcagacatgacctgcagcctgaccctggagatggcacccacagcagcgcctactgcccagactacacagtgcgggccctgagtgacctgcagctgatcaaggtgacccggctgcagtacctgaatgccctgctggccacccgggcccagaacctgccccagagcccagaaaatacagacctgcaggtgattcctggcagccagacccggctgctgggggagaagaccaccacagctgctggcagcagccacagccggcccagcctgcccctgctgccccggggccgggacagcgctgcctacagcgacagcgacctgtttggcctgagccacctggtgtctgctgtgacagcctttgtgtggccctag

SEQ ID NO: 148827 - DNA, 2328 bp, Artificial Sequence
  Description of Artificial Sequence: Synthetic coding sequence
atggcccctgtgggcggcggcggccggcctgtgggcggccctgcccggggccgcctgctgctggccgcccctgtgctgctggtgctgctgtgggccctgggcgcccggggccagggcagcccccagcagggcaccatcgtgggcatgaggctggccagctgcaacaagagctgtggcaccaacccagatggcatcatctttgtgtctgagggcagcacagtgaacctgcggctgtatggctacagcctgggcaacatcagcagcaacctgatctccttcacagaggtggatgatgctgagaccctgcacaagagcaccagctgcctggagctgaccaaggacctggtggtgcagcagctggtgaatgtgtcccggggcaacaccagcggcgtgctggtggtgctgaccaagttcctgcggcgctctgagagcatgaagctgtatgccctgtgcacccgggcccagccagatggcccctggctgaagtggacagacaaggacagcctgctcttcatggtggaggagcccggccgcttcctgcccctgtggctgcacatcctgctgatcaccgtgctgctggtgctgagcggcatcttcagcggcctgaacctgggcctgatggccctggaccccatggagctgcgcatcgtgcagaactgtggcacagagaaggagcggcgctatgccaggaagattgagcccatccggaggaagggcaactacctgctgtgcagcctgctgctgggcaatgtgctggtgaacaccagcctgaccatcctgctggacaacctgattggcagcggcctgatggctgtggccagcagcaccatcggcatcgtcatctttggagagatcctgccccaggccctgtgcagccgccacggcctggccgtgggcgccaacaccatcctgctgaccaagttcttcatgctgctgaccttccccctgtccttccccatcagcaagctgctggacttcttcctgggccaggagatcagaacagtgtacaaccgggagaagctgatggagatgctgaaggtgacagagccctacaatgacctggtgaaggaggagctgaacatgatccagggcgccctggagctgcggaccaagacagtggaggacatcatgacccagctgcaggactgcttcatgatccgcagtgatgccatcctggacttcaacaccatgtctgagatcatggagagcggctacacccgcatccctgtgtttgaagatgagcagagcaacatcgtggacatcctgtatgtgaaggacctggcctttgtggaccctgatgactgcacccccctgaagaccatcacccgcttctacaaccaccctgtgcactttgtgttccatgacaccaagctggatgccatgctggaggagttcaagaagggcaagagccacctggccatcgtgcagaaggtgaacaatgaaggagagggggaccccttctatgaggtgctgggcctggtgaccctggaggatgtgattgaggagatcatcaagtctgagatcctggatgaaagtgacatgtacacagacaacagaagcaggaagagggtgtctgagaagaacaagagggacttcagcgccttcaaggatgctgacaatgagctgaaggtgaagatcagcccccagctgctgctggccgcccaccgcttcctggccacagaggtgtcccagttcagccccagcctcatcagcgagaagatcctgctgcggctgctgaagtacccagatgtgatccaggagctgaagtttgatgagcacaacaagtactatgcccggcactacctgtacaccaggaacaagccagctgactacttcatcctgatcctgcagggcaaggtggaggtggaggccggcaaggagaacatgaagtttgaaacaggagccttctcctactacggcaccatggccctgacctctgtgcccagcgacaggagccctgcccaccccacccccctgagccgcagcgccagcctgagctacccagacagaacagatgtgtccacagctgccaccctggccggcagcagcaaccagtttggcagctctgtgctgggccagtacatcagtgacttctctgtgcgggccctggtggacctgcagtacatcaagatcacccggcagcagtaccagaatggcctgctggccagcaggatggagaacagcccccagttccccattgatggctgcaccacccacatggagaacctggccgagaagtctgagctgcctgtggtggatgagaccaccaccctgctgaatgaaagaaacagcctgctgcacaaggccagccatgaaaatgccatctag

SEQ ID NO: 148828 - DNA, 792 bp, Artificial Sequence
  Description of Artificial Sequence: Synthetic coding sequence
atgtacacagacaacagaagcaggaagagggtgtctgagaagaacaagagggacttcagcgccttcaaggatgctgacaatgagctgaaggtgaagatcagcccccagctgctgctggccgcccaccgcttcctggccacagaggtgtcccagttcagccccagcctcatcagcgagaagatcctgctgcggctgctgaagtacccagatgtgatccaggagctgaagtttgatgagcacaacaagtactatgcccggcactacctgtacaccaggaacaagccagctgactacttcatcctgatcctgcagggcaaggtggaggtggaggccggcaaggagaacatgaagtttgagaccggggccttctcctactacggcaccatggccctgacctctgtgcccagcgacaggagccctgcccaccccacccccctgagccgcagcgccagcctgagctacccagacagaacagatgtgtccacagctgccaccctggccggcagcagcaaccagtttggcagctctgtgctgggccagtacatcagtgacttctctgtgcgggccctggtggacctgcagtacatcaagccccagagctggccctgcttcagcaggcctggggacagagtgtgcctgcctgccccacccagcatgaacagcagcctgccccacgccgaccacagcgctgctgtgcctgagagagctgctggcttcagccatggagagcagcccagcgtgagccaccggcgggtgcaccacccccacggggagctgggccgggaggtgtag

SEQ ID NO: 148829 - DNA, 2193 bp, Artificial Sequence
  Description of Artificial Sequence: Synthetic coding sequence
atggccagcggccgcggggccagcagccgctggttcttcacccgggagcagctggagaacacccccagccgccgctgtggggtggaggccgacaaggagctgagctgccggcagcaggccgccaacctgatccaggagatgggccagaggctgaatgtgtcccagctgaccatcaacacagccatcgtgtacatgcaccgcttctacatgcaccacagcttcaccaagttcaacaagaacatcatcagcagcacagccctcttcctggccgccaaggtggaggagcaggccaggaagctggagcacgtgatcaaggtggcccacgcctgcctgcaccccctggagcccctgctggacaccaagtgtgatgcctacctgcagcagacccaggagctggtgatcctggagaccatcatgctgcagaccctgggctttgagatcaccatcgagcacccccacacagatgtggtgaagtgcacccagctggtgcgggccagcaaggacctggcccagaccagctacttcatggccaccaacagcctgcacctgaccaccttctgcctgcagtacaagcccaccgtgattgcctgtgtgtgcatccacctggcctgcaagtggagcaactgggagatccctgtgtccacagatggcaagcactggtgggagtatgtggaccccaccgtgaccctggagctgctggatgagctgacccatgagttcctgcagatcctggagaagacccccaaccggctgaagaagatccggaactggagggccaaccaggccgccaggaagcccaaggtggatggccaggtgtctgagacccccctgctgggcagcagcctggtgcagaacagcatcctggtggacagcgtgactggagtgcccaccaaccccagcttccagaagcccagcaccagcgccttccctgcccctgtgcccctgaacagcggcaacatctctgtgcaggacagccacaccagtgacaacctgtccatgctggccaccggcatgcccagcaccagctatggcctgagcagccaccaggagtggccccagcaccaggacagcgccaggacagagcagctgtacagccagaagcaggagaccagcctgagcggcagccagtacaacatcaacttccagcagggccccagcatcagcctgcacagcggcctgcaccacaggccagacaagatcagtgaccacagctctgtgaagcaggagtacacccacaaggccggcagcagcaagcaccacggccccatcagcaccaccccaggcatcatcccccagaagatgagcctggacaagtaccgggagaagaggaagctggagaccctggacctggatgtgcgggaccactacatcgccgcccaggtggagcagcagcacaagcagggccagagccaggccgccagcagcagctctgtgaccagccccatcaagatgaagatccccatcgccaacacagagaagtacatggctgacaagaaggagaagagcggcagcctgaagctgcgcatccccatccccccaacagacaagagcgccagcaaggaggagctgaagatgaagatcaaggtgagcagcagcgagcggcacagcagcagtgatgagggcagcggcaagagcaagcacagcagcccccacatcagccgggaccacaaggagaagcacaaggagcaccccagcagccgccaccacaccagcagccacaagcacagccacagccacagcggcagcagcagcggcggcagcaagcacagcgcagatggcatccccccaacagtgctgcggagccctgtgggcctgagcagtgatggcatcagcagcagcagcagcagcagcaggaagaggctgcacgtgaatgatgccagccacaaccaccacagcaagatgagcaagagcagcaagagcagcggcagcagcagcagcagcagcagctctgtgaagcagtacatcagcagccacaacagcgtcttcaaccaccccctgcccccacctcctcctgtgacctaccaggtgggctacggccacctgagcaccctggtgaagctggacaagaagcctgtggagaccaatggaccagatgccaaccacgagtacagcaccagcagccagcacatggactacaaggacacctttgacatgctggacagcctgctgagcgcccagggcatgaacatgtag

SEQ ID NO: 148830 - DNA, 1992 bp, Artificial Sequence
  Description of Artificial Sequence: Synthetic coding sequence
atggccagcggccgcggggccagcagccgctggttcttcacccgggagcagctggagaacacccccagccgccgctgtggggtggaggccgacaaggagctgagctgccggcagcaggccgccaacctgatccaggagatgggccagaggctgaatgtgtcccagctgaccatcaacacagccatcgtgtacatgcaccgcttctacatgcaccacagcttcaccaagttcaacaagaacatcatcagcagcacagccctcttcctggccgccaaggtggaggagcaggccaggaagctggagcacgtgatcaaggtggcccacgcctgcctgcaccccctggagcccctgctggacaccaagtgtgatgcctacctgcagcagacccaggagctggtgatcctggagaccatcatgctgcagaccctgggctttgagatcaccatcgagcacccccacacagatgtggtgaagtgcacccagctggtgcgggccagcaaggacctggcccagaccagctacttcatggccaccaacagcctgcacctgaccaccttctgcctgcagtacaagcccaccgtgattgcctgtgtgtgcatccacctggcctgcaagtggagcaactgggagatccctgtgtccacagatggcaagcactggtgggagtatgtggaccccaccgtgaccctggagctgctggatgagctgacccatgagttcctgcagatcctggagaagacccccaaccggctgaagaagatccggaactggagggccaaccaggccgccaggaagcccaaggtggatggccaggtgtctgagacccccctgctgggcagcagcctggtgcagaacagcatcctggtggacagcgtgactggagtgcccaccaaccccagcttccagaagcccagcaccagcgccttccctgcccctgtgcccctgaacagcggcaacatctctgtgcaggacagccacaccagtgacaacctgtccatgctggccaccggcatgcccagcaccagctatggcctgagcagccaccaggagtggccccagcaccaggacagcgccaggacagagcagctgtacagccagaagcaggagaccagcctgagcggcagccagtacaacatcaacttccagcagggccccagcatcagcctgcacagcggcctgcaccacaggccagacaagatcagtgaccacagctctgtgaagcaggagtacacccacaaggccggcagcagcaagcaccacggccccatcagcaccaccccaggcatcatcccccagaagatgagcctggacaagtaccgggagaagaggaagctggagaccctggacctggatgtgcgggaccactacatcgccgcccaggtggagcagcagcacaagcagggccagagccaggccgccagcagcagctctgtgaccagccccatcaagatgaagatccccatcgccaacacagagaagtacatggctgacaagaaggagaagagcggcagcctgaagctgcgcatccccatccccccaacagacaagagcgccagcaaggaggagctgaagatgaagatcaaggtgagcagcagcgagcggcacagcagcagtgatgagggcagcggcaagagcaagcacagcagcccccacatcagccgggaccacaaggagaagcacaaggagcaccccagcagccgccaccacaccagcagccacaagcacagccacagccacagcggcagcagcagcggcggcagcaagcacagcgcagatggcatccccccaacagtgctgcggagccctgtgggcctgagcagtgatggcatcagcagcagcagcagcagcagcaggaagaggctgcacgtgaatgatgccagccacaaccaccacagcaagatgagcaagagcagcaagagcagcggcggcctgcggaccagccagcacccccgggagaccggccaggaggccagcggggaccagaggagctag

SEQ ID NO: 148831 - DNA, 1467 bp, Artificial Sequence
  Description of Artificial Sequence: Synthetic coding sequence
atggccaccaacagcctgcacctgaccaccttctgcctgcagtacaagcccaccgtcatcgcctgtgtgtgcatccacctggcctgcaagtggagcaactgggagatccctgtgtccacagatggcaagcactggtgggagtatgtggaccccaccgtgaccctggagctgctggatgagctgacccatgagttcctgcagatcctggagaagacccccaaccggctgaagaagatccggaactggagggccaaccaggccgccaggaagcccaaggtggatggccaggtgtctgagacccccctgctgggcagcagcctggtgcagaacagcatcctggtggacagcgtgactggagtgcccaccaaccccagcttccagaagcccagcaccagcgccttccctgcccctgtgcccctgaacagcggcaacatctctgtgcaggacagccacaccagtgacaacctgtccatgctggccaccggcatgcccagcaccagctatggcctgagcagccaccaggagtggccccagcaccaggacagcgccaggacagagcagctgtacagccagaagcaggagaccagcctgagcggcagccagtacaacatcaacttccagcagggccccagcatcagcctgcacagcggcctgcaccacaggccagacaagatcagtgaccacagctctgtgaagcaggagtacacccacaaggccggcagcagcaagcaccacggccccatcagcaccaccccaggcatcatcccccagaagatgagcctggacaagtaccgggagaagaggaagctggagaccctggacctggatgtgcgggaccactacatcgccgcccaggtggagcagcagcacaagcagggccagagccaggccgccagcagcagctctgtgaccagccccatcaagatgaagatccccatcgccaacacagagaagtacatggctgacaagaaggagaagagcggcagcctgaagctgcgcatccccatccccccaacagacaagagcgccagcaaggaggagctgaagatgaagatcaaggtgagcagcagcgagcggcacagcagcagtgatgagggcagcggcaagagcaagcacagcagcccccacatcagccgggaccacaaggagaagcacaaggagcaccccagcagccgccaccacaccagcagccacaagcacagccacagccacagcggcagcagcagcggcggcagcaagcacagcgcagatggcatcccccccaccgtgctgcggagccctgtgggcctgagcagtgatggcatcagcagcagcagcagcagcagcaggaagaggctgcacgtgaatgatgccagccacaaccaccacagcaagatgagcaagagcagcaagagcagcggcggcctgcggaccagccagcacccccgggagaccggccaggaggccagcggggaccagaggagctag

SEQ ID NO: 148832 - DNA, 864 bp, Artificial Sequence
  Description of Artificial Sequence: Synthetic coding sequence
atggagttcaaccccagcgaccacccccgggccagcaccatcttcctgagcaagagccagacagatgtgcgggagaagaggaagagcctcttcatcaaccaccaccccccaggccagatcgccaggaagtacagcagctgcagcaccatcttcctggatgacagcacagtgtcccagcccaacctgaagtacaccatcaagtgtgtggccctggccatctactaccacatcaagaacagagatcctgatggccgcatgctgctggacatctttgatgagaacctgcaccccctgagcaagtctgaggtgcccccagactatgacaagcacaaccctgagcagaagcagatctacagatttgtgaggaccctcttctctgctgcccagctgacagcagaatgtgccatcgtgaccctggtgtacctggagcggctgctgacctatgcagaaattgacatctgcccagccaactggaagagaattgtgctgggcgccatcctgctggccagcaaggtgtgggatgaccaggccgtgtggaatgtggactactgccagatcctgaaggacatcaccgtggaggacatgaatgagctggagcggcagttcctggagctgctgcagttcaacatcaacgtgcccagctctgtgtatgccaagtactactttgacctgcggagcctggccgaggccaacaacctgtccttccccctggagcccctgagccgggagcgggcccacaagctggaggccatcagccggctgtgtgaggacaagtacaaggacctgcggcgcagcgccaggaagaggtctgccagcgctgacaacctgaccctgccccgctggagccctgccatcatctcctag

SEQ ID NO: 148833 - DNA, 951 bp, Artificial Sequence
  Description of Artificial Sequence: Synthetic coding sequence
atgggcaacaccaccagctgctgcgtgagcagcagccccaagctgcggagaaatgcccacagccggctggagagctacagaccagacacagacctgagccgggaggacaccggctgcaacctgcagcacatcagtgaccgggagaacattgatgtgcgggagaagaggaagagcctcttcatcaaccaccaccccccaggccagatcgccaggaagtacagcagctgcagcaccatcttcctggatgacagcacagtgtcccagcccaacctgaagtacaccatcaagtgtgtggccctggccatctactaccacatcaagaacagagatcctgatggccgcatgctgctggacatctttgatgagaacctgcaccccctgagcaagtctgaggtgcccccagactatgacaagcacaaccctgagcagaagcagatctacagatttgtgaggaccctcttctctgctgcccagctgacagcagaatgtgccatcgtgaccctggtgtacctggagcggctgctgacctacgccgagattgacatctgcccagccaactggaagagaattgtgctgggcgccatcctgctggccagcaaggtgtgggatgaccaggccgtgtggaatgtggactactgccagatcctgaaggacatcaccgtggaggacatgaatgagctggagcggcagttcctggagctgctgcagttcaacatcaacgtgcccagctctgtgtatgccaagtactactttgacctgcggagcctggccgaggccaacaacctgtccttccccctggagcccctgagccgggagcgggcccacaagctggaggccatcagccggctgtgtgaggacaagtacaaggacctgcggcgcagcgccaggaagaggtctgccagcgctgacaacctgaccctgccccgctggagccctgccatcatctcctag

SEQ ID NO: 148834 - DNA, 1026 bp, Artificial Sequence
  Description of Artificial Sequence: Synthetic coding sequence
atgggcaacaccaccagctgctgcgtgagcagcagccccaagctgcggagaaatgcccacagccggctggagagctacagaccagacacagacctgagccgggaggacaccggctgcaacctgcagcacatcagtgaccgggagaacattgatgacctgaacatggagttcaaccccagcgaccacccccgggccagcaccatcttcctgagcaagagccagacagatgtgcgggagaagaggaagagcctcttcatcaaccaccaccccccaggccagatcgccaggaagtacagcagctgcagcaccatcttcctggatgacagcacagtgtcccagcccaacctgaagtacaccatcaagtgtgtggccctggccatctactaccacatcaagaacagagatcctgatggccgcatgctgctggacatctttgatgagaacctgcaccccctgagcaagtctgaggtgcccccagactatgacaagcacaaccctgagcagaagcagatctacagatttgtgaggaccctcttctctgctgcccagctgacagcagaatgtgccatcgtgaccctggtgtacctggagcggctgctgacctatgcagaaattgacatctgcccagccaactggaagagaattgtgctgggcgccatcctgctggccagcaaggtgtgggatgaccaggccgtgtggaatgtggactactgccagatcctgaaggacatcaccgtggaggacatgaatgagctggagcggcagttcctggagctgctgcagttcaacatcaacgtgcccagctctgtgtatgccaagtactactttgacctgcggagcctggccgaggccaacaacctgtccttccccctggagcccctgagccgggagcgggcccacaagctggaggccatcagccggctgtgtgaggacaagtacaaggacctgcggcgcagcgccaggaagaggtctgccagcgctgacaacctgaccctgccccgctggagccctgccatcatctcctag

SEQ ID NO: 148835 - DNA, 864 bp, Artificial Sequence; identical to SEQ ID NO: 148832
  Description of Artificial Sequence: Synthetic coding sequence

SEQ ID NO: 148836 - DNA, 627 bp, Artificial Sequence
  Description of Artificial Sequence: Synthetic coding sequence
atggaccctgatggccgcatgctgctggacatctttgatgagaacctgcaccccctgagcaagtctgaggtgcccccagactatgacaagcacaaccctgagcagaagcagatctacagatttgtgaggaccctcttctctgctgcccagctgacagcagaatgtgccatcgtgaccctggtgtacctggagcggctgctgacctacgccgagattgacatctgcccagccaactggaagagaattgtgctgggcgccatcctgctggccagcaaggtgtgggatgaccaggccgtgtggaatgtggactactgccagatcctgaaggacatcaccgtggaggacatgaatgagctggagcggcagttcctggagctgctgcagttcaacatcaacgtgcccagctctgtgtatgccaagtactactttgacctgcggagcctggccgaggccaacaacctgtccttccccctggagcccctgagccgggagcgggcccacaagctggaggccatcagccggctgtgtgaggacaagtacaaggacctgcggcgcagcgccaggaagaggtctgccagcgctgacaacctgaccctgccccgctggagccctgccatcatctcctag

SEQ ID NO: 148837 - DNA, 1026 bp, Artificial Sequence; identical to SEQ ID NO: 148834
  Description of Artificial Sequence: Synthetic coding sequence

SEQ ID NO: 148838 - DNA, 942 bp, Artificial Sequence
  Description of Artificial Sequence: Synthetic coding sequence
atggagcccatgtaccaggaccgggcccgggacacccagacagatgaaattgtggccctgaagaaggtgaggatggacaaggagaaggatggcatccccatcagcagcctgcgggagatcaccctgctgctgcggctgcggcaccccaacatcgtggagctgaaggaggtggtggtgggcaaccacctggagagcatcttcctggtgatgggctactgtgagcaggacctggccagcctgctggagaacatgcccacccccttcagcgaggcccaggtgaagtgcatcgtgctgcaggtgctgcggggcctgcagtacctgcacaggaacttcatcatccaccgggacctgaaggtgagcaacctgctgatgacagacaagggctgtgtgaagacagctgactttggcctggcccgggcctatggagtgcctgtgaagcccatgacccccaaggtggtgaccctgtggtaccgggcccctgagctgctgctgggcaccaccacccagaccaccagcattgacatgtgggccgtgggctgcatcctggccgagctgctggcccaccggcccctgctgcccggcaccagcgagatccaccagattgacctgattgtgcagctgctgggcacccccagcgagaacatctggccaggcttcagcaagctgcccctggtgggccagtacagcctgaggaagcagccctacaacaacctgaagcacaagttcccctggctgtctgaggccggcctgcggctgctgcacttcctgttcatgtatgaccccaagaagagggccacagctggggactgcctggagagcagctacttcaaggagaagcccctgccctgtgagcctgagctgatgcccaccttcccccaccacaggaacaagagagctgccccagccaccagcgagggccagagcaagcgctgcaagccctag

SEQ ID NO: 148839 - DNA, 1083 bp, Artificial Sequence
  Description of Artificial Sequence: Synthetic coding sequence
atggccgagccagacctggagtgtgagcagatccggctgaagtgcatcaggaaggagggcttcttcaccgtgcccccagagcaccggctgggccgctgccgctctgtgaaggagtttgagaagctgaacagaattggagagggcacctacggcatcgtgtaccgggcccgggacacccagacagatgagatcgtggccctgaagaaggtgaggatggacaaggagaaggatggcatccccatcagcagcctgcgggagatcaccctgctgctgcggctgcggcaccccaacatcgtggagctgaaggaggtggtggtgggcaaccacctggagagcatcttcctggtgatgggctactgtgagcaggacctggccagcctgctggagaacatgcccacccccttcagcgaggcccaggtgaagtgcatcgtgctgcaggtgctgcggggcctgcagtacctgcacaggaacttcatcatccaccgggacctgaaggtgagcaacctgctgatgacagacaagggctgtgtgaagacagctgactttggcctggcccgggcctacggcgtgcctgtgaagcccatgacccccaaggtggtgaccctgtggtaccgggcccctgagctgctgctgggcaccaccacccagaccaccagcattgacatgtgggccgtgggctgcatcctggccgagctgctggcccaccggcccctgctgcccggcaccagcgagatccaccagattgacctgattgtgcagctgctgggcaccccatctgagaacatctggccaggcttcagcaagctgcccctggtgggccagtacagcctgaggaagcagccctacaacaacctgaagcacaagttcccctggctgtctgaggccggcctgcggctgctgcacttcctgttcatgtatgaccccaagaagagggccacagctggggactgcctggagagcagctacttcaaggagaagcccctgccctgtgagcctgagctgatgcccaccttcccccaccacaggaacaagagagctgccccagccaccagcgagggccagagcaagcgctgcaagccctag

SEQ ID NO: 148840 - DNA, 819 bp, Artificial Sequence
  Description of Artificial Sequence: Synthetic coding sequence
atggacaaggagaaggatggcatccccatcagcagcctgcgggagatcaccctgctgctgcggctgcggcaccccaacatcgtggagctgaaggaggtggtggtgggcaaccacctggagagcatcttcctggtgatgggctactgtgagcaggacctggccagcctgctggagaacatgcccacccccttcagcgaggcccaggtgaagtgcatcgtgctgcaggtgctgcggggcctgcagtacctgcacaggaacttcatcatccaccgggacctgaaggtgagcaacctgctgatgacagacaagggctgtgtgaagacagctgactttggcctggcccgggcctatggagtgcctgtgaagcccatgacccccaaggtggtgaccctgtggtaccgggcccctgagctgctgctgggcaccaccacccagaccaccagcattgacatgtgggccgtgggctgcatcctggccgagctgctggcccaccggcccctgctgcccggcaccagcgagatccaccagattgacctgattgtgcagctgctgggcacccccagcgagaacatctggccaggcttcagcaagctgcccctggtgggccagtacagcctgaggaagcagccctacaacaacctgaagcacaagttcccctggctgtctgaggccggcctgcggctgctgcacttcctgttcatgtatgaccccaagaagagggccacagctggggactgcctggagagcagctacttcaaggagaagcccctgcggctgcccatcagcggcgtgtgtgagggctgccgggagcctggatag

SEQ ID NO: 148841 - DNA, 504 bp, Artificial Sequence
  Description of Artificial Sequence: Synthetic coding sequence
atgggcaagacagaggagaagggaaatggaaaaggagccttccaggagaggaagggccccctgggcgctgtgaggaaggaggccggggccggggcccaggatgctggagctgctgagggcgctgctgtgaagaagatgaccttcagcgagcacccctacaacaacctgaggaagagatttggagccctgctgagtgaccagggctttgacctgatgaacaagttcctgacctacttccctggccgccgcatctctgcagaagatggcctgaagcatgagtacttccgggagacccccctgcccatcgaccccagcatgttccccacctggccagccaagtctgagcagcagagggtgaagaggggcaccagccccaggcctcctgagggcggcctgggctacagccagctgggagatgatgacctgaaggagaccggcttccacctgaccaccaccaaccagggcgccagcgctgctggccctggcttcagcctgaagttctag

SEQ ID NO: 148842 - DNA, 2241 bp, Artificial Sequence
  Description of Artificial Sequence: Synthetic coding sequence
atgagccagagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtgccgccaccacagccacagcgctgagggcggcaagcacgcccgggtgaaggagcgggagcatgaaagaaggaagaggcaccgggaggagcaggacaaggcccggcgggagtgggagcggcagaagagaagagagatggcccgggagcacagccggcgggagcgggaccggctggagcagctggagaggaagcgggagcgggagaggaagatgagggagcagcagaaggagcagcgggagcagaaggagcgggagcggcgggcagaggagaggaggaaggagcgggaggcccggcgggaggtgtctgcccaccacaggaccatgagggaggactacagcgacaaggtgaaggccagccactggagccgcagccccccccggcccccccgggagagatttgagctgggagatggcaggaagcctgtgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagagagaaaatgaaaaccacctgctggtggtgcctgagagcagatttgaccgggacagcggggagagcgaggaggccgaggaggaggtgggggagggcaccccccagagcagcgccctgacagaaggagactatgtgcctgacagccctgccctgctgcccatcgagctgaagcaggagctgcccaagtacctgcctgccctgcagggctgccgctctgtggaggagttccagtgcctgaacagaattgaggagggcacctacggcgtggtgtaccgggccaaggacaagaagacagatgagatcgtggccctgaagaggctgaagatggagaaggagaaggagggcttccccatcaccagcctgcgggagatcaacaccatcctgaaggcccagcaccccaacatcgtgacagtgcgggagatcgtggtgggcagcaacatggacaagatctacatcgtgatgaactacgtggagcatgacctgaagagcctgatggagaccatgaagcagcccttcctgcctggagaggtgaagaccctgatgatccagctgctgcggggcgtgaagcacctgcatgacaactggatcctgcaccgggacctgaagaccagcaacctgctgctgagccacgccggcatcctgaaggtgggggactttggcctggcccgggagtatggcagccccctgaaggcctacacccctgtggtggtgacccagtggtaccgggcccctgagctgctgctgggcgccaaggagtacagcacagctgtggacatgtggagcgtgggctgcatctttggagagctgctgacccagaagcccctcttccctggcaacagcgagattgaccagatcaacaaggtgttcaaggagctgggcaccccatctgagaagatctggccaggctacagcgagctgcctgtggtgaagaagatgaccttcagcgagcacccctacaacaacctgaggaagagatttggagccctgctgagtgaccagggctttgacctgatgaacaagttcctgacctacttccctggaagacgcatctctgcagaagatggcctgaagcatgagtacttccgggagacccccctgcccatcgaccccagcatgttccccacctggccagccaagtctgagcagcagagggtgaagaggggcaccagcccccggcccccagagggcggcctgggctacagccagctgggagatgatgacctgaaggagaccggcttccacctgaccaccaccaaccagggcgccagcgctgctggccctggcttcagcctgaagttctag

SEQ ID NO: 148843 - DNA, 2340 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtggaagcacgcccgggtgaaggagcgggagcatgaaagaaggaagaggcaccgggaggagcaggacaaggcccggcgggagtgggagcggcagaagagaagagagatggcccgggagcacagccggcgggagagaggaaatgatggagtgtgcctcttccgggaccggctggagcagctggagaggaagcgggagcgggagaggaagatgagggagcagcagaaggagcagcgggagcagaaggagcgggagaggagagctgaggagaggaggaaggagcgggaggcccggcgggaggtgtctgcccaccacaggaccatgagggaggactacagcgacaaggtgaaggccagccactggagccgcagcccccccaggcctccccgggagagatttgagctgggagatggcaggaagcctgtgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagcgggagaatgaaaaccacctgctggtggtgcctgagagcagatttgaccgggacagcggggagagcgaggaggccgaggaggaggtgggggagggcaccccccagagcagcgccctgacagaaggagactatgtgcctgacagccctgccctgctgcccatcgagctgaagcaggagctgcccaagtacctgcctgccctgcagggctgccgctctgtggaggagttccagtgcctgaaccgcatcgaggagggcacctatggagtggtgtaccgggccaaggacaagaagacagatgaaattgtggccctgaagaggctgaagatggagaaggagaaggagggcttccccatcaccagcctgcgggagatcaacaccatcctgaaggcccagcaccccaacatcgtgacagtgcgggagatcgtggtgggcagcaacatggacaagatctacatcgtgatgaactacgtggagcatgacctgaagagcctgatggagaccatgaagcagcccttcctgcccggggaggtgaagaccctgatgatccagctgctgcggggcgtgaagcacctgcatgacaactggatcctgcaccgggacctgaagaccagcaacctgctgctgagccatgctggcatcctgaaggtgggggactttggcctggcccgggagtatggcagccccctgaaggcctacacccctgtggtggtgacccagtggtaccgggcccctgagctgctgctgggcgccaaggagtacagcacagctgtggacatgtggagcgtgggctgcatctttggagagctgctgacccagaagcccctcttccctggcaacagcgagattgaccagatcaacaaggtgttcaaggagctgggcacccccagcgagaagatctggccaggctacagcgagctgcctgtggtgaagaagatgaccttcagcgagcacccctacaacaacctgaggaagagatttggagccctgctgagtgaccagggctttgacctgatgaacaagttcctgacctacttccctggccgccgcatctctgcagaagatggcctgaagcatgagtacttccgggagacccccctgcccatcgaccccagcatgttccccacctggccagccaagtctgagcagcagagggtgaagaggggcaccagccccaggcctcctgagggcggcctgggctacagccagctgggagatgatgacctgaaggagaccggcttccacctgaccaccaccaaccagggcgccagcgctgctggccctggcttcagcctgaagttctag

SEQ ID NO: 148844 - DNA, 2313 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtggaagcacgcccgggtgaaggagcgggagcatgaaagaaggaagaggcaccgggaggagcaggacaaggcccggcgggagtgggagcggcagaagagaagagagatggcccgggagcacagccggcgggagcgggaccggctggagcagctggagaggaagcgggagcgggagaggaagatgagggagcagcagaaggagcagcgggagcagaaggagcgggagcggcgggcagaggagaggaggaaggagcgggaggcccggcgggaggtgtctgcccaccacaggaccatgagggaggactacagcgacaaggtgaaggccagccactggagccgcagccccccccggcccccccgggagagatttgagctgggagatggcaggaagcctgtgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagagagaaaatgaaaaccacctgctggtggtgcctgagagcagatttgaccgggacagcggggagagcgaggaggccgaggaggaggtgggggagggcaccccccagagcagcgccctgacagaaggagactatgtgcctgacagccctgccctgctgcccatcgagctgaagcaggagctgcccaagtacctgcctgccctgcagggctgccgctctgtggaggagttccagtgcctgaacagaattgaggagggcacctacggcgtggtgtaccgggccaaggacaagaagacagatgagatcgtggccctgaagaggctgaagatggagaaggagaaggagggcttccccatcaccagcctgcgggagatcaacaccatcctgaaggcccagcaccccaacatcgtgacagtgcgggagatcgtggtgggcagcaacatggacaagatctacatcgtgatgaactacgtggagcatgacctgaagagcctgatggagaccatgaagcagcccttcctgcctggagaggtgaagaccctgatgatccagctgctgcggggcgtgaagcacctgcatgacaactggatcctgcaccgggacctgaagaccagcaacctgctgctgagccacgccggcatcctgaaggtgggggactttggcctggcccgggagtatggcagccccctgaaggcctacacccctgtggtggtgacccagtggtaccgggcccctgagctgctgctgggcgccaaggagtacagcacagctgtggacatgtggagcgtgggctgcatctttggagagctgctgacccagaagcccctcttccctggcaacagcgagattgaccagatcaacaaggtgttcaaggagctgggcaccccatctgagaagatctggccaggctacagcgagctgcctgtggtgaagaagatgaccttcagcgagcacccctacaacaacctgaggaagagatttggagccctgctgagtgaccagggctttgacctgatgaacaagttcctgacctacttccctggaagacgcatctctgcagaagatggcctgaagcatgagtacttccgggagacccccctgcccatcgaccccagcatgttccccacctggccagccaagtctgagcagcagagggtgaagaggggcaccagcccccggcccccagagggcggcctgggctacagccagctgggagatgatgacctgaaggagaccggcttccacctgaccaccaccaaccagggcgccagcgctgctggccctggcttcagcctgaagttctag

SEQ ID NO: 148845 - DNA, 2241 bp, Artificial Sequence; identical to SEQ ID NO: 148842
  Description of Artificial Sequence: Synthetic coding sequence

SEQ ID NO: 148846 - DNA, 2352 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtggaagcacgcccgggtgaaggagcgggagcatgaaagaaggaagaggcaccgggaggagcaggacaaggcccggcgggagtgggagcggcagaagagaagagagatggcccgggagcacagccggcgggagcgggaccggctggagcagctggagaggaagcgggagcgggagaggaagatgagggagcagcagaaggagcagcgggagcagaaggagcgggagcggcgggcagaggagaggaggaaggagcgggaggcccggcgggaggtgtctgcccaccacaggaccatgagggaggactacagcgacaaggtgaaggccagccactggagccgcagccccccccggcccccccgggagagatttgagctgggagatggcaggaagccaggagaggcccggcctgccccagcccagaagccagcccagctgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagcgggagaatgaaaaccacctgctggtggtgcctgagagcagatttgaccgggacagcggggagagcgaggaggccgaggaggaggtgggggagggcaccccccagagcagcgccctgacagaaggagactatgtgcctgacagccctgccctgctgcccatcgagctgaagcaggagctgcccaagtacctgcctgccctgcagggctgccgctctgtggaggagttccagtgcctgaaccgcatcgaggagggcacctatggagtggtgtaccgggccaaggacaagaagacagatgaaattgtggccctgaagaggctgaagatggagaaggagaaggagggcttccccatcaccagcctgcgggagatcaacaccatcctgaaggcccagcaccccaacatcgtgacagtgcgggagatcgtggtgggcagcaacatggacaagatctacatcgtgatgaactacgtggagcatgacctgaagagcctgatggagaccatgaagcagcccttcctgcccggggaggtgaagaccctgatgatccagctgctgcggggcgtgaagcacctgcatgacaactggatcctgcaccgggacctgaagaccagcaacctgctgctgagccatgctggcatcctgaaggtgggggactttggcctggcccgggagtatggcagccccctgaaggcctacacccctgtggtggtgacccagtggtaccgggcccctgagctgctgctgggcgccaaggagtacagcacagctgtggacatgtggagcgtgggctgcatctttggagagctgctgacccagaagcccctcttccctggcaacagcgagattgaccagatcaacaaggtgttcaaggagctgggcacccccagcgagaagatctggccaggctacagcgagctgcctgtggtgaagaagatgaccttcagcgagcacccctacaacaacctgaggaagagatttggagccctgctgagtgaccagggctttgacctgatgaacaagttcctgacctacttccctggccgccgcatctctgcagaagatggcctgaagcatgagtacttccgggagacccccctgcccatcgaccccagcatgttccccacctggccagccaagtctgagcagcagagggtgaagaggggcaccagccccaggcctcctgagggcggcctgggctacagccagctgggagatgatgacctgaaggagaccggcttccacctgaccaccaccaaccagggcgccagcgctgctggccctggcttcagcctgaagttctag

SEQ ID NO: 148847 - DNA, 699 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtggaagcacgcccgggtgaaggagcgggagcatgaaagaaggaagaggcaccgggaggagcaggacaaggcccggcgggagtgggagcggcagaagagaagagagatggcccgggagcacagccggcgggagagcgtgtgcaccagccccaatgatgagcggggcctgcagaggcagagcgagagccagcccctggagagccagcctgccagcgctgctgctggagctgtgcgggtgggcagaagacctgaggccagcaagaggcgggagaatggaaggaagggccctgctgtgcggctgaccggccaccagaggcagcgggaggaggaccagctgggccgggtgctggtgtctggcatccggctgcgcttctag

SEQ ID NO: 148848 - DNA, 2241 bp, Artificial Sequence; identical to SEQ ID NO: 148842
  Description of Artificial Sequence: Synthetic coding sequence

SEQ ID NO: 148849 - DNA, 114 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaactag

SEQ ID NO: 148850 - DNA, 2343 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtgccgccaccacagccacagcgctgagggcggcaagcacgcccgggtgaaggagcgggagcatgaaagaaggaagaggcaccgggaggagcaggacaaggcccggcgggagtgggagcggcagaagagaagagagatggcccgggagcacagccggcgggagcgggaccggctggagcagctggagaggaagcgggagcgggagaggaagatgagggagcagcagaaggagcagcgggagcagaaggagcgggagcggcgggcagaggagaggaggaaggagcgggaggcccggcgggaggtgtctgcccaccacaggaccatgagggaggactacagcgacaaggtgaaggccagccactggagccgcagccccccccggcccccccgggagagatttgagctgggagatggcaggaagcctgtgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagagagaaaatgaaaaccacctgctggtggtgcctgagagcagatttgaccgggacagcggggagagcgaggaggccgaggaggaggtgggggagggcaccccccagagcagcgccctgacagaaggagactatgtgcctgacagccctgccctgctgcccatcgagctgaagcaggagctgcccaagtacctgcctgccctgcagggctgccgctctgtggaggagttccagtgcctgaacagaattgaggagggcacctacggcgtggtgtaccgggccaaggacaagaagacagatgagatcgtggccctgaagaggctgaagatggagaaggagaaggagggcttccccatcaccagcctgcgggagatcaacaccatcctgaaggcccagcaccccaacatcgtgacagtgcgggagatcgtggtgggcagcaacatggacaagatctacatcgtgatgaactacgtggagcatgacctgaagagcctgatggagaccatgaagcagcccttcctgcctggagaggtgaagaccctgatgatccagctgctgcggggcgtgaagcacctgcatgacaactggatcctgcaccgggacctgaagaccagcaacctgctgctgagccacgccggcatcctgaaggtgggggactttggcctggcccgggagtatggcagccccctgaaggcctacacccctgtggtggtgacccagtggtaccgggcccctgagctgctgctgggcgccaaggagtacagcacagctgtggacatgtggagcgtgggctgcatctttggagagctgctgacccagaagcccctcttccctggcaacagcgagattgaccagatcaacaaggtgttcaaggagctgggcaccccatctgagaagatctggccaggctacagcgagctgcctgtggtgaagaagatgaccttcagcgagcacccctacaacaacctgaggaagagatttggagccctgctgagtgaccagggctttgacctgatgaacaagttcctgacctacttccctggaagacgcatctctgcagaagatggcctgaagcatgagtacttccgggagacccccctgcccatcgaccccagcatgttccccacctggccagccaagtctgagcagcagagggtgaagaggggcaccagcccccggcccccagagggcggcctgggctacagccagctgggagatgatgacctgaaggagaccggcttccacctgaccaccaccaaccagggcgccagcgctgctggccctggcttcagcctgaagttctag

SEQ ID NO: 148851 - DNA, 456 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtggaagcacgcccgggtgaaggagcgggagcatgaaagaaggaagaggcaccgggaggagcaggacaaggcccggcgggagtgggagcggcagaagagaagagagatggcccgggagcacagcagaagatag

SEQ ID NO: 148852 - DNA, 1263 bp, Artificial Sequence
  Description of Artificial Sequence: Synthetic coding sequence
atgggagatgagaaggacagctggaaggtgaagaccctggatgagatcctgcaggagaagaagaggaggaaggagcaggaggagaaggccgagatcaagaggctgaagaacagtgatgaccgggacagcaagagggacagcctggaggagggggagctgcgggaccactgcatggagatcaccatccggaacagcccctaccgccgggaggacagcatggaggacagaggagaagaagatgacagcctggccatcaagccaccccagcagatgagcaggaaggagaaggtgcaccacaggaaggatgagaagaggaaggagaagtgccgccaccacagccacagcgctgagggcggcaagcacgcccgggtgaaggagcgggagcatgaaagaaggaagaggcaccgggaggagcaggacaaggcccggcgggagtgggagcggcagaagagaagagagatggcccgggagcacagccggcgggagcgggaccggctggagcagctggagaggaagcgggagcgggagaggaagatgagggagcagcagaaggagcagcgggagcagaaggagcgggagcggcgggcagaggagaggaggaaggagcgggaggcccggcgggaggtgtctgcccaccacaggaccatgagggaggactacagcgacaaggtgaaggccagccactggagccgcagccccccccggcccccccgggagagatttgagctgggagatggcaggaagccaggagaggcccggcctgccccagcccagaagccagcccagctgaaggaggagaagatggaggagcgggacctgctgagtgacctgcaggacatcagtgacagcgagaggaagaccagcagcgctgagagcagcagcgctgagagcggcagcggcagcgaggaggaggaggaggaggaggaggaggaggaggaggagggcagcaccagcgaggagagcgaggaggaggaggaggaggaggaggaggaggaggaggagaccggcagcaacagcgaggaggccagcgagcagagcgctgaggaggtgtctgaggaggagatgtctgaagatgaggagcgggagaatgaaaaccacctgctggtggtgcctgagagcagatttgaccgggacagcggggagagcgaggaggccgaggaggaggtgggcctgcctgagcggcggggcgtgcctgtgcctgagcaggacagaggaggccacctgtggagcggcctgcagagcaagaggcaggagaacagatag

SEQ ID NO: 148853 - DNA, 1686 bp, Artificial Sequence
  Description of Artificial Sequence: Synthetic coding sequence
atggccatcgccaccagcacccagctggcccgggccctgtatgacaacacagctgagagcccccaggagctgtccttcagaagaggagatgtgctgcgggtgctgcagcgggagggcgctgggggcctggatggctggtgcctgtgcagcctgcacggccagcagggcatcgtgcctgccaacagagtgaagctgctgcctgctggccctgcccccaagcccagcctgagccctgccagccctgcccagcccggcagcccctacccagccccagaccacagcaatgaagaccaggaggtgtatgtggtgcccccaccagcccggccctgccccaccagcggccccccagctggcccctgcccccccagcccagacctgatctacaagatcccccgggccagcggcacccagctggccgcccccagagatgccctggaggtgtatgatgtgcccccaacagccctgcgggtgcccagcagcggcccctatgactgcccagccagcttcagccaccccctgaccagggtggccccccagcccccaggagaagatgatgccccctatgatgtgcccctgacccccaagcccccagctgagctggagccagacctggagtgggagggcggccgggagcccggcccccccatctatgctgcccccagcaacctgaagagggccagcgccctgctgaacctgtatgaggcccctgaggagctgctggctgatggagagggcggcggcacagatgagggcatctatgatgtgcccctgctgggccctgaggccccacccagccctgagcccccaggggccctggccagccatgaccaggacaccctggcccagctgctggcccggagccccccaccaccccaccggccccggctgcccagcgctgagagcctgagccggcggcccctgcctgccctgcctgtgcctgaggcccccagccccagccctgtgcccagccctgcccctggcaggaagggcagcatccaggaccggcccctgcccccacctccaccccggctgcccggctatggaggccccaaggtggagggggaccctgagggccgggagatggaggatgatcctgctggccaccacaatgaatatgagggcatccccatggccgaggagtatgactatgtgcacctgaagggcatggacaaggcccagggcagccggcccccagaccaggcctgcacaggagaccctgagctgcctgagcggggcatgcctgccccccaggaggccctgagccctggagagcccctggtggtgtccactggagacctgcagctgctgtacttctacgccggccagtgccagagccactacagcgccctgcaggccgctgtggccgccctgatgagcagcacccaggccaaccagcccccccggctgtttgtgccccacagcaagagggtggtggtggccgcccaccggctggtgtttgtgggggacaccctgggccgcctggccgccagcgcccccctgcgggcccaggtgcgggctgctggaacagccctgggccaggccctgcgggccaccgtgctggccgtgaagggagctgccctgggctaccccagcagccctgccatccaggagatggtgcagtgtgtgacagagctggccggccaggccctgcagttcaccaccctgctgaccagcctggccccctag

SEQ ID NO: 148854 - DNA, 684 bp, Artificial Sequence
  Description of Artificial Sequence: Synthetic coding sequence
atgaatggcaccatctatgccaatgaatgccagcagatccgccaccccaacagcaagaccctgggcaccgtgacccccaggaagcctgtgctgtctgtgtctgccaggaagatcaaggacaatgctgctgactggcacaacctgatcctgaagtgggagaccctgaatgatgctggcttcaccacagccaacaacatcgccaacctgaagatcagcctgctgaacaaggacaagattgagctggacagcagcagccctgccagcaaagaaaatgaggagaaggtgtgcctggagtacaatgaggagctggagaagctgtgtgaggagctgcaggccaccctggatggcctgaccaagatccaggtgaagatggagaagctgagcagcaccaccaagggcatctgtgagctggagaactaccactacggggaggagagcaagaggcctcctctcttccacacctggcccaccacccacttctatgaggtgagccacaagctgctggagatgtacaggaaggagctgctgctgaagaggacagtggccaaggagctggcccacactggagaccctgacctgaccctgagctacctgtccatgtggctgcaccagccctacgtggagagtgacagccggctgcacctggagagcatgctgctggagaccggccaccgggccctgtag

SEQ ID NO: 148855 - DNA, 357 bp, Artificial Sequence
  Description of Artificial Sequence: Synthetic coding sequence
atggaggccaagaccctgggcaccgtgacccccaggaagcctgtgctgtctgtgtctgccaggaagatcaaggacaatgctgctgactggcacaacctgatcctgaagtgggagaccctgaatgatgctggcttcaccacagccaacaacatcgccaacctgaagatcagcctgctgaacaaggacaagattgagctggacagcagcagccctgccagcaaagaaaatgaggagaaggtgtgcctggagtacaatgaggagctggagaagctgtgtgaggagctgcaggccaccctggatggcctgatgaggttccgcatcagctcctggcgctgcaccggccgcagctgcagctag

SEQ ID NO: 148856 - DNA, 639 bp, Artificial Sequence
  Description of Artificial Sequence: Synthetic coding sequence
atggaggccaagaccctgggcaccgtgacccccaggaagcctgtgctgtctgtgtctgccaggaagatcaaggacaatgctgctgactggcacaacctgatcctgaagtgggagaccctgaatgatgctggcttcaccacagccaacaacatcgccaacctgaagatcagcctgctgaacaaggacaagattgagctggacagcagcagccctgccagcaaagaaaatgaggagaaggtgtgcctggagtacaatgaggagctggagaagctgtgtgaggagctgcaggccaccctggatggcctgaccaagatccaggtgaagatggagaagctgagcagcaccaccaagggcatctgtgagctggagaactaccactatggagaggagagcaagaggcctcctctcttccacacctggcccaccacccacttctatgaggtgagccacaagctgctggagatgtacaggaaggagctgctgctgaagaggacagtggccaaggagctggcccacactggagaccctgacctgaccctgagctacctgtccatgtggctgcaccagccctacgtggagagtgacagccggctgcacctggagagcatgctgctggagaccggccaccgggccctgtag

SEQ ID NO: 148857 - DNA, 918 bp, Artificial Sequence
  Description of Artificial Sequence: Synthetic coding sequence
atggacatgttccagaaggtggagaagatcggggagggcacctatggagtggtgtacaaggccaagaaccgggagaccggccagctggtggccctgaagaagatccggctggacctggagatggagggcgtgcccagcacagccatccgggagatcagcctgctgaaggagctgaagcaccccaacatcgtgcggctgctggatgtggtgcacaatgaaaggaagctgtacctggtgtttgagttcctgagccaggacctgaagaagtacatggacagcaccccaggcagcgagctgcccctgcacctgatcaagagctacctgttccagctgctgcagggcgtgtccttctgccacagccacagggtcatccaccgggacctgaagccccagaacctgctgatcaatgagctgggcgccatcaagctggccgactttggcctggcccgggccttcggcgtgcccctgcggacctacacccatgaggtggtgaccctgtggtaccgggcccctgagatcctgctgggcagcaagttctacaccacagctgtggacatctggagcatcggctgcatctttgctgagatggtgaccaggaaggccctcttccctggggacagcgagattgaccagctgttccgcatcttcaggatgctgggcaccccatctgaggacacctggccaggagtgacccagctgcctgactacaagggcagcttccccaagtggaccaggaagggcctggaggagatcgtgcccaacctggagcctgagggccgggacctgctgatgcagctgctgcagtatgaccccagccagaggatcacagccaagacagccctggcccacccctacttcagcagccctgagcccagccctgctgcccggcagtatgtgctgcagcgcttccgccactag

SEQ ID NO: 148858 - DNA, 918 bp, Artificial Sequence; identical to SEQ ID NO: 148857
  Description of Artificial Sequence: Synthetic coding sequence

SEQ ID NO: 148859 - DNA, 879 bp, Artificial Sequence
  Description of Artificial Sequence: Synthetic coding sequence
atgcagaagtatgagaagctggagaagatcggggagggcacctatggaacagtgttcaaggccaagaaccgggagacccatgaaattgtggccctgaagagggtgcggctggatgatgatgatgaaggagtgcccagcagcgccctgcgggagatctgcctgctgaaggagctgaagcacaagaacatcgtgcggctgcatgatgtgctgcacagcgacaagaagctgaccctggtgtttgagttctgtgaccaggacctgaagaagtactttgacagctgcaatggagacctggaccctgagatcgtgaagagcttcctgttccagctgctgaagggcctgggcttctgccacagcagaaatgtgctgcaccgggacctgaagccccagaacctgctgatcaacagaaatggagagctgaagctggccgactttggcctggcccgggccttcggcatccctgtgcgctgctacagcgctgaggtggtgaccctgtggtacagacctccagatgtgctgtttggagccaagctgtacagcaccagcattgacatgtggagcgctggctgcatctttgctgagctggccaatgccggccggcccctcttccctggaaatgatgtggatgaccagctgaagaggatcttccggctgctgggcacccccacagaggagcagtggcccagcatgaccaagctgcctgactacaagccctaccccatgtacccagccaccaccagcctggtgaatgtggtgcccaagctgaatgccaccggccgggacctgctgcagaacctgctgaagtgcaaccctgtgcagaggatctctgctgaggaggccctgcagcacccctacttcagtgacttctgccccccatag

SEQ ID NO: 148860 - DNA, 783 bp, Artificial Sequence
  Description of Artificial Sequence: Synthetic coding sequence
atgcagaagtatgagaagctggagaagatcggggagggcacctatggaacagtgttcaaggccaagaaccgggagacccatgaaattgtggccctgaagagggtgcggctggatgatgatgatgaaggagtgcccagcagcgccctgcgggagatctgcctgctgaaggagctgaagcacaagaacatcgtgcggctgcatgatgtgctgcacagcgacaagaagctgaccctggtgtttgagttctgtgaccaggacctgaagaagtactttgacagctgcaatggagacctggaccctgagatcgtgaagaatggagagctgaagctggccgactttggcctggcccgggccttcggcatccctgtgcgctgctacagcgctgaggtggtgaccctgtggtacagacctccagatgtgctgtttggagccaagctgtacagcaccagcattgacatgtggagcgctggctgcatctttgctgagctggccaatgccggccggcccctcttccctggaaatgatgtggatgaccagctgaagaggatcttccggctgctgggcacccccacagaggagcagtggcccagcatgaccaagctgcctgactacaagccctaccccatgtacccagccaccaccagcctggtgaatgtggtgcccaagctgaatgccaccggccgggacctgctgcagaacctgctgaagtgcaaccctgtgcagaggatctctgctgaggaggccctgcagcacccctacttcagtgacttctgccccccatag

SEQ ID NO: 148861 - DNA, 1104 bp, Artificial Sequence
  Description of Artificial Sequence: Synthetic coding sequence
atgggcaccgtgctgagcctgagccctgccagcagcgccaagggccggcggcctgggggcctgcctgaggagaagaagaaggcccctcctgctggagatgaggccctgggcggctatggagcccctcctgtgggcaagggcggcaaaggagagagccggctgaagaggcccagcgtgctgatcagcgccctgacctggaagaggctggtggccgccagcgccaagaagaagaagggcagcaagaaggtgacccccaagccagccagcacaggccctgaccccctggtgcagcagaggaaccgggagaacctgctgaggaagggccgggaccccccagatggcggcggcacagccaagcccctggccgtgcctgtgcccaccgtgcctgctgctgctgccacctgtgagcccccatctgggggcagcgctgctgcccagcccccaggcagcggcggcggcaagcccccacctcctcctcctccagccccccaggtggcccctcctgtgcctgggggcagccccaggagggtcatcgtgcaggccagcactggagagctgctgcgctgcctgggggactttgtgtgccgccgctgctaccgcctgaaggagctgagccctggagagctggtgggctggttccggggcgtggacaggagcctgctgctgcagggctggcaggaccaggccttcatcaccccagccaacctggtgtttgtgtacctgctgtgccgggagagcctgcggggagatgagctggccagcgctgctgagctgcaggccgccttcctgacctgcctgtacctggcctacagctacatgggaaatgagatctcctaccccctgaagcccttcctggtggagccagacaaggagcgcttctggcagcgctgcctgcggctcatccagaggctgagcccccagatgctgcggctgaatgctgacccccacttcttcacccaggtgttccaggacctgaagaatgaaggagaggccgccgccagcggcggcggcccccccagcggcggggccccagctgccagcagcgctgcccgggacagctgtgccgccggcaccaagcactggaccatgaacctggacagatag

SEQ ID NO: 148862 - DNA, 1779 bp, Artificial Sequence
  Description of Artificial Sequence: Synthetic coding sequence
atggagatgtatgagaccctgggcaaggtgggggagggcagctatggaacagtgatgaagtgcaagcacaagaacacaggccagatcgtggccatcaagatcttctatgaaagacctgagcagagcgtgaacaagatcgccatgagggagatcaagttcctgaagcagttccaccacgagaacctggtgaacctgattgaggtgttccggcagaagaagaagatccacctggtgtttgagttcatcgaccacacagtgctggatgagctgcagcactactgccacggcctggagagcaagaggctgaggaagtacctgttccagatcctgcgggccatcgactacctgcacagcaacaacatcatccaccgggacatcaagccagagaacatcctggtgtcccagagcggcatcaccaagctgtgtgactttggatttgcccggaccctggccgcccctggggacatctacacagattatgtggccacccgctggtaccgggcccctgagctggtgctgaaggacaccagctatggcaagcctgtggacatctgggccctgggctgcatgatcatcgagatggccaccggcaacccctacctgcccagcagcagtgacctggacctgctgcacaagatcgtgctgaaggtgggcaacctgagcccccacctgcagaacatcttcagcaagagccccatctttgctggggtggtgctgccccaggtgcagcaccccaagaatgccaggaagaagtaccccaagctgaatggcctgctggccgacatcgtgcacgcctgcctgcagattgatcctgctgaccgcatcagcagcagtgacctgctgcaccacgagtacttcaccagagatggcttcatcgagaagttcatgcctgagctgaaggccaagctgctgcaggaggccaaggtgaacagcctcatcaagcccaaggagagcagcaaagaaaatgagctgaggaaggatgagaggaagacagtgtacaccaacaccctgctgagcagctctgtgctgggcaaggagattgagaaggagaagaagcccaaggagatcaaggtgcgggtcatcaaggtgaagggcggccgcggggacatcagcgagcccaagaagaaggagtatgagggcggcctgggccagcaggatgccaatgaaaatgtgcaccccatgagcccagacaccaagctggtgaccatcgagccccccaaccccatcaaccccagcaccaactgcaatggcctgaaggagaacccccactgcggcggctctgtgaccatgccacccatcaacctgaccaacagcaacctgatggccgccaacctgagcagcaacctcttccaccccagcgtgcggctgacagagcgggccaagaagaggaggaccagcagccagagcatcggccaggtgatgcccaacagccggcaggaggaccccggccccatccagagccagatggagaagggcatcttcaatgaaagaacaggccacagcgaccagatggccaatgaaaacaagaggaagctgaacttcagcagaagtgacaggaaggagttccacttccctgagctgcctgtgaccatccagagcaaggacaccaagggcatggaggtgaagcagatcaagatgctgaagcgggagagcaagaagacagagagcagcaagatccccaccctgctgaatgtggaccagaaccaggagaagcaggagggcggagatggccactgtgagggcaagaacctgaagaggaaccgcttcttcttctggtag

SEQ ID NO: 148863 - DNA, 1368 bp, Artificial Sequence
  Description of Artificial Sequence: Synthetic coding sequence
atggagatgtatgagaccctgggcaaggtgggggagggcagctatggaacagtgatgaagtgcaagcacaagaacacaggccagatcgtggccatcaagatcttctatgaaagacctgagcagagcgtgaacaagatcgccatgagggagatcaagttcctgaagcagttccaccacgagaacctggtgaacctgattgaggtgttccggcagaagaagaagatccacctggtgtttgagttcatcgaccacacagtgctggatgagctgcagcactactgccacggcctggagagcaagaggctgaggaagtacctgttccagatcctgcgggccatcgactacctgcacagcaacaacatcatccaccgggacatcaagccagagaacatcctggtgtcccagagcggcatcaccaagctgtgtgactttggatttgcccggaccctggccgcccctggggacatctacacagattatgtggccacccgctggtaccgggcccctgagctggtgctgaaggacaccagctatggcaagcctgtggacatctgggccctgggctgcatgatcatcgagatggccaccggcaacccctacctgcccagcagcagtgacctggacctgctgcacaagatcgtgctgaaggtgggcaacctgagcccccacctgcagaacatcttcagcaagagccccatctttgctggggtggtgctgccccaggtgcagcaccccaagaatgccaggaagaagtaccccaagctgaatggcctgctggccgacatcgtgcacgcctgcctgcagattgatcctgctgaccgcatcagcagcagtgacctgctgcaccacgagtacttcaccagagatggcttcatcgagaagttcatgcctgagctgaaggccaagctgctgcaggaggccaaggtgaacagcctcatcaagcccaaggagagcagcaaagaaaatgagctgaggaaggatgagaggaagacagtgtacaccaacaccctgctgagcagctctgtgctgggcaaggagattgagaaggagaagaagcccaaggagatcaaggtgcgggtcatcaaggtgaagggcggccgcggggacatcagcgagcccaagaagaaggagtatgagggcggcctgggccagcaggatgccaatgaaaatgtgcaccccatgagcccagacaccaagctggtgaccatcgagccccccaaccccatcaaccccagcaccaactgcaatggcctgaaggagaacccccactgcggcggctctgtgaccatgccacccatcaacctgaccaacagcaacctgatggccgccaacctgagcagcaacctcttccaccccagcgtgaggtag

SEQ ID NO: 148864 - DNA, 1092 bp, Artificial Sequence
  Description of Artificial Sequence: Synthetic coding sequence
atgcctgagctgaaggccaagctgctgcaggaggccaaggtgaacagcctcatcaagcccaaggagagcagcaaagaaaatgagctgaggaaggatgagaggaagacagtgtacaccaacaccctgctgagcagctctgtgctgggcaaggagattgagaaggagaagaagcccaaggagatcaaggtgcgggtcatcaaggtgaagggcggccgcggggacatcagcgagcccaagaagaaggagtatgaaggaggcctgggccagcaggatgccaatgaaaatgtgcaccccatgagcccagacaccaagctggtgaccatcgagccccccaaccccatcaaccccagcaccaactgcaatggcctgaaggagaacccccactgcggcggctctgtgaccatgccacccatcaacctgaccaacagcaacctgatggccgccaacctgagcagcaacctcttccaccccagcgtgcggctgacagagcgggccaagaagaggaggaccagcagccagagcatcggccaggtgatgcccaacagccggcaggaggaccccggccccatccagagccagatggagaagggcatcttcaatgaaagaacaggccacagcgaccagatggccaatgaaaacaagaggaagctgaacttcagcagaagtgacaggaaggagttccacttccctgagctgcctgtgaccatccagagcaaggacaccaagggcatggaggtgaagcagatcaagatgctgaagcgggagagcaagaagacagagagcagcaagatccccaccctgctgaatgtggaccagaaccaggagaagcaggagttcatccccctgagcctgctgagcgcctgctgccccatcttcaccaacatctgcagccagctgaccatccgctacgtgttcatcagcggcatgaagacagaccagtacagcgagctggtgcctgtggagtggggcattgctgagaagatccccaagaatgtggaggccaccctggagctgggcaaccggcagagatttgagcagtttggagagctgcggcggcggcaggagaatgtgggcaagtttggcaccttctag

SEQ ID NO: 148865 - DNA, 1773 bp, Artificial Sequence
  Description of Artificial Sequence: Synthetic coding sequence
atggagatgtatgagaccctgggcaaggtgggggagggcagctatggaacagtgatgaagtgcaagcacaagaacacaggccagatcgtggccatcaagatcttctatgaaagacctgagcagagcgtgaacaagatcgccatgagggagatcaagttcctgaagcagttccaccacgagaacctggtgaacctgattgaggtgttccggcagaagaagaagatccacctggtgtttgagttcatcgaccacacagtgctggatgagctgcagcactactgccacggcctggagagcaagaggctgaggaagtacctgttccagatcctgcgggccatcgactacctgcacagcaacaacatcatccaccgggacatcaagccagagaacatcctggtgtcccagagcggcatcaccaagctgtgtgactttggatttgcccggaccctggccgcccctggggacatctacacagattatgtggccacccgctggtaccgggcccctgagctggtgctgaaggacaccagctatggcaagcctgtggacatctgggccctgggctgcatgatcatcgagatggccaccggcaacccctacctgcccagcagcagtgacctggacctgctgcacaagatcgtgctgaaggtgggcaacctgagcccccacctgcagaacatcttcagcaagagccccatctttgctggggtggtgctgccccaggtgcagcaccccaagaatgccaggaagaagtaccccaagctgaatggcctgctggccgacatcgtgcacgcctgcctgcagattgatcctgctgaccgcatcagcagcagtgacctgctgcaccacgagtacttcaccagagatggcttcatcgagaagttcatgcctgagctgaaggccaagctgctgcaggaggccaaggtgaacagcctcatcaagcccaaggagagcagcaaagaaaatgagctgaggaaggatgagaggaagacagtgtacaccaacaccctgctgagcagctctgtgctgggcaaggagattgagaaggagaagaagcccaaggagatcaaggtgcgggtcatcaaggtgaagggcggccgcggggacatcagcgagcccaagaagaaggagtatgagggcggcctgggccagcaggatgccaatgaaaatgtgcaccccatgagcccagacaccaagctggtgaccatcgagccccccaaccccatcaaccccagcaccaactgcaatggcctgaaggagaacccccactgcggcggctctgtgaccatgccacccatcaacctgaccaacagcaacctgatggccgccaacctgagcagcaacctcttccaccccagcgtgcggctgacagagcgggccaagaagaggaggaccagcagccagagcatcggccaggtgatgcccaacagccggcaggaggaccccggccccatccagagccagatggagaagggcatcttcaatgaaagaacaggccacagcgaccagatggccaatgaaaacaagaggaagctgaacttcagcagaagtgacaggaaggagttccacttccctgagctgcctgtgaccatccagagcaaggacaccaagggcatggaggtgaagcagatcaagatgctgaagcgggagagcaagaagacagagagcagcaagatccccaccctgctgaatgtggaccagaaccaggagaagcaggagaacacaggaaatgcccagacagagaggaagaagaacctgcctgatgtggagtag

SEQ ID NO: 148866 - DNA, 1368 bp, Artificial Sequence; identical to SEQ ID NO: 148863
  Description of Artificial Sequence: Synthetic coding sequence

SEQ ID NO: 148867 - DNA, 876 bp, Artificial Sequence
  Description of Artificial Sequence: Synthetic coding sequence
atgcctgagctgaaggccaagctgctgcaggaggccaaggtgaacagcctcatcaagcccaaggagagcagcaaagaaaatgagctgaggaaggatgagaggaagacagtgtacaccaacaccctgctgagcagctctgtgctgggcaaggagattgagaaggagaagaagcccaaggagatcaaggtgcgggtcatcaaggtgaagggcggccgcggggacatcagcgagcccaagaagaaggagtatgaaggaggcctgggccagcaggatgccaatgaaaatgtgcaccccatgagcccagacaccaagctggtgaccatcgagccccccaaccccatcaaccccagcaccaactgcaatggcctgaaggagaacccccactgcggcggctctgtgaccatgccacccatcaacctgaccaacagcaacctgatggccgccaacctgagcagcaacctcttccaccccagcgtgcggctgacagagcgggccaagaagaggaggaccagcagccagagcatcggccaggtgatgcccaacagccggcaggaggaccccggccccatccagagccagatggagaagggcatcttcaatgaaagaacaggccacagcgaccagatggccaatgaaaacaagaggaagctgaacttcagcagaagtgacaggaaggagttccacttccctgagctgcctgtgaccatccagagcaaggacaccaagggcatggaggtgaagcagatcaagatgctgaagcgggagagcaagaagacagagagcagcaagatccccaccctgctgaatgtggaccagaaccaggagaagcaggaggtgcggctgtaccagagacatgaggaccggcccatccagtag

SEQ ID NO: 148868 - DNA, 3093 bp, Artificial Sequence
  Description of Artificial Sequence: Synthetic coding sequence
atgaagatccccaacattggaaatgtgatgaacaagtttgagatcctgggcgtggtgggggagggcgcctacggcgtggtgctgaagtgccgccacaaggagacccatgagatcgtggccatcaagaagttcaaggacagtgaagaaaatgaggaggtgaaggagaccaccctgcgggagctgaagatgctgcggaccctgaagcaggagaacatcgtggagctgaaggaggccttcagaagaagaggcaagctgtacctggtgtttgaatatgtggagaagaacatgctggagctgctggaggagatgcccaatggagtgcccccagagaaggtgaagagctacatctaccagctgatcaaggccatccactggtgccacaagaatgacatcgtgcaccgggacatcaagccagagaacctgctgatcagccacaatgatgtgctgaagctgtgtgactttggatttgccaggaacctgtctgagggcaacaatgccaactacacagaatatgtggccacccgctggtaccgcagccctgagctgctgctgggcgccccctacggcaagtctgtggacatgtggagcgtgggctgcatcctgggggagctgagtgatggccagcccctcttccctggagagagcgagattgaccagctgttcaccatccagaaggtgctgggccccctgcccagcgagcagatgaagctgttctacagcaacccccgcttccacggcctgcgcttccctgctgtgaaccacccccagagcctggagcggcgctacctgggcatcctgaacagcgtgctgctggacctgatgaagaacctgctgaagctggaccctgctgaccgctacctgacagagcagtgcctgaaccaccccaccttccagacccagaggctgctggacaggagccccagccgcagcgccaagaggaagccctaccacgtggagagcagcaccctgagcaacagaaaccaggccggcaagagcacagccctgcagagccaccacaggagcaacagcaaggacatccagaacctgtctgtgggcctgcccagggcagatgagggcctgcctgccaatgaaagcttcctgaatggaaacctggccggggccagcctgagccccctgcacaccaagacctaccaggccagcagccagcccggcagcaccagcaaggacctgaccaacaacaacatcccccacctgctgagccccaaggaggccaagagcaagacagaatttgacttcaacatcgaccccaagcccagcgagggccctggcaccaagtacctgaagagcaacagccgcagccagcagaacagacacagcttcatggagagcagccagagcaaggccggcaccctgcagcccaatgagaagcagagccgccacagctacatcgacaccatcccccagagcagccgcagccccagctaccgcaccaaggccaagagccatggagccctgagtgacagcaagtctgtgagcaacctgtctgaggcccgggcccagattgctgagcccagcaccagccgctacttccccagcagctgcctggacctgaacagccccaccagccccacccccaccaggcacagcgacaccaggaccctgctgagccccagcggcaggaacaacagaaatgaaggcaccctggacagcaggaggaccaccaccaggcacagcaagaccatggaggagctgaagctgcctgagcacatggacagcagccacagccacagcctgagcgcccctcatgagagcttctcctatggcctgggctacaccagccccttcagcagccagcagaggccccaccgccacagcatgtatgtgacccgggacaaggtgcgggccaagggcctggatggcagcctgagcatcggccagggcatggccgcccgggccaacagcctgcagctgctgagcccccagcctggagagcagctgcccccagagatgacagtggcccggagctctgtgaaggagaccagccgggagggcaccagcagcttccacacccggcagaagtctgagggcggcgtgtaccatgacccccacagtgatgatggaacagcccccaaggaaaatagacacctgtacaatgaccctgtgccccggcgggtgggcagcttctacagagtgcccagccccaggccagacaacagcttccatgaaaataatgtgtccaccagggtgagcagcctgcccagcgagagcagcagcggcaccaaccacagcaagaggcagcctgcctttgacccctggaagagccctgagaacatcagccacagcgagcagctgaaggagaaggagaagcagggcttcttccgctccatgaagaagaagaagaagaagagccagacagtgcccaacagcgacagcccagacctgctgaccctgcagaagagcatccacagcgccagcacccccagcagccggcccaaggagtggaggcctgagaagatcagtgacctgcagacccagagccagcccctgaagagcctgaggaagctgctgcacctgagcagcgccagcaaccacccagccagcagtgacccccgcttccagcccctgacagcccagcagaccaagaacagcttcagcgagatccgcatccaccccctgagccaggccagcggcggcagcagcaacatccggcaggagcccgcccccaagggccgcccagccctgcagctgcctgatggcggctgtgatggaagacggcagaggcaccacagcggcccccaggaccggcgcttcatgctgcggaccacagagcagcagggcgagtacttctgctgcggggaccccaagaagccccacaccccctgtgtgcccaacagagccctgcaccggcccatcagcagccctgccccctaccctgtgctgcaggtgcggggcacctccatgtgccccaccctgcaggtgcggggcacagatgccttcagctgccccacccagcagagcggcttctccttctttgtgagacatgtgatgagggaggccctgatccaccgggcccaggtgaaccaggccgccctgctgacctaccatgaaaatgctgccctgaccgggaagtag

SEQ ID NO: 148869 - DNA, 3093 bp, Artificial Sequence; identical to SEQ ID NO: 148868
  Description of Artificial Sequence: Synthetic coding sequence

SEQ ID NO: 148870 - DNA, 1956 bp, Artificial Sequence
  Description of Artificial Sequence: Synthetic coding sequence
atgagcctgccccggctgctgaaggtgaacatccgcacctatgacaacagcatccccatcagcgagagcagcaggaagtcctggaaccagaagcactttgccctgaccttccccaagcccctgcagaggggcaccaatgacaagagccggcccctgaagagccagatcaccgtgaccaggcatgacaagaggaagctggaggagggccagaagccagcccacaagtggatccgccacagcttcaggaagatcctgcagtggccacccatctacacagctgcccgggagcagacccccttccgccacctgtacaccagcaagacccacctgaagaaggccgagtacaagaagagcaaggatgagaagggcggcacccccctgaagaaggacagcaagaagaagggcggcagctatgccaccaaccctgagagcaagcagatcgtggaggagaagaccaagaggcagaatgaggccgacaagacccccctgaagagcagccatgaaaatgagcagagcaagaagagcaagagcagcagcgagaccaaccctgagagccagaacagcaagacagtgtccaagaactgcagccagaaggacaagaaggacagcaagaacagcaagaagaccaacacagagttcctgcacaccaagaacaaccccaagaaggacctgaagaggagcaagaccagcaatgaccccatcagcgagatctgcagcgagaacagcctgaatgtggacttcctgatgctggtgggccagagtgatgatgagagcatcaactttgatgcctggctgaggaactacagccagaacaacagcaagaactacagcctgaagtacaccaagtacaccaagaaggacaccaagaagaatgccaagaagagcagtgatgctgagagcgaggacagcaaggatgccaagaaggacagcaagaaggtgaagaagaatgtgaagaaggatgacaagaagaaggatgtgaagaaggacacagagagcacagatgctgagagcggggacagcaaggatgagaggaaggacaccaagaaggacaagaagaagctgaagaaggatgacaagaagaaggacaccaagaagtacccagagagcacagacacagagagcggagatgccaaggatgccagaaatgacagcaggaacctgaagaaggccagcaagaatgatgacaagaagaaggatgccaagaagatcaccttcagcacagattctgagagcgagctggagagcaaggagagccagaaggatgagaagaaggacaagaaggacagcaagacagacaacaagaagtctgtgaagaatgatgaggagagcacagatgctgacagcgagcccaagggggacagcaagaagggcaagaaggatgagaagaagggcaagaaggacagcaagaaggatgacaagaagaaggatgccaagaagaatgctgagagcacagagatggagagtgacctggagctgaagaaggacaagaagcacagcaaggagaagaagggcagcaagaaggacatcaagaaggatgccaggaaggacacagagagcacagatgctgagtttgatgagagcagcaagacaggcttcaagaccagcaccaagatcaagggcagtgacacagaaagtgaggagagcctgtacaagccaggggccaagaagaagattgatgaaagtgatggcaccagcgccaacagcaagatggagggcctggagagcaagaggggcttcaggatgagcagcaagaagaccaccttcaatgaaaaaggagagaaggccagcacaggccgggtgccccccagccgggagaagccacccctgcctgcctgtgagcccagcctgcccagccccaaggtgcggcggctgtgctggtgcaagatgcctcctcctccacccaagcccaggtatgcccccctgcctgaggccccctggatccacaagctgctgtag

SEQ ID NO: 148871 - DNA, 1974 bp, Artificial Sequence
  Description of Artificial Sequence: Synthetic coding sequence
atgagcctgccccggctgctgaaggtgaacatccgcacctatgacaacagcatccccatcagcgagagcagcaggaagtcctggaaccagaagcactttgccctgaccttccccaagcccctgcagaggggcaccaatgacaagagccggcccctgaagagccagatcaccgtgaccaggcatgacaagaggaagctggaggagggccagaagccagcccacaagtggatccgccacagcttcaggaagatcctgcagtggccacccatctacacagctgcccgggagcagacccccttccgccacctgtacaccagcaagacccacctgaagaaggccgagtacaagaagagcaaggatgagaagggcggcacccccctgaagaaggacagcaagaagaagggcggcagctatgccaccaaccctgagagcaagcagatcgtggaggagaagaccaagaggcagaatgaggccgacaagacccccctgaagagcagccatgaaaatgagcagagcaagaagagcaagagcagcagcgagaccaaccctgagagccagaacagcaagacagtgtccaagaactgcagccagaaggacaagaaggacagcaagaacagcaagaagaccaacacagagttcctgcacaccaagaacaaccccaagaaggacctgaagaggagcaagaccagcaatgaccccatcagcgagatctgcagcgagaacagcctgaatgtggacttcctgatgctggtgggccagagtgatgatgagagcatcaactttgatgcctggctgaggaactacagccagaacaacagcaagaactacagcctgaagtacaccaagtacaccaagaaggacaccaagaagaatgccaagaagagcagtgatgctgagagcgaggacagcaaggatgccaagaaggacagcaagaaggtgaagaagaatgtgaagaaggatgacaagaagaaggatgtgaagaaggacacagagagcacagatgctgagagcggggacagcaaggatgagaggaaggacaccaagaaggacaagaagaagctgaagaaggatgacaagaagaaggacaccaagaagtacccagagagcacagacacagagagcggagatgccaaggatgccagaaatgacagcaggaacctgaagaaggccagcaagaatgatgacaagaagaaggatgccaagaagatcaccttcagcacagattctgagagcgagctggagagcaaggagagccagaaggatgagaagaaggacaagaaggacagcaagacagacaacaagaagtctgtgaagaatgatgaggagagcacagatgctgacagcgagcccaagggggacagcaagaagggcaagaaggatgagaagaagggcaagaaggacagcaagaaggatgacaagaagaaggatgccaagaagaatgctgagagcacagagatggagagtgacctggagctgaagaaggacaagaagcacagcaaggagaagaagggcagcaagaaggacatcaagaaggatgccaggaaggacacagagagcacagatgctgagtttgatgagagcagcaagacaggcttcaagaccagcaccaagatcaagggcagtgacacagaaagtgaggagagcctgtacaagccaggggccaagaagaagattgatgaaagtgatggcaccagcgccaacagcaagatggagggcctggagagcaagaggggcttcaggatgagcagcaagaagaccaccttcaatgaaaaaggagagaaggccagcacaggccgggtgccccccagccgggagaagccacccctgcctgcctgtgagcccagcctgcccagccccaaggtgcggcggctgtgctggtgcaagatgcctcctcctccacccaagcccaggtatgcccccctcatccagaggcggcagaggctgggcgtgcggcgctgccagctgctgatgtag

SEQ ID NO: 148872 - DNA, 1086 bp, Artificial Sequence
  Description of Artificial Sequence: Synthetic coding sequence
atgcaggagaaggatgccagcagccagggcttcctgccccacttccagcactttgccacccaggccatccacgtgggccaggaccctgagcagtggaccagcagagctgtggtgccccccatcagcctgagcaccaccttcaagcagggcgcccctggccagcacagcggctttgagtacagccgcagcggcaaccccaccaggaactgcctggagaaggctgtggccgccctggatggagccaagtactgcctggcctttgccagcggcctggccgccaccgtgaccatcacccacctgctgaaggccggggaccagatcatctgcatggatgatgtgtatggaggcaccaaccgctacttccggcaggtggccagcgagtttggcctgaagatcagctttgtggactgcagcaagatcaagctgctggaggccgccatcaccccagagaccaagaggcccctggccctgggcgctgacatctccatgtacagcgccaccaagtacatgaatggccacagtgatgtggtgatgggcctggtgtctgtgaactgtgagagcctgcacaaccggctgcgcttcctgcagaacagcctgggcgctgtgcccagccccatcgactgctacctgtgcaacagaggcctgaagaccctgcacgtgaggatggagaagcacttcaagaatggcatggctgtggcccagttcctggagagcaacccctgggtggagaaggtgatctacccaggcctgcccagccacccccagcacgagctggtgaagaggcagtgcaccggctgcaccggcatggtgaccttctacatcaagggcaccctgcagcacgccgagatcttcctgaagaacctgaagctgttcaccctggccgagagcctgggcggctttgagagcctggccgagctgcctgccatcatgacccacgcctctgtgctgaagaatgacagagatgtgctgggcatcagtgacaccctcatccggctgtctgtgggcctggaggatgaggaggacctgctggaggacctggaccaggccctgaaggccgcccaccccccatctggcagccacagctag

SEQ ID NO: 148873 - DNA, 1218 bp, Artificial Sequence
  Description of Artificial Sequence: Synthetic coding sequence
atgcaggagaaggatgccagcagccagggcttcctgccccacttccagcactttgccacccaggccatccacgtgggccaggaccctgagcagtggaccagcagagctgtggtgccccccatcagcctgagcaccaccttcaagcagggcgcccctggccagcacagcggctttgagtacagccgcagcggcaaccccaccaggaactgcctggagaaggctgtggccgccctggatggagccaagtactgcctggcctttgccagcggcctggccgccaccgtgaccatcacccacctgctgaaggccggggaccagatcatctgcatggatgatgtgtatggaggcaccaaccgctacttccggcaggtggccagcgagtttggcctgaagatcagctttgtggactgcagcaagatcaagctgctggaggccgccatcaccccagagaccaagctggtgtggattgagacccccaccaaccccacccagaaggtgattgatattgagggctgtgcccacatcgtgcacaagcatggagacatcatcctggtggtggacaacaccttcatgagcccctacttccagaggcccctggccctgggcgctgacatctccatgtacagcgccaccaagtacatgaatggccacagtgatgtggtgatgggcctggtgtctgtgaactgtgagagcctgcacaaccggctgcgcttcctgcagaacagcctgggcgctgtgcccagccccatcgactgctacctgtgcaacagaggcctgaagaccctgcacgtgaggatggagaagcacttcaagaatggcatggctgtggcccagttcctggagagcaacccctgggtggagaaggtgatctacccaggcctgcccagccacccccagcacgagctggtgaagaggcagtgcaccggctgcaccggcatggtgaccttctacatcaagggcaccctgcagcacgccgagatcttcctgaagaacctgaagctgttcaccctggccgagagcctgggcggctttgagagcctggccgagctgcctgccatcatgacccacgcctctgtgctgaagaatgacagagatgtgctgggcatcagtgacaccctcatccggctgtctgtgggcctggaggatgaggaggacctgctggaggacctggaccaggccctgaaggccgcccaccccccatctggcagccacagctag

SEQ ID NO: 148874 - DNA, 1122 bp, Artificial Sequence
  Description of Artificial Sequence: Synthetic coding sequence
atgcaggagaaggatgccagcagccagggcttcctgccccacttccagcactttgccacccaggccatccacgtgggccaggaccctgagcagtggaccagcagagctgtggtgccccccatcagcctgagcaccaccttcaagcagggcgcccctggccagcacagcggctttgagtacagccgcagcggcaaccccaccaggaactgcctggagaaggctgtggccgccctggatggagccaagtactgcaccaaccgctacttccggcaggtggccagcgagtttggcctgaagatcagctttgtggactgcagcaagatcaagctgctggaggccgccatcaccccagagaccaagctggtgtggattgagacccccaccaaccccacccagaaggtgattgatattgagggctgtgcccacatcgtgcacaagcatggagacatcatcctggtggtggacaacaccttcatgagcccctacttccagaggcccctggccctgggcgctgacatctccatgtacagcgccaccaagtacatgaatggccacagtgatgtggtgatgggcctggtgtctgtgaactgtgagagcctgcacaaccggctgcgcttcctgcagaacagcctgggcgctgtgcccagccccatcgactgctacctgtgcaacagaggcctgaagaccctgcacgtgaggatggagaagcacttcaagaatggcatggctgtggcccagttcctggagagcaacccctgggtggagaaggtgatctacccaggcctgcccagccacccccagcacgagctggtgaagaggcagtgcaccggctgcaccggcatggtgaccttctacatcaagggcaccctgcagcacgccgagatcttcctgaagaacctgaagctgttcaccctggccgagagcctgggcggctttgagagcctggccgagctgcctgccatcatgacccacgcctctgtgctgaagaatgacagagatgtgctgggcatcagtgacaccctcatccggctgtctgtgggcctggaggatgaggaggacctgctggaggacctggaccaggccctgaaggccgcccaccccccatctggcagccacagctag

SEQ ID NO: 148875 - DNA, 1656 bp, Artificial Sequence
  Description of Artificial Sequence: Synthetic coding sequence
atgcccagcgagaccccccaggccgaggtgggccccaccggctgcccccacaggagcggcccccacagcgccaagggcagcctggagaagggcagccctgaggacaaggaggccaaggagcccctgtggatccggccagatgcccccagccgctgcacctggcagctgggccgcccagccagcgagagcccccaccaccacacagccccagccaagagccccaagatcctgcctgacatcctgaagaagatcggggacacccccatggtgcgcatcaacaagattggcaagaagtttggcctgaagtgtgagctgctggccaagtgtgagttcttcaatgctgggggctctgtgaaggaccgcatcagcctgaggatgattgaagatgctgagagagatggcaccctgaagccaggggacaccatcatcgagcccaccagcggcaacacaggcatcggcctggccctggccgctgctgtgcggggctaccgctgcatcatcgtgatgcctgagaagatgagcagcgagaaggtggatgtgctgcgggccctgggcgctgagatcgtgaggacccccaccaatgccaggtttgacagccctgagagccacgtgggcgtggcctggaggctgaagaatgagatccccaacagccacatcctggaccagtacagaaatgccagcaaccccctggcccactatgacaccacagcagatgagatcctgcagcagtgtgatggcaagctggacatgctggtggcctctgtgggcactggaggcaccatcaccggcatcgccaggaagctgaaggagaagtgccccggctgccgcatcatcggcgtggaccctgagggcagcatcctggccgagcctgaggagctgaaccagacagagcagaccacctatgaggtggagggcatcggctatgacttcatccccaccgtgctggacagaacagtggtggacaagtggttcaagagcaatgatgaggaggccttcacctttgccaggatgctgattgcccaggagggcctgctgtgtggcggcagcgctggcagcacagtggccgtggccgtgaaggccgcccaggagctgcaggagggccagagatgtgtggtgatcctgcctgattctgtgaggaactacatgaccaagttcctgagtgaccgctggatgctgcagaagggcttcctgaaggaggaggacctgacagagaagaagccctggtggtggcacctgcgggtgcaggagctgggcctgagcgcccccctgactgtgctgcccaccatcacctgtggccacaccatcgagatcctgcgggagaagggctttgaccaggcccctgtggtggatgaggccggggtcatcctgggcatggtgaccctgggcaacatgctgagcagcctgctggccggcaaggtgcagcccagcgaccaggtgggcaaggtgatctacaagcagttcaagcagatccggctgacagacaccctgggccgcctgagccacatcctggagatggaccactttgccctggtggtgcatgagcagatccagtaccacagcacaggcaagagcagccagaggcagatggtgtttggagtggtgacagccatcgacctgctgaactttgtggccgcccaggagcgggaccagaagtag

SEQ ID NO: 148876 - DNA, 1656 bp, Artificial Sequence; identical to SEQ ID NO: 148875
  Description of Artificial Sequence: Synthetic coding sequence

SEQ ID NO: 148877 - DNA, 1656 bp, Artificial Sequence; identical to SEQ ID NO: 148875
  Description of Artificial Sequence: Synthetic coding sequence

SEQ ID NO: 148878 - DNA, 1656 bp, Artificial Sequence; identical to SEQ ID NO: 148875
  Description of Artificial Sequence: Synthetic coding sequence

SEQ ID NO: 148879 - DNA, 1698 bp, Artificial Sequence
  Description of Artificial Sequence: Synthetic coding sequence
atgcccagcgagaccccccaggccgaggtgggccccaccggctgcccccacaggagcggcccccacagcgccaagggcagcctggagaagggcagccctgaggacaaggaggccaaggagcccctgtggatccggccagatgcccccagccgctgcacctggcagctgggccgcccagccagcgagagcccccaccaccacacagccccagccaagagccccaagatcctgcctgacatcctgaagaagatcggggacacccccatggtgcgcatcaacaagattggcaagaagtttggcctgaagtgtgagctgctggccaagtgtgagttcttcaatgctgggggctctgtgaaggaccgcatcagcctgaggatgattgaagatgctgagagagatggcaccctgaagccaggggacaccatcatcgagcccaccagcggcaacacaggcatcggcctggccctggccgctgctgtgcggggctaccgctgcatcatcgtgatgcctgagaagatgagcagcgagaaggtggatgtgctgcgggccctgggcgctgagatcgtgaggacccccaccaatgccaggtttgacagccctgagagccacgtgggcgtggcctggaggctgaagaatgagatccccaacagccacatcctggaccagtacagaaatgccagcaaccccctggcccactatgacaccacagcagatgagatcctgcagcagtgtgatggcaagctggacatgctggtggcctctgtgggcactggaggcaccatcaccggcatcgccaggaagctgaaggagaagtgccccggctgccgcatcatcggcgtggaccctgagggcagcatcctggccgagcctgaggagctgaaccagacagagcagaccacctatgaggtggagggcatcggctatgacttcatccccaccgtgctggacagaacagtggtggacaagtggttcaagagcaatgatgaggaggccttcacctttgccaggatgctgattgcccaggagggcctgctgtgtggcggcagcgctggcagcacagtggccgtggccgtgaaggccgcccaggagctgcaggagggccagagatgtgtggtgatcctgcctgattctgtgaggaactacatgaccaagttcctgagtgaccgctggatgctgcagaagggcttcctgaaggaggaggacctgacagagaagaagccctggtggtggcacctgcgggtgcaggagctgggcctgagcgcccccctgactgtgctgcccaccatcacctgtggccacaccatcgagatcctgcgggagaagggctttgaccaggcccctgtggtggatgaggccggggtcatcctgggcatggtgaccctgggcaacatgctgagcagcctgctggccggcaaggtgcagcccagcgaccaggtgggcaaggtgatctacaagcagttcaagcagatccggctgacagacaccctgggccgcctgagccacatcctggagatggaccactttgccctggtggtgcatgagcagatccagagccaggaccaggcctgggccggcgtggtgggcggccctgctgaccacagcacaggcaagagcagccagaggcagatggtgtttggagtggtgacagccatcgacctgctgaactttgtggccgcccaggagcgggaccagaagtag

SEQ ID NO: 148880 - DNA, 534 bp, Artificial Sequence
  Description of Artificial Sequence: Synthetic coding sequence
atgcccagcgagaccccccaggccgaggtgggccccaccggctgcccccacaggagcggcccccacagcgccaagggcagcctggagaagggcagccctgaggacaaggaggccaaggagcccctgtggatccggccagatgcccccagccgctgcacctggcagctgggccgcccagccagcgagagcccccaccaccacacagccccagccaagagccccaagatcctgcctgacatcctgaagaagatcggggacacccccatggtgcgcatcaacaagattggcaagaagtttggcctgaagtgtgagctgctggccaagtgtgagttcttcaatgctgggggctctgtgaaggaccgcatcagcctgaggatgattgaagatgctgagagagatggcaccctgaagccaggggacaccatcatcgagcccaccagcggcaacacaggcatcggcctggccctggccgctgctgtgcggggctaccgctgcatcatcgtgatgcctgagaagatgagcagcgagaagtag

SEQ ID NO: 148881 - DNA, 1527 bp, Artificial Sequence
  Description of Artificial Sequence: Synthetic coding sequence
atgcccagcgagaccccccaggccgaggtgggccccaccggctgcccccacaggagcggcccccaccaccacacagccccagccaagagccccaagatcctgcctgacatcctgaagaagattggagacacccccatggtgcgcatcaacaagattggcaagaagtttggcctgaagtgtgagctgctggccaagtgtgagttcttcaatgccggcggctctgtgaaggaccgcatcagcctgaggatgattgaagatgctgagagagatggcaccctgaagccaggggacaccatcatcgagcccaccagcggcaacacaggaattggcctggccctggccgctgctgtgcggggctaccgctgcatcatcgtgatgcctgagaagatgagcagcgagaaggtggatgtgctgcgggccctgggcgctgagatcgtgaggacccccaccaatgccaggtttgacagccctgagagccacgtgggcgtggcctggaggctgaagaatgagatccccaacagccacatcctggaccagtacagaaatgccagcaaccccctggcccactatgacaccacagcagatgagatcctgcagcagtgtgatggcaagctggacatgctggtggcctctgtgggcaccggcggcaccatcactggaattgccaggaagctgaaggagaagtgccccggctgccgcatcattggagtggaccctgagggcagcatcctggccgagcctgaggagctgaaccagacagagcagaccacctatgaggtggagggcatcggctatgacttcatccccaccgtgctggacagaacagtggtggacaagtggttcaagagcaatgatgaggaggccttcacctttgccaggatgctgattgcccaggagggcctgctgtgtggcggcagcgctggcagcacagtggccgtggccgtgaaggccgcccaggagctgcaggagggccagagatgtgtggtgatcctgcctgacagcgtgaggaactacatgaccaagttcctgagtgaccgctggatgctgcagaagggcttcctgaaggaggaggacctgacagagaagaagccctggtggtggcacctgcgggtgcaggagctgggcctgagcgcccccctgactgtgctgcccaccatcacctgtggccacaccatcgagatcctgcgggagaagggctttgaccaggcccctgtggtggatgaagctggggtcatcctgggcatggtgaccctgggcaacatgctgagcagcctgctggccggcaaggtgcagcccagcgaccaggtgggcaaggtgatctacaagcagttcaagcagatccggctgacagacaccctgggccgcctgagccacatcctggagatggaccactttgccctggtggtgcatgagcagatccagtaccacagcacaggcaagagcagccagaggcagatggtgtttggagtggtgacagccatcgacctgctgaactttgtggccgcccaggagcgggaccagaagtag

SEQ ID NO: 148882 - DNA, 1392 bp, Artificial Sequence
  Description of Artificial Sequence: Synthetic coding sequence
atggtgcgcatcaacaagattggcaagaagtttggcctgaagtgtgagctgctggccaagtgtgagttcttcaatgctgggggctctgtgaaggaccgcatcagcctgaggatgattgaagatgctgagagagatggcaccctgaagccaggggacaccatcatcgagcccaccagcggcaacacaggcatcggcctggccctggccgctgctgtgcggggctaccgctgcatcatcgtgatgcctgagaagatgagcagcgagaaggtggatgtgctgcgggccctgggcgctgagatcgtgaggacccccaccaatgccaggtttgacagccctgagagccacgtgggcgtggcctggaggctgaagaatgagatccccaacagccacatcctggaccagtacagaaatgccagcaaccccctggcccactatgacaccacagcagatgagatcctgcagcagtgtgatggcaagctggacatgctggtggcctctgtgggcactggaggcaccatcaccggcatcgccaggaagctgaaggagaagtgccccggctgccgcatcatcggcgtggaccctgagggcagcatcctggccgagcctgaggagctgaaccagacagagcagaccacctatgaggtggagggcatcggctatgacttcatccccaccgtgctggacagaacagtggtggacaagtggttcaagagcaatgatgaggaggccttcacctttgccaggatgctgattgcccaggagggcctgctgtgtggcggcagcgctggcagcacagtggccgtggccgtgaaggccgcccaggagctgcaggagggccagagatgtgtggtgatcctgcctgattctgtgaggaactacatgaccaagttcctgagtgaccgctggatgctgcagaagggcttcctgaaggaggaggacctgacagagaagaagccctggtggtggcacctgcgggtgcaggagctgggcctgagcgcccccctgactgtgctgcccaccatcacctgtggccacaccatcgagatcctgcgggagaagggctttgaccaggcccctgtggtggatgaggccggggtcatcctgggcatggtgaccctgggcaacatgctgagcagcctgctggccggcaaggtgcagcccagcgaccaggtgggcaaggtgatctacaagcagttcaagcagatccggctgacagacaccctgggccgcctgagccacatcctggagatggaccactttgccctggtggtgcatgagcagatccagtaccacagcacaggcaagagcagccagaggcagatggtgtttggagtggtgacagccatcgacctgctgaactttgtggccgcccaggagcgggaccagaagtag

SEQ ID NO: 148883 - DNA, 312 bp, Artificial Sequence
  Description of Artificial Sequence: Synthetic coding sequence
atgatggccgagccctggcaggccctgcagctgctgctggccatcctgctgaccctgatggccctgccctaccaggccaggaagaagaccttcctgtctgtgcatgaggtgatggctgtggagaactatgccaaggacagcctgcagtggatcacagaccagtacaacaaggagagtgatgacaagtaccacttccgcatcttccgggtgctgaaggtgcagaggcagcaggtgaactgcttcttctctgtgtttgctgtgccctggtttgagcagtacaagatcctgaacaagagctgcagcagtgactag

SEQ ID NO: 148884 - DNA, 417 bp, Artificial Sequence
  Description of Artificial Sequence: Synthetic coding sequence
atgatggccgagccctggcaggccctgcagctgctgctggccatcctgctgaccctgatggccctgccctaccaggccaggaagaagaccttcctgtctgtgcatgaggtgatggctgtggagaactatgccaaggacagcctgcagtggatcacagaccagtacaacaaggagagtgatgacaagtaccacttccgcatcttccgggtgctgaaggtgcagaggcaggtgacagaccacctggagtaccacctgaatgtggagatgcagtggaccacctgccagaagccagagaccaccaactgtgtgccccaggagcgggagctgcacaagcaggtgaactgcttcttctctgtgtttgctgtgccctggtttgagcagtacaagatcctgaacaagagctgcagcagtgactag

SEQ ID NO: 148885 - DNA, 297 bp, Artificial Sequence
  Description of Artificial Sequence: Synthetic coding sequence
atgatccctgggggcctgtctgaggccaagccagccaccccagagatccaggagatcgtggacaaggtgaagccccagctggaggagaagaccaatgagacctacggcaagctggaggccgtgcagtacaagacccaggtggtggccggcaccaactactacatcaaggtgcgggccggggacaacaagtacatgcacctgaaggtgttcaagagcctgcccggccagaatgaagacctggtgctgaccggctaccaggtggacaagaacaaggatgatgagctgaccggcttctag

SEQ ID NO: 148886 - DNA, 297 bp, Artificial Sequence
  Description of Artificial Sequence: Synthetic coding sequence
atgatgtgtggggcccccagcgccacccagcctgccacagctgagacccagcacatcgctgaccaggtgcgcagccagctggaggagaaggagaacaagaagtttcctgtgttcaaggctgtgtccttcaagagccaggtggtggccggcaccaactacttcatcaaggtgcacgtgggagatgaggactttgtgcacctgcgggtcttccagagcctgccccatgagaacaagcccctgaccctgagcaactaccagaccaacaaggccaagcatgatgagctgacctacttctag

SEQ ID NO: 148887 - DNA, 441 bp, Artificial Sequence
  Description of Artificial Sequence: Synthetic coding sequence
atggccggccccctgcgggcccccctgctgctgctggccatcctggccgtggccctggccgtgtccccagctgctggcagcagccctgggaagccaccccggctggtgggcggccccatggatgcctctgtggaggaggagggcgtgcggcgggccctggactttgctgtgggggagtacaacaaggccagcaatgacatgtaccacagccgggccctgcaggtggtgcgggccaggaagcagatcgtggccggcgtgaactacttcctggatgtggagctgggccgcaccacctgcaccaagacccagcccaacctggacaactgccccttccatgaccagccccacctgaagaggaaggccttctgcagcttccagatctatgctgtgccctggcagggcaccatgaccctgagcaagagcacctgccaggatgcctag

SEQ ID NO: 148888 - DNA, 441 bp, Artificial Sequence; identical to SEQ ID NO: 148887
  Description of Artificial Sequence: Synthetic coding sequence

SEQ ID NO: 148889 - DNA, 441 bp, Artificial Sequence; identical to SEQ ID NO: 148887
  Description of Artificial Sequence: Synthetic coding sequence

SEQ ID NO: 148890 - DNA, 429 bp, Artificial Sequence
  Description of Artificial Sequence: Synthetic coding sequence
atgatgtggcccatgcacacccccctgctgctgctgacagccctgatggtggccgtggccggcagcgccagcgcccagagcaggaccctggccggcggcatccacgccacagacctgaatgacaagtctgtgcagtgtgccctggactttgccatcagcgagtacaacaaggtgatcaacaaggatgagtactacagccggcccctgcaggtgatggccgcctaccagcagatcgtgggcggcgtgaactactacttcaacgtgaagtttggccgcaccacctgcaccaagagccagcccaacctggacaactgccccttcaatgaccagcccaagctgaaggaggaggagttctgcagcttccagatcaatgaggtgccctgggaggacaagatcagcatcctgaactacaagtgcaggaaggtgtag

SEQ ID NO: 148891 - DNA, 1578 bp, Artificial Sequence
  Description of Artificial Sequence: Synthetic coding sequence
atggccaccctgctgcggagcaagctgagcaatgtggccacctctgtgagcaacaagagccaggccaagatgagcggcatgtttgccaggatgggcttccaggccgccacagatgaggaggccgtgggctttgcccactgtgatgacctggactttgagcaccggcagggcctgcagatggacatcctgaaggccgagggggagccctgtggagatgagggcgctgaggcccctgtggagggggacatccactaccagaggggcagcggggcccccctgccccccagcggcagcaaggaccaggtgggcggcggcggggagtttggaggccatgacaagcccaagatcacagcctgggaggccggctggaatgtgaccaatgccatccagggcatgtttgtgctgggcctgccctatgccatcctgcatggaggctacctgggcctcttcctgatcatctttgctgctgtggtgtgctgctacaccgggaagatcctgattgcctgcctgtatgaagaaaatgaagatggagaggtggtgcgggtgcgggacagctatgtggccatcgccaatgcctgctgtgccccccgcttccccaccctgggcggccgggtggtgaatgtggcccagatcatcgagctggtgatgacctgcatcctgtatgtggtggtgtctggcaacctgatgtacaacagcttccctggcctgcctgtgtcccagaagtcctggagcatcatcgccacagctgtgctgctgccctgtgccttcctgaagaacctgaaggctgtgtccaagttcagcctgctgtgcaccctggcccactttgtgatcaacatcctggtgattgcctactgcctgagccgggcccgggactgggcctgggagaaggtgaagttctacattgatgtgaagaagttccccatcagcatcggcatcatcgtgttctcctacaccagccagatcttcctgcccagcctggagggcaacatgcagcagcccagcgagttccactgcatgatgaactggacccacatcgccgcctgtgtgctgaagggcctgtttgccctggtggcctacctgacctgggcagatgagaccaaggaggtgatcacagacaacctgcccggcagcatccgggctgtggtgaacatcttcctggtggccaaggccctgctgagctaccccctgcccttctttgctgctgtggaggtgctggagaagagcctcttccaggagggcagccgggccttcttccctgcctgctacagcggagatggccgcctgaagtcctggggcctgaccctgcgctgtgccctggtggtgttcaccctgctgatggccatctacgtgccccactttgccctgctgatgggcctgaccggcagcctgaccggggccggcctgtgcttcctgctgcccagcctcttccacctgcggctgctgtggaggaagctgctgtggcaccaggtgttctttgatgtggccatctttgtgattggaggcatctgcagcgtgtctggctttgtgcacagcctggagggcctcatcgaggcctaccgcaccaatgctgaggactag

SEQ ID NO: 148892 - DNA, 426 bp, Artificial Sequence
  Description of Artificial Sequence: Synthetic coding sequence
atggcctggcccctgtgcaccctgctgctgctgctggccacccaggccgtggccctggcctggagcccccaggaggaggaccgcatcatcgagggcggcatctatgatgctgacctgaatgatgagcgggtgcagagggccctgcacttcgtcatcagcgagtacaacaaggccacagaagatgagtactacagaaggctgctgcgggtgctgcgggcccgggagcagatcgtgggcggcgtgaactacttctttgatattgaggtgggccgcaccatctgcaccaagagccagcccaacctggacacctgtgccttccacgagcagcctgagctgcagaagaagcagctgtgcagcttccagatctatgaggtgccctgggaggacaggatgagcctggtgaacagccgctgccaggaggcctag

SEQ ID NO: 148893 - DNA, 426 bp, Artificial Sequence
  Description of Artificial Sequence: Synthetic coding sequence
atggcccagtacctgagcaccctgctgctgctgctggccaccctggccgtggccctggcctggagccccaaggaggaggaccgcatcatccctgggggcatctacaatgctgacctgaatgatgagtgggtgcagagggccctgcactttgccatcagcgagtacaacaaggccaccaaggatgactactacagaagacccctgcgggtgctgcgggcccggcagcagacagtgggcggcgtgaactacttctttgatgtggaggtgggccgcaccatctgcaccaagagccagcccaacctggacacctgtgccttccacgagcagcctgagctgcagaagaagcagctgtgcagctttgagatctatgaggtgccctgggagaacagaagaagcctggtgaagagccgctgccaggagagctag

SEQ ID NO: 148894 - DNA, 426 bp, Artificial Sequence; identical to SEQ ID NO: 148893
  Description of Artificial Sequence: Synthetic coding sequence

SEQ ID NO: 148895 - DNA, 582 bp, Artificial Sequence
  Description of Artificial Sequence: Synthetic coding sequence
atgcccaactggggcggcggcaagaagtgtggggtgtgccagaagacagtgtactttgctgaggaggtgcagtgtgagggcaacagcttccacaagagctgcttcctgtgcatggtgtgcaagaagaacctggacagcaccaccgtggccgtgcacggggaggagatctactgcaagagctgctacggcaagaagtatggccccaagggctacggctacggccagggcgccggcaccctgagcacagacaagggggagagcctgggcatcaagcatgaggaggcccctggccaccggcccaccaccaaccccaatgccagcaagtttgcccagaagattggaggcagcgagcgctgcccccgctgcagccaggccgtgtatgctgctgagaaggtgattggagctgggaagtcctggcacaaggcctgcttccgctgtgccaagtgtgggaagggcctggagagcaccaccctggccgacaaggatggagagatctactgcaagggctgctacgccaagaactttggccccaagggcttcggcttcggccagggcgctggggccctggtgcacagcgagtag

SEQ ID NO: 148896 - DNA, 582 bp, Artificial Sequence; identical to SEQ ID NO: 148895
  Description of Artificial Sequence: Synthetic coding sequence

SEQ ID NO: 148897 - DNA, 582 bp, Artificial Sequence; identical to SEQ ID NO: 148895
  Description of Artificial Sequence: Synthetic coding sequence

SEQ ID NO: 148898 - DNA, 582 bp, Artificial Sequence; identical to SEQ ID NO: 148895
  Description of Artificial Sequence: Synthetic coding sequence

SEQ ID NO: 148899 - DNA, 513 bp, Artificial Sequence
  Description of Artificial Sequence: Synthetic coding sequence
atgcccaactggggcggcggcaagaagtgtggggtgtgccagaagacagtgtactttgctgaggaggtgcagtgtgagggcaacagcttccacaagagctgcttcctgtgcatggtgtgcaagaagaacctggacagcaccaccgtggccgtgcacggggaggagatctactgcaagagctgctacggcaagaagtatggccccaagggctacggctacggccagggcgccggcaccaaccccaatgccagcaagtttgcccagaagattggaggcagcgagcgctgcccccgctgcagccaggccgtgtatgctgctgagaaggtgattggagctgggaagtcctggcacaaggcctgcttccgctgtgccaagtgtgggaagggcctggagagcaccaccctggccgacaaggatggagagatctactgcaagggctgctacgccaagaactttggccccaagggctttggatttggccagggcgctggggccctggtgcacagcgagtag

SEQ ID NO: 148900 - DNA, 582 bp, Artificial Sequence
  Description of Artificial Sequence: Synthetic coding sequence
atgcctgtgtggggcggcggcaacaagtgtggggcctgtggccgcacagtgtaccacgccgaggaggtgcagtgtgatggccgctccttccaccgctgctgcttcctgtgcatggtgtgcaggaagaacctggacagcaccaccgtggccatccatgatgaggagatctactgcaagagctgctacggcaagaagtatggccccaagggctacggctacggccagggcgccggcaccctgaacatggacagaggagagcggctgggcatcaagccagagagcgtgcagccccaccggcccaccaccaaccccaacaccagcaagtttgcccagaagtatggaggagctgagaagtgcagccgctgtggggacagcgtgtatgctgctgagaagatcattggagctgggaagccctggcacaagaactgcttccgctgtgccaagtgtgggaagagcctggagagcaccaccctgacagagaaggagggggagatctactgcaagggctgctacgccaagaactttggccccaagggcttcggctacggccagggcgctggggccctggtgcacgcccagtag

SEQ ID NO: 148901 - DNA, 582 bp, Artificial Sequence; identical to SEQ ID NO: 148900
  Description of Artificial Sequence: Synthetic coding sequence

SEQ ID NO: 148902 - DNA, 585 bp, Artificial Sequence
  Description of Artificial Sequence: Synthetic coding sequence
atgcccaactggggcggcggggccaagtgtggggcctgtgagaagacagtgtaccacgccgaggagatccagtgcaatggccgctccttccacaagacctgcttccactgcatggcctgcaggaaggccctggacagcaccaccgtggccgcccacgagagcgagatctactgcaaggtgtgctacggccgccgctatggccccaagggcatcggctacggccagggcgccggctgcctgagcacagacaccggggagcacctgggcctgcagttccagcagagccccaagccagcccggtctgtgaccaccagcaaccccagcaagttcaccgccaagtttggagagagcgagaagtgcccccgctgtgggaagtctgtgtatgctgctgagaaggtgatgggcggcggcaagccctggcacaagacctgcttccgctgtgccatctgtgggaagagcctggagagcaccaacgtgacagacaaggatggagagctgtactgcaaggtgtgctacgccaagaactttggccccactggaattggatttggaggcctgacccagcaggtggagaagaaggagtag

SEQ ID NO: 148903 - DNA, 585 bp, Artificial Sequence; identical to SEQ ID NO: 148902
  Description of Artificial Sequence: Synthetic coding sequence

SEQ ID NO: 148904 - DNA, 1365 bp, Artificial Sequence
  Description of Artificial Sequence: Synthetic coding sequence
atgttcctggcccagaggagcctgtgcagcctgagcggccgggccaagttcctgaagaccatcagcagcagcaagatcctgggcttcagcaccagcgccaagatgagcctgaagttcaccaatgccaagagaattgagggcctggacagcaatgtgtggattgagttcaccaagctggccgctgaccccagcgtggtgaacctgggccagggcttcccagacatcagcccccccacctacgtgaaggaggagctgagcaagattgctgccatcgacagcctgaaccagtacacccggggcttcggccaccccagcctggtgaaggccctgagctacctgtatgagaagctgtaccagaagcagattgacagcaacaaggagatcctggtgacagtgggcgcctacggcagcctcttcaacaccatccaggccctgattgatgaaggagatgaggtgatcctgattgtgcccttctatgactgctatgagcccatggtgaggatggccggggccacccctgtgttcatccccctgcggagcaagcctgtgtatggcaagcgctggagcagcagtgactggaccctggacccccaggagctggagagcaagttcaacagcaagaccaaggccatcatcctgaacaccccccacaaccccctgggcaaggtgtacaaccgggaggagctgcaggtgattgctgacctgtgcatcaagtatgacaccctgtgcatcagtgatgaggtgtatgagtggctggtgtacagcggcaacaagcacctgaagatcgccaccttccctggcatgtgggagaggaccatcaccatcggcagcgctgggaagaccttctctgtgacaggctggaagctgggctggagcatcggccccaaccacctgatcaagcacctgcagacagtgcagcagaacaccatctacacctgtgccacccccctgcaggaggccctggcccaggccttctggattgacatcaagaggatggatgatcctgagtgctacttcaacagcctgcccaaggagctggaggtgaagagggacaggatggtgcggctgctggagagcgtgggcctgaagcccatcgtgcctgatggcggctacttcatcatcgcagatgtgtccctgctggaccctgacctgagtgacatgaagaacaatgagccctatgactacaagtttgtgaagtggatgaccaagcacaagaagctgagcgccatccctgtgtctgccttctgcaacagcgagaccaagagccagtttgagaagtttgtgcgcttctgcttcatcaagaaggacagcaccctggatgctgctgaggagatcatcaaggcctggagcgtgcagaagagctag

SEQ ID NO: 148905 - DNA, 504 bp, Artificial Sequence
  Description of Artificial Sequence: Synthetic coding sequence
atgttcctggcccagaggagcctgtgcagcctgagcggccgggccaagttcctgaagaccatcagcagcagcaagatcctgggcttcagcaccagcgccaagatgagcctgaagttcaccaatgccaagagaattgagggcctggacagcaatgtgtggattgagttcaccaagctggccgctgaccccagcgtggtgaacctgggccagggcttcccagacatcagcccccccacctacgtgaaggaggagctgagcaagattgctgccatcgacagcctgaaccagtacacccggggcttcggccaccccagcctggtgaaggccctgagctacctgtatgagaagctgtaccagaagcagattgacagcaacaaggagatcctggtgacagtgggcgcctacggcagcctcttcaacaccatccaggccctgattgatgaaggagatgagtacaatgcctgcaccgtgaagttcaccaacctgaagtgcacagctggatag

SEQ ID NO: 148906 - DNA, 789 bp, Artificial Sequence
  Description of Artificial Sequence: Synthetic coding sequence
atgttcctggcccagaggagcctgtgcagcctgagcggccgggccaagttcctgaagaccatcagcagcagcaagatcctgggcttcagcaccagcgccaagatgagcctgaagttcaccaatgccaagagaattgagggcctggacagcaatgtgtggattgagttcaccaagctggccgctgaccccagcgtggtgaacctgggccagggcttcccagacatcagcccccccacctacgtgaaggaggagctgagcaagattgctgccatcgacagcctgaaccagtacacccggggcttcggccaccccagcctggtgaaggccctgagctacctgtatgagaagctgtaccagaagcagattgacagcaacaaggagatcctggtgacagtgggcgcctacggcagcctcttcaacaccatccaggccctgattgatgaaggagatgaggtgatcctgattgtgcccttctatgactgctatgagcccatggtgaggatggccggggccacccctgtgttcatccccctgcggagcaagcctgtgtatggcaagcgctggagcagcagtgactggaccctggacccccaggagctggagagcaagttcaacagcaagaccaaggccatcatcctgaacaccccccacaaccccctgggcaaggtgtacaaccgggaggagctgcaggtgattgctgacctgtgcatcaagtatgacaccctgtgcatcagtgatgaggtgtatgagtggctggtgtacagcggcaacaagcacctgaagatctag

SEQ ID NO: 148907 - DNA, 1263 bp, Artificial Sequence
  Description of Artificial Sequence: Synthetic coding sequence
atgagcctgaagttcaccaatgccaagagaattgagggcctggacagcaatgtgtggattgagttcaccaagctggccgctgaccccagcgtggtgaacctgggccagggcttcccagacatcagcccccccacctacgtgaaggaggagctgagcaagattgctgccatcgacagcctgaaccagtacacccggggcttcggccaccccagcctggtgaaggccctgagctacctgtatgagaagctgtaccagaagcagattgacagcaacaaggagatcctggtgacagtgggcgcctacggcagcctcttcaacaccatccaggccctgattgatgaaggagatgaggtgatcctgattgtgcccttctatgactgctatgagcccatggtgaggatggccggggccacccctgtgttcatccccctgcggagcaagcctgtgtatggcaagcgctggagcagcagtgactggaccctggacccccaggagctggagagcaagttcaacagcaagaccaaggccatcatcctgaacaccccccacaaccccctgggcaaggtgtacaaccgggaggagctgcaggtgattgctgacctgtgcatcaagtatgacaccctgtgcatcagtgatgaggtgtatgagtggctggtgtacagcggcaacaagcacctgaagatcgccaccttccctggcatgtgggagaggaccatcaccatcggcagcgctgggaagaccttctctgtgacaggctggaagctgggctggagcatcggccccaaccacctgatcaagcacctgcagacagtgcagcagaacaccatctacacctgtgccacccccctgcaggaggccctggcccaggccttctggattgacatcaagaggatggatgatcctgagtgctacttcaacagcctgcccaaggagctggaggtgaagagggacaggatggtgcggctgctggagagcgtgggcctgaagcccatcgtgcctgatggcggctacttcatcatcgcagatgtgtccctgctggaccctgacctgagtgacatgaagaacaatgagccctatgactacaagtttgtgaagtggatgaccaagcacaagaagctgagcgccatccctgtgtctgccttctgcaacagcgagaccaagagccagtttgagaagtttgtgcgcttctgcttcatcaagaaggacagcaccctggatgctgctgaggagatcatcaaggcctggagcgtgcagaagagctag

SEQ ID NO: 148908 - DNA, 1269 bp, Artificial Sequence
  Description of Artificial Sequence: Synthetic coding sequence
atggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagaccttcggctacccacccctgaccaagatcctggccagcttcttcggggagctgctgggccaggagattgaccccctgagaaatgtgctggtgacagtgggcggctatggagccctcttcaccgccttccaggccctggtggatgaaggagatgaggtgatcatcatcgagcccttctttgactgctatgagcccatgaccatgatggccggcggccggcctgtgtttgtgtccctgaagccaggccccatccagaatggagagctgggcagcagcagcaactggcagctggaccccatggagctggccggcaagttcaccagcaggaccaaggccctggtgctgaacacccccaacaaccccctgggcaaggtgttcagccgggaggagctggagctggtggccagcctgtgccagcagcatgatgtggtgtgcatcacagatgaggtgtaccagtggatggtgtatgatggccaccagcacatcagcatcgccagcctgcccggcatgtgggagaggaccctgaccatcggcagcgctgggaagaccttcagcgccaccggctggaaggtgggctgggtgctgggccctgaccacatcatgaagcacctgaggacagtgcaccagaacagcgtcttccactgccccacccagagccaggccgctgtggccgagagctttgagcgggagcagctgctcttccggcagcccagcagctactttgtgcagttcccccaggccatgcagcgctgccgggaccacatgatccgcagcctgcagagcgtgggcctgaagcccatcatcccccagggcagctacttcctgatcacagacatcagtgacttcaagaggaagatgccagacctgcctggagctgtggatgagccctatgacagaagatttgtgaagtggatgatcaagaacaagggcctggtggccatccctgtgtccatcttctacagcgtgccccaccagaagcactttgaccactacatccgcttctgctttgtgaaggatgaggccaccctgcaggccatggatgagaagctgaggaagtggaaggtggagctgtag

SEQ ID NO: 148909 - DNA, 1119 bp, Artificial Sequence
  Description of Artificial Sequence: Synthetic coding sequence
atggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagacctttgtgatcatcatcgagcccttctttgactgctatgagcccatgaccatgatggccggcggccggcctgtgtttgtgtccctgaagccaggccccatccagaatggagagctgggcagcagcagcaactggcagctggaccccatggagctggccggcaagttcaccagcaggaccaaggccctggtgctgaacacccccaacaaccccctgggcaaggtgttcagccgggaggagctggagctggtggccagcctgtgccagcagcatgatgtggtgtgcatcacagatgaggtgtaccagtggatggtgtatgatggccaccagcacatcagcatcgccagcctgcccggcatgtgggagaggaccctgaccatcggcagcgctgggaagaccttcagcgccaccggctggaaggtgggctgggtgctgggccctgaccacatcatgaagcacctgaggacagtgcaccagaacagcgtcttccactgccccacccagagccaggccgctgtggccgagagctttgagcgggagcagctgctcttccggcagcccagcagctactttgtgcagttcccccaggccatgcagcgctgccgggaccacatgatccgcagcctgcagagcgtgggcctgaagcccatcatcccccagggcagctacttcctgatcacagacatcagtgacttcaagaggaagatgccagacctgcctggagctgtggatgagccctatgacagaagatttgtgaagtggatgatcaagaacaagggcctggtggccatccctgtgtccatcttctacagcgtgccccaccagaagcactttgaccactacatccgcttctgctttgtgaaggatgaggccaccctgcaggccatggatgagaagctgaggaagtggaaggtggagctgtag

SEQ ID NO: 148910 - DNA, 480 bp, Artificial Sequence
  Description of Artificial Sequence: Synthetic coding sequence
gccatggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagacctttgtgtccctgtgctacccaggctggagcgccatggtgcgctcctggagcacagctgccctgaccctgcctgtgagcagcggcccccccaccagcgccagcggcgtgacaggcaccaccggctggagccagagctggctggagagcagcttctttgaccccaagaagaagaagatcatctggggctacccacccctgaccaagatcctggccagcttctttggagagctgctgggccaggagattgaccccctgagaaatgtgctggtgacagtgtag

SEQ ID NO: 148911 - DNA, 555 bp, Artificial Sequence
  Description of Artificial Sequence: Synthetic coding sequence
atggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagaccttcggctacccacccctgaccaagatcctggccagcttcttcggggagctgctgggccaggagattgaccccctgagaaatgtgctggtgacagtgggcggctatggagccctcttcaccgccttccaggccctggtggatgaaggagatgaggtgatcatcatcgagcccttctttgactgctatgagcccatgaccatgatggccggcggccggcctgtgtttgtgtccctgaagccaggccccatccagaatggagagctgggcagcagcagcaactggcagctggaccccatggagctggccggcaagttcaccagcaggaccaaggccctggtgctgaacacccccaactag

SEQ ID NO: 148912 - DNA, 480 bp, Artificial Sequence; identical to SEQ ID NO: 148910
  Description of Artificial Sequence: Synthetic coding sequence

SEQ ID NO: 148913 - DNA, 1551 bp, Artificial Sequence
  Description of Artificial Sequence: Synthetic coding sequence
atgttcagaacagctgctgccatctctgtgcacctggtgggccccctgcagggcaggaaggccggggcccccctgacctggttcctgcaccagacccaggtggccgagaagaatgtgggcagccctgccccccggcccaccagccacctgggcctggccaacccccaggagaggaaggtgccccagggcccccagagcccctgtgaggtgcctgctgctgagggcatcctgaggactggaggagccaagctgcccatccagggccacccagccaagctggccatggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagaccttcggctacccacccctgaccaagatcctggccagcttcttcggggagctgctgggccaggagattgaccccctgagaaatgtgctggtgacagtgggcggctatggagccctcttcaccgccttccaggccctggtggatgaaggagatgaggtgatcatcatcgagcccttctttgactgctatgagcccatgaccatgatggccggcggccggcctgtgtttgtgtccctgaagccaggccccatccagaatggagagctgggcagcagcagcaactggcagctggaccccatggagctggccggcaagttcaccagcaggaccaaggccctggtgctgaacacccccaacaaccccctgggcaaggtgttcagccgggaggagctggagctggtggccagcctgtgccagcagcatgatgtggtgtgcatcacagatgaggtgtaccagtggatggtgtatgatggccaccagcacatcagcatcgccagcctgcccggcatgtgggagaggaccctgaccatcggcagcgctgggaagaccttcagcgccaccggctggaaggtgggctgggtgctgggccctgaccacatcatgaagcacctgaggacagtgcaccagaacagcgtcttccactgccccacccagagccaggccgctgtggccgagagctttgagcgggagcagctgctcttccggcagcccagcagctactttgtgcagttcccccaggccatgcagcgctgccgggaccacatgatccgcagcctgcagagcgtgggcctgaagcccatcatcccccagggcagctacttcctgatcacagacatcagtgacttcaagaggaagatgccagacctgcctggagctgtggatgagccctatgacagaagatttgtgaagtggatgatcaagaacaagggcctggtggccatccctgtgtccatcttctacagcgtgccccaccagaagcactttgaccactacatccgcttctgctttgtgaaggatgaggccaccctgcaggccatggatgagaagctgaggaagtggaaggtggagctgtag

SEQ ID NO: 148914 - DNA, 756 bp, Artificial Sequence
  Description of Artificial Sequence: Synthetic coding sequence
atggccaagcagctgcaggcccggcggctggatggcatcgactacaacccctgggtggagtttgtgaagctggccagcgagcatgatgtggtgaacctgggccagggcttcccagacttccccccaccagactttgctgtggaggccttccagcacgctgtgtctggggacttcatgctgaaccagtacaccaagaccttcggctacccacccctgaccaagatcctggccagcttcttcggggagctgctgggccaggagattgaccccctgagaaatgtgctggtgacagtgggcggctatggagccctcttcaccgccttccaggccctggtggatgaaggagatgaggtgatcatcatcgagcccttctttgactgctatgagcccatgaccatgatggccggcggccggcctgtgtttgtgtccctgaagccaggccccatccagaatggagagctgggcagcagcagcaactggcagctggaccccatggagctggccggcaagttcaccagcaggaccaaggccctggtgctgaacacccccaacaaccccctgggcaaggtgttcagccgggaggagctggagctggtggccagcctgtgccagcagcatgatgtggtgtgcatcacagatgaggtgtaccagtggatggtgtatgatggccaccagcacatcagcatcgccagcctgcccggcatgtgggagaggaccctgaccatcggcagcgctgggaagaccttcagcgcctag

SEQ ID NO: 148915 - DNA, 603 bp, Artificial Sequence
  Description of Artificial Sequence: Synthetic coding sequence
atggagcagacagaggtgctgaagcccaggaccctggccgacctgatccgcatcctgcaccagctgtttgctggagatgaggtgaatgtggaggaggtgcaggccatcatggaggcctatgaaagtgaccccacagagtgggccatgtatgccaagtttgaccagtaccgctacaccaggaacctggtggaccagggcaatggcaagttcaacctgatgatcctgtgctggggcgagggccacggcagcagcatccatgaccacaccaacagccactgcttcctgaagatgctgcagggcaacctgaaggagaccctgtttgcctggccagacaagaagagcaatgagatggtgaagaagtctgagcgggtgctgcgggagaaccagtgtgcctacatcaatgacagcatcggcctgcaccgggtggagaacatcagccacacagagcctgctgtgtccctgcacctgtacagccccccatttgacacctgccacgcctttgaccagaggacaggccacaagaacaaggtgaccatgaccttccacagcaagtttggcatccgcaccccaaatgccaccagcggcagcctggagaacaactag

SEQ ID NO: 148916 - DNA, 3111 bp, Artificial Sequence
  Description of Artificial Sequence: Synthetic coding sequence
atgtacctggtggccggggaccggggcctggccggctgcggccacctgctggtgtccctgctgggcctgctgctgctgctggcccggagcggcacccgggccctggtgtgcctgccctgtgatgagagcaaatgtgaggagcccaggaactgccccggcagcatcgtgcagggcgtgtgtggctgctgctacacctgtgccagccagagaaatgaaagctgtggcggcaccttcggcatctacggcacctgtgaccggggcctgcgctgcgtcatccggccccccctgaatggagacagcctgacagaatatgaggccggcgtgtgtgaagatgagaactggacagatgaccagctgctgggcttcaagccctgcaatgaaaacctgattgctggctgcaacatcatcaatggaaaatgtgagtgcaacaccatccgcacctgcagcaacccctttgagttccccagccaggacatgtgcctgagcgccctgaagagaattgaggaggagaagccagactgcagcaaggcccgctgtgaggtgcagttcagcccccgctgcccagaagattctgtgctgattgagggctacgcccctcctggagagtgctgccccctgcccagccgctgtgtgtgcaacccagctggctgcctgaggaaggtgtgccagcccggcaacctgaacatcctggtgtccaaggccagcggcaagccaggagagtgctgtgacctgtatgagtgcaagcctgtgtttggagtggactgcaggacagtggagtgcccccctgtgcagcagacagcctgccccccagacagctatgagacccaggtgcggctgacagcagatggctgctgcaccctgcccacccgctgtgagtgcctgagcggcctgtgtggcttccctgtgtgtgaggtgggcagcaccccaagaattgtgtccagaggagatggcaccccaggcaagtgctgtgatgtgtttgaatgtgtgaatgacaccaagccagcctgtgtgttcaacaacgtggagtactatgatggagacatgttcaggatggacaactgccgcttctgccgctgccagggcggcgtggccatctgcttcaccgcccagtgtggggagatcaactgtgagcgctactacgtgcctgaaggagagtgctgccctgtgtgtgaagatcctgtgtaccccttcaacaacccagctggctgctacgccaacggcctcatcctggcccacggggaccgctggagagaagatgactgcaccttctgccagtgtgtgaatggagagcggcactgtgtggccaccgtgtgtggccagacctgcaccaaccctgtgaaggtgcctggagagtgctgccctgtgtgtgaggagcccaccatcatcaccgtggaccccccagcctgtggggagctgagcaactgcaccctgaccgggaaggactgcatcaatggcttcaagagggaccacaacggctgcaggacctgccagtgcatcaacacagaggagctgtgcagcgagaggaagcagggctgcaccctgaactgccccttcggcttcctgacagatgcccagaactgtgagatctgtgaatgtcggccccggcccaagaagtgccggcccatcatctgtgacaagtactgccccctgggcctgctgaagaacaagcacggctgtgacatctgccgctgcaagaagtgcccagagctgagctgcagcaagatctgccccctgggcttccagcaggacagccacggctgcctgatctgcaagtgccgggaggccagcgccagcgctggcccccccatcctgagcggcacctgcctgactgtggatggccaccaccacaagaatgaggagagctggcatgatggctgccgggagtgctactgcctgaatggccgggagatgtgtgccctgatcacctgccctgtgcctgcctgtggcaaccccaccatccaccctggccagtgctgccccagctgtgctgatgactttgtggtgcagaagccagagctgagcacccccagcatctgccacgcccctggaggagagtactttgtggagggggagacctggaacatcgacagctgcacccagtgcacctgccacagcggccgggtgctgtgtgaaacagaggtgtgcccccccctgctgtgccagaaccccagcaggacccaggacagctgctgcccccagtgcacagaccagcccttccggcccagcctgagcaggaacaacagcgtgcccaactactgcaagaatgatgaaggagacatcttcctggccgctgagagctggaagccagatgtgtgcaccagctgcatctgcatcgacagcgtcatcagctgcttcagcgagagctgccccagcgtgtcctgtgagaggcctgtgctgaggaagggccagtgctgcccctactgcatcgaggacaccatccccaagaaggtggtgtgccacttcagcggcaaggcctatgcagatgaggagcgctgggacctggacagctgcacccactgctactgcctgcagggccagaccctgtgcagcacagtgtcctgcccccccctgccctgtgtggagcccatcaacgtggagggcagctgctgccccatgtgcccagagatgtatgtgcctgagcccaccaacatccccatcgagaagaccaaccacagaggagaggtggacctggaggtgcccctgtggcccacccccagtgaaaatgacatcgtgcacctgccccgggacatgggccacctgcaggtggactacagagacaaccggctgcaccccagcgaggacagcagcctggacagcatcgcctctgtggtggtgcccatcatcatctgcctgagcatcatcatcgccttcctgttcatcaaccagaagaagcagtggatccccctgctgtgctggtaccgcacccccaccaagcccagcagcctgaacaaccagctggtgtctgtggactgcaagaagggcaccagggtgcaggtggacagcagccagaggatgctgagaattgctgagccagatgcccgcttcagcggcttctacagcatgcagaagcagaaccacctgcaggccgacaacttctaccagacagtgtag

SEQ ID NO: 148917 - DNA, 498 bp, Artificial Sequence
  Description of Artificial Sequence: Synthetic coding sequence
atggctgactttgatgagatctatgaggaggaggaggatgaggagcgggccctggaggagcagctgctgaagtacagcccagaccctgtggtggtgcggggcagcggccacgtgacagtgtttggcctgagcaacaagtttgaaagtgagttccccagcagcctgaccgggaaggtggcccctgaggagttcaaggccagcatcaacagagtgaacagctgcctgaagaagaacctgcctgtgaatgtgcgctggctgctgtgtggctgcctgtgctgctgctgcaccctgggctgcagcatgtggcctgtgatctgcctgagcaagaggacccggcgcagcattgagaagctgctggagtgggagaacaaccggctgtaccacaagctgtgcctgcactggaggctgagcaagaggaaatgtgagaccaacaacatgatggagtatgtgatcctgattgagttcctgcccaagacccccatcttccggccagactag

SEQ ID NO: 148918 - DNA, 234 bp, Artificial Sequence
  Description of Artificial Sequence: Synthetic coding sequence
atgcccaagtgccccaagtgcaacaaggaggtgtactttgctgagcgggtgaccagcctgggcaaggactggcaccggccctgcctgaagtgtgagaagtgtgggaagaccctgaccagcggcggccacgccgagcacgagggcaagccctactgcaaccacccctgctacgccgccatgtttggccccaagggcttcggccggggcggcgctgagagccacaccttcaagtag

SEQ ID NO: 148919 - DNA, 234 bp, Artificial Sequence; identical to SEQ ID NO: 148918
  Description of Artificial Sequence: Synthetic coding sequence

SEQ ID NO: 148920 - DNA, 234 bp, Artificial Sequence; identical to SEQ ID NO: 148918
  Description of Artificial Sequence: Synthetic coding sequence

SEQ ID NO: 148921 - DNA, 627 bp, Artificial Sequence
  Description of Artificial Sequence: Synthetic coding sequence
atggccagcaagtgccccaagtgtgacaagacagtgtactttgctgagaaggtgagcagcctgggcaaggactggcacaagttctgcctgaagtgtgagcgctgcagcaagaccctgaccccaggcggccatgctgagcatgatggcaagcccttctgccacaagccctgctacgccaccctgtttggccccaagggcgtgaacattggaggagctggcagctacatctatgagaagcccctggccgagggcccccaggtgacaggccccatcgaggtgcctgctgcccgggcagaggagaggaaggccagcggcccccccaagggccccagccgggccagctctgtgaccaccttcaccggggagcccaacacctgcccccgctgcagcaagaaggtgtactttgctgagaaggtgaccagcctgggcaaggactggcaccggccctgcctgcgctgtgagcgctgtgggaagaccctgacccctgggggccacgccgagcatgatggccagccctactgccacaagccctgctacggcatcctgtttggccccaagggcgtgaacacaggagctgtgggcagctacatctatgaccgggaccctgagggcaaggtgcagccctag

SEQ ID NO: 148922 - DNA, 849 bp, Artificial Sequence
  Description of Artificial Sequence: Synthetic coding sequence
atgccaccccaccacctgctgccctggctggcccaggtgcccagcgctgagggggagctggtgcggctggtgtccagagctgggggccgcggggcctgcttctggccagctgtgaccatggagatggctgtggccgccggctgtgtgtgcaagggcggcggctgctgccaccgggagcccagccaggaccaccacgagagccaggagcaccggggccccctggtgggcagccagacctgcctggtgcaccaggccgagggcacagctgagaaggtgagcagcctgggcaaggactggcacaagttctgcctgaagtgtgagcgctgcagcaagaccctgaccccaggcggccatgctgagcatgatggcaagcccttctgccacaagccctgctacgccaccctgtttggccccaagggcgtgaacattggaggagctggcagctacatctatgagaagcccctggccgagggcccccaggtgacaggccccatcgaggtgcctgctgcccgggcagaggagaggaaggccagcggcccccccaagggccccagccgggccagctctgtgaccaccttcaccggggagcccaacacctgcccccgctgcagcaagaaggtgtactttgctgagaaggtgaccagcctgggcaaggactggcaccggccctgcctgcgctgtgagcgctgtgggaagaccctgacccctgggggccacgccgagcatgatggccagccctactgccacaagccctgctacggcatcctgtttggccccaagggcgtgaacacaggagctgtgggcagctacatctatgaccgggaccctgagggcaaggtgcagccctag

SEQ ID NO: 148923 - DNA, 315 bp, Artificial Sequence
  Description of Artificial Sequence: Synthetic coding sequence
tgaccaggaggagagagagctgagggcgccggccggcctggggcccccaccatggccagcaaatgtcccaagtgtgacaagacagtgtactttgctgagaaggtgaccagcctgggcaaggactggcaccggccctgcctgcgctgtgagcgctgtgggaagaccctgacccctgggggccacgccgagcatgatggccagccctactgccacaagccctgctacggcatcctgtttggccccaagggcgtgaacacaggagctgtgggcagctacatctatgaccgggaccctgagggcaaggtgcagccctag

SEQ ID NO: 148924 - DNA, 537 bp, Artificial Sequence
  Description of Artificial Sequence: Synthetic coding sequence
atggagatcaagcacctgctcttcctggtggccgccgcctgcctgctgcccatgctgtccatgaagaagaagagcgcccgggaccagttcaacaagctggtgacagacctgcccaacgtgcaggaggagatcgtgaacatccacaatgccctgcggaggagagtggtgcccccagccagcaacatgctgaagatgtcctggagcgaggaggccgcccagaatgcccgcatcttcagcaagtactgtgacatgacagagagcaaccccctggagcggcggctgcccaacaccttctgtggggagaacatgcacatgaccagctaccctgtgtcctggagcagcgtcatcggcgtgtggtacagcgagagcaccagcttcaagcacggggagtggaccaccacagatgatgacatcaccacagaccactacacccagatcgtgtgggccaccagctacctgattggctgtgccatcgccagctgccggcagcagggcagcccccgctacctgtatgtgtgccactactgccacgactag

SEQ ID NO: 148925 - DNA, 750 bp, Artificial Sequence
  Description of Artificial Sequence: Synthetic coding sequence
atggagatcaagcacctgctcttcctggtggccgccgcctgcctgctgcccatgctgtccatgaagaagaagagcgcccgggaccagttcaacaagctggtgacagacctgcccaacgtgcaggaggagatcgtgaacatccacaatgccctgcggaggagagtggtgcccccagccagcaacatgctgaagatgtcctggagcgaggaggccgcccagaatgcccgcatcttcagcaagtactgtgacatgacagagagcaaccccctggagcggcggctgcccaacaccttctgtggggagaacatgcacatgaccagctaccctgtgtcctggagcagcgtcatcggcgtgtggtacagcgagagcaccagcttcaagcacggggagtggaccaccacagatgatgacatcaccacagaccactacacccagatcgtgtgggccaccagctacctgattggctgtgccatcgccagctgccggcagcagggcagcccccgctacctgtatgtgtgccactactgccacgagggcaatgaccctgagaccaagaatgagccctacaagacaggagtgccctgtgaggcctgccccagcaactgtgaggacaagctgtgcaccaacccctgcatctactatgatgagtactttgactgtgacatccaggtgcactacctgggctgcaaccacagcaccaccatcctcttctgcaaggccacctgcctgtgtgacacagagatcaagtag

SEQ ID NO: 148926 - DNA, 750 bp, Artificial Sequence; identical to SEQ ID NO: 148925
  Description of Artificial Sequence: Synthetic coding sequence

SEQ ID NO: 148927 - DNA, 750 bp, Artificial Sequence; identical to SEQ ID NO: 148925
  Description of Artificial Sequence: Synthetic coding sequence

SEQ ID NO: 148928 - DNA, 537 bp, Artificial Sequence; identical to SEQ ID NO: 148924
  Description of Artificial Sequence: Synthetic coding sequence

SEQ ID NO: 148929 - DNA, 537 bp, Artificial Sequence; identical to SEQ ID NO: 148924
  Description of Artificial Sequence: Synthetic coding sequence

SEQ ID NO: 148930 - DNA, 669 bp, Artificial Sequence
  Description of Artificial Sequence: Synthetic coding sequence
atggccggcaagcccaagctgcactacttcaacggccggggccgcatggagcccatccgctggctgctggccgccgccggcgtggagtttgaggagaagttcatcggcagcgctgaggacctgggcaagctgagaaatgatggcagcctgatgttccagcaggtgcccatggtggagattgatggcatgaagctggtgcagacccgggccatcctgaactacatcgccagcaagtacaacctgtatggcaaggacatcaaggagcgggccctgattgacatgtacacagagggcatggctgacctgaatgagatgatcctgctgctgcccctgtgcaggcctgaggagaaggatgccaagatcgccctgatcaaggagaagaccaagagccgctacttccctgcctttgagaaggtgctgcagagccacggccaggactacctggtgggcaacaagctgagcagagctgacatcagcctggtggagctgctgtactacgtggaggagctggacagcagcctcatcagcaacttccccctgctgaaggccctgaagacccgcatcagcaacctgcccaccgtgaagaagttcctgcagcccggcagccccaggaagcccccagcagatgccaaggccctggaggaggccaggaagatcttccgcttctag

SEQ ID NO: 148931 - DNA, 732 bp, Artificial Sequence
  Description of Artificial Sequence: Synthetic coding sequence
atggccctgctgcctgtgctcttcctggtgacagtgctgctgcccagcctgcctgctgagggcaaggaccctgccttcaccgccctgctgaccacccagctgcaggtgcagcgggagatcgtgaacaagcacaatgagctgaggaaggctgtgtccccaccagccagcaacatgctgaagatggagtggagccgggaggtgaccaccaatgcccagcgctgggccaacaagtgcaccctgcagcacagcgaccctgaggacaggaagaccagcacccgctgtggggagaacctgtacatgagcagtgaccccacctcctggagcagcgccatccagagctggtatgatgagatcctggactttgtgtatggagtgggccccaagagccccaatgctgtggtgggccactacacccagctggtgtggtacagcacctaccaggtgggctgcggcatcgcctactgccccaaccaggacagcctgaagtactactacgtgtgccagtactgcccagctggcaacaacatgaacaggaagaacaccccctaccagcagggcaccccctgtgccggctgcccagatgactgtgacaagggcctgtgcaccaacagctgccagtaccaggacctgctgagcaactgtgacagcctgaagaacacagctggctgtgaacatgagctgctgaaggagaagtgcaaggccacctgcctgtgtgagaacaagatctactag

SEQ ID NO: 148932 - DNA, 1494 bp, Artificial Sequence
  Description of Artificial Sequence: Synthetic coding sequence
atgagctgtgtgctgggcggcgtcatccccctgggcctgctcttcctggtgtgtggcagccagggctacctgctgcccaacgtgaccctgctggaggagctgctgagcaagtaccagcacaatgaaagccacagccgggtgcggcgggccatcccccgggaggacaaggaggagatcctgatgctgcacaacaagctgcggggccaggtgcagccccaggccagcaacatggagtacatgacctgggatgatgagctggagaagtctgctgctgcctgggccagccagtgcatctgggagcacggccccaccagcctgctggtgtccatcggccagaacctgggcgcccactggggccgctaccgcagccctggcttccacgtgcagagctggtatgatgaggtgaaggactacacctacccctaccccagcgagtgcaacccctggtgcccagagcgctgcagcggccccatgtgcacccactacacccagatcgtgtgggccaccaccaacaagattggctgtgctgtgaacacctgcaggaagatgacagtgtggggcgaggtgtgggagaatgctgtgtactttgtgtgcaactacagccccaagggcaactggattggagaggccccctacaagaatggccggccctgcagcgagtgcccccccagctatggaggcagctgcaggaacaacctgtgctaccgggaggagacctacacccccaagccagagacagatgagatgaatgaggtggagacagcccccatccctgaggagaaccacgtgtggctgcagccccgggtgatgaggcccaccaagcccaagaagaccagcgctgtgaactacatgacccaggtggtgcgctgtgacaccaagatgaaggaccgctgcaagggcagcacctgcaaccgctaccagtgcccagctggctgcctgaaccacaaggccaagatcttcggcaccctcttctatgagagcagcagcagcatctgccgggccgccatccactacggcatcctggatgacaagggcggcctggtggacatcaccagaaatggcaaggtgcccttctttgtgaagtcagaaagacatggagtgcagagcctgagcaagtacaagcccagcagcagcttcatggtgtccaaggtgaaggtgcaggacctggactgctacaccaccgtggcccagctgtgcccctttgagaagccagccacccactgcccccgcatccactgcccagcccactgcaaggatgagcccagctactgggcccctgtgtttggcaccaacatctatgctgacaccagcagcatctgcaagacagctgtgcacgccggggtcatcagcaatgaaagtggaggagatgtggatgtgatgcctgtggacaagaagaagacctacgtgggcagcctgagaaatggagtgcagagcgagagcctgggcaccccaagagatggcaaggccttccgcatctttgctgtgcggcagtag

SEQ ID NO: 148933 - DNA, 1269 bp, Artificial Sequence
  Description of Artificial Sequence: Synthetic coding sequence
atggccccctggccacccaagggcctggtgcctgccatgctgtggggcctgagcctcttcctgaacctgcccggccccatctggctgcagcccagccccccaccccagagcagccccccaccccagccccacccctgccacacctgccggggcctggtggacagcttcaacaagggcctggagaggaccatccgggacaactttggaggcggcaacacagcctgggaggaggagaacctgagcaagtacaaggacagcgagacccggctggtggaggtgctggagggcgtgtgcagcaagagtgactttgagtgccaccggctgctggagctgtctgaggagctggtggagagctggtggttccacaagcagcaggaggccccagacctcttccagtggctgtgcagcgacagcctgaagctgtgctgcccagctggcaccttcggccccagctgcctgccctgccctgggggcacagagcggccctgtggcggctacggccagtgtgagggggagggcacccggggcggcagcggccactgtgactgccaggccggctatggaggagaggcctgtggccagtgtggcctgggctactttgaggccgagagaaatgccagccacctggtgtgcagcgcctgcttcggcccctgtgcccgctgcagcggccctgaggagagcaactgcctgcagtgcaagaagggctgggccctgcaccacctgaagtgtgtggacattgatgaatgtggcacagaaggagccaactgtggggctgaccagttctgtgtgaacacagagggcagctatgagtgccgggactgtgccaaggcctgcctgggctgcatgggcgccggccctggccgctgcaagaagtgcagccctggctaccagcaggtgggcagcaagtgcctggatgtggatgaatgtgaaacagaggtgtgccctggagagaacaagcagtgtgagaacacagagggcggctaccgctgcatctgtgccgagggctacaagcagatggagggcatctgtgtgaaggagcagatccctggggccttccccatcctgacagacctgaccccagagaccacccggcgctggaagctgggcagccacccccacagcacctacgtgaagatgaagatgcagagagatgaggccaccttccctggcctgtatggcaagcaggtggccaagctgggcagccagagccggcagagcgaccggggcaccaggctcatccacagccagcaggccagcagccagaggtag

SEQ ID NO: 148934 - DNA, 1263 bp, Artificial Sequence
  Description of Artificial Sequence: Synthetic coding sequence
atggccccctggccacccaagggcctggtgcctgccatgctgtggggcctgagcctcttcctgaacctgcccggccccatctggctgcagcccagccccccaccccagagcagccccccaccccagccccacccctgccacacctgccggggcctggtggacagcttcaacaagggcctggagaggaccatccgggacaactttggaggcggcaacacagcctgggaggaggagaacctgagcaagtacaaggacagcgagacccggctggtggaggtgctggagggcgtgtgcagcaagagtgactttgagtgccaccggctgctggagctgtctgaggagctggtggagagctggtggttccacaagcagcaggaggccccagacctcttccagtggctgtgcagcgacagcctgaagctgtgctgcccagctggcaccttcggccccagctgcctgccctgccctgggggcacagagcggccctgtggcggctacggccagtgtgagggggagggcacccggggcggcagcggccactgtgactgccaggccggctatggaggagaggcctgtggccagtgtggcctgggctactttgaggccgagagaaatgccagccacctggtgtgcagcgcctgcttcggcccctgtgcccgctgcagcggccctgaggagagcaactgcctgcagtgcaagaagggctgggccctgcaccacctgaagtgtgtggacattgatgaatgtggcacagaaggagccaactgtggggctgaccagttctgtgtgaacacagagggcagctatgagtgccgggactgtgccaaggcctgcctgggctgcatgggcgccggccctggccgctgcaagaagtgcagccctggctaccagcaggtgggcagcaagtgcctggatgtggatgaatgtgaaacagaggtgtgccctggagagaacaagcagtgtgagaacacagagggcggctaccgctgcatctgtgccgagggctacaagcagatggagggcatctgtgtgaaggagcagatccctgagagcgctggcttcttcagcgagatgacagaagatgagctggtggtgctgcagcagatgttcttcggcatcatcatctgtgccctggccaccctggccgccaagggggacctggtgttcaccgccatcttcatcggggctgtggccgccatgacaggctactggctgtctgagaggagtgacagagtgctggagggcttcatcaagggccgctag

SEQ ID NO: 148935 - DNA, 1263 bp, Artificial Sequence; identical to SEQ ID NO: 148934
  Description of Artificial Sequence: Synthetic coding sequence

SEQ ID NO: 148936 - DNA, 1263 bp, Artificial Sequence; identical to SEQ ID NO: 148934
  Description of Artificial Sequence: Synthetic coding sequence

SEQ ID NO: 148937 - DNA, 1140 bp, Artificial Sequence
  Description of Artificial Sequence: Synthetic coding sequence
atgagcagcagaattgcccgggccctggccctggtggtgaccctgctgcacctgacccggctggccctgagcacctgcccagctgcctgccactgccccctggaggcccccaagtgtgcccctggggtgggcctggtgagagatggctgcggctgctgcaaggtgtgtgccaagcagctgaatgaagactgcagcaagacccagccctgtgaccacaccaagggcctggagtgcaactttggagccagcagcacagccctgaagggcatctgccgggcccagagcgagggccggccctgtgagtacaacagccgcatctaccagaatggagagagcttccagcccaactgcaagcaccagtgcacctgcattgatggagctgtgggctgcatccccctgtgcccccaggagctgagcctgcccaacctgggctgccccaacccccggctggtgaaggtgacaggccagtgctgtgaggagtgggtgtgtgatgaagattccatcaaggaccccatggaggaccaggacggcctgctgggcaaggagctgggctttgatgccagcgaggtggagctgaccaggaacaatgagctgattgctgtgggcaagggcagcagcctgaagaggctgcctgtgtttggcatggagccccgcatcctgtacaaccccctgcagggccagaagtgcatcgtgcagaccacctcctggagccagtgcagcaagacctgtggcaccggcatcagcaccagggtgaccaatgacaacccagaatgtcggctggtgaaggagacccgcatctgtgaggtgcggccctgtggccagcctgtgtacagcagcctgaagaagggcaagaagtgcagcaagaccaagaagagccctgagcctgtgcgcttcacctacgccggctgcctgtctgtgaagaagtaccggcccaagtactgcggcagctgtgtggatggccgctgctgcaccccccagctgacccgctgtgaagatgctgtgcccctgcggcgctggggagacatcttccaggagagacatgatgatcctgtgaagtgcaactacaactgcccccacgccaatgaagctgccttccccttctaccgcctcttcaatgacatccacaagttccgggactag

SEQ ID NO: 148938 - DNA, 1146 bp, Artificial Sequence
  Description of Artificial Sequence: Synthetic coding sequence
atgagcagcagaattgcccgggccctggccctggtggtgaccctgctgcacctgacccggctggccctgagcacctgcccagctgcctgccactgccccctggaggcccccaagtgtgcccctggggtgggcctggtgagagatggctgcggctgctgcaaggtgtgtgccaagcagctgaatgaagactgcagcaagacccagccctgtgaccacaccaagggcctggagtgcaactttggagccagcagcacagccctgaagggcatctgccgggcccagagcgagggccggccctgtgagtacaacagccgcatctaccagaatggagagagcttccagcccaactgcaagcaccagtgcacctgcattgatggagctgtgggctgcatccccctgtgcccccaggagctgagcctgcccaacctgggctgccccaacccccggctggtgaaggtgacaggccagtgctgtgaggagtgggtgtgtgatgaagattccatcaaggaccccatggaggaccaggacggcctgctgggcaaggagctgggctttgatgccagcgaggtggagctgaccaggaacaatgagctgattgctgtgggcaagggcagcagcctgaagaggctgcctgtgtttggcatggagccccgcatcctgtacaaccccctgcagggccagaagtgcatcgtgcagaccacctcctggagccagtgcagcaagacctgtggcaccggcatcagcaccagggtgaccaatgacaacccagaatgtcggctggtgaaggagacccgcatctgtgaggtgcggccctgtggccagcctgtgtacagcagcctgaagaagggcaagaagtgcagcaagaccaagaagagccctgagcctgtgcgcttcacctacgccggctgcctgtctgtgaagaagtaccggcccaagtactgcggcagctgtgtggatggccgctgctgcaccccccagctgaccaggacagtgaagatgaggttccgctgtgaagatggagagaccttcagcaagaatgtgatgatgatccagagctgcaagtgcaactacaactgcccccacgccaatgaagctgccttccccttctaccgcctcttcaatgacatccacaagttccgggactag

SEQ ID NO: 148939 - DNA, 1074 bp, Artificial Sequence
  Description of Artificial Sequence: Synthetic coding sequence
atgagcagcagaattgcccgggccctggccctggtggtgaccctgctgcacctgacccggctggccctgagcacctgtggctgctgcaaggtgtgtgccaagcagctgaatgaagactgcagcaagacccagccctgtgaccacaccaagggcctggagtgcaactttggagccagcagcacagccctgaagggcatctgccgggcccagagcgagggccggccctgtgagtacaacagccgcatctaccagaatggagagagcttccagcccaactgcaagcaccagtgcacctgcattgatggagctgtgggctgcatccccctgtgcccccaggagctgagcctgcccaacctgggctgccccaacccccggctggtgaaggtgacaggccagtgctgtgaggagtgggtgtgtgatgaagattccatcaaggaccccatggaggaccaggacggcctgctgggcaaggagctgggctttgatgccagcgaggtggagctgaccaggaacaatgagctgattgctgtgggcaagggcagcagcctgaagaggctgcctgtgtttggcatggagccccgcatcctgtacaaccccctgcagggccagaagtgcatcgtgcagaccacctcctggagccagtgcagcaagacctgtggcaccggcatcagcaccagggtgaccaatgacaacccagaatgtcggctggtgaaggagacccgcatctgtgaggtgcggccctgtggccagcctgtgtacagcagcctgaagaagggcaagaagtgcagcaagaccaagaagagccctgagcctgtgcgcttcacctacgccggctgcctgtctgtgaagaagtaccggcccaagtactgcggcagctgtgtggatggccgctgctgcaccccccagctgaccaggacagtgaagatgaggttccgctgtgaagatggagagaccttcagcaagaatgtgatgatgatccagagctgcaagtgcaactacaactgcccccacgccaatgaagctgccttccccttctaccgcctcttcaatgacatccacaagttccgggactag

SEQ ID NO: 148940 - DNA, 1014 bp, Artificial Sequence
  Description of Artificial Sequence: Synthetic coding sequence
atggatgagaccggcaacctgactgtgtcctctgccacctgccacgacaccattgatgacttcaggaaccaggtgtacagcaccctgtacagcatgatctctgtggtgggcttctttggaaatggatttgtgctgtatgtgctgatcaagacctaccacaagaagagcgccttccaggtgtacatgatcaacctggccgtggccgacctgctgtgtgtgtgcaccctgcccctgcgggtggtgtactacgtgcacaagggcatctggctgtttggagacttcctgtgccgcctgagcacctacgccctgtatgtgaacctgtactgcagcatcttcttcatgacagccatgtccttcttccgctgcatcgccatcgtgtttcctgtgcagaacatcaacctggtgacccagaagaaggccaggtttgtgtgtgtgggcatctggatcttcgtcatcctgaccagcagccccttcctgatggccaagccccagaaggatgagaagaacaacaccaagtgctttgagcccccccaggacaaccagaccaagaaccacgtgctggtgctgcactacgtgtccctgtttgtgggcttcatcatccccttcgtcatcatcatcgtgtgctacaccatgatcatcctgaccctgctgaagaagtccatgaagaagaacctgagcagccacaagaaggccatcggcatgatcatggtggtgacagctgccttcctggtgtccttcatgccctaccacatccagaggaccatccacctgcacttcctgcacaatgagaccaagccctgtgacagcgtgctgaggatgcagaagtctgtggtgatcaccctgagcctggccgccagcaactgctgctttgaccccctgctgtacttcttcagcggcggcaacttcaggaagaggctgagcaccttcaggaagcacagcctgagctctgtgacctacgtgcccaggaagaaggccagcctgcctgagaagggggaggagatctgcaaggtgtag

SEQ ID NO: 148941 - DNA, 1041 bp, Artificial Sequence
  Description of Artificial Sequence: Synthetic coding sequence
atggagaggaagttcatgagcctgcagcccagcatctctgtgtctgagatggagcccaacggcaccttcagcaacaacaacagcaggaactgcaccatcgagaacttcaagcgggagttcttccccatcgtgtacctgatcatcttcttctggggcgtgctgggcaatggcctgagcatctacgtgttcctgcagccctacaagaagagcacctctgtgaatgtgttcatgctgaacctggccatcagtgacctgctcttcatcagcaccctgcccttccgggctgactactacctgcggggcagcaactggatctttggagacctggcctgccgcatcatgagctacagcctgtatgtgaacatgtacagcagcatctacttcctgactgtgctgtctgtggtgcgcttcctggccatggtgcaccccttccggctgctgcacgtgaccagcatccgcagcgcctggatcctgtgtggcatcatctggatcctgatcatggccagcagcatcatgctgctggacagcggcagcgagcagaatggatctgtgaccagctgcctggagctgaacctgtacaagatcgccaagctgcagaccatgaactacatcgccctggtggtgggctgcctgctgcccttcttcaccctgagcatctgctacctgctgatcatccgggtgctgctgaaggtggaggtgcctgagagcggcctgcgggtgagccacaggaaggccctgaccaccatcatcatcaccctcatcatcttcttcctgtgcttcctgccctaccacaccctgaggacagtgcacctgaccacctggaaggtgggcctgtgcaaggaccggctgcacaaggccctggtgatcaccctggccctggccgccgccaatgcctgcttcaaccccctgctgtactactttgctggggagaacttcaaggaccggctgaagagcgccctgaggaagggccacccccagaaggccaagaccaagtgtgtgtttcctgtgtctgtgtggctgaggaaggagaccagggtgtag

SEQ ID NO: 148942 - DNA, 2181 bp, Artificial Sequence
  Description of Artificial Sequence: Synthetic coding sequence
atggctgacagcagcggccagcagggcaagggccggcgggtgcagccccagtggagccccccagctggcacccagccctgccgcctgcacctgtacaacagcctgaccaggaacaaggaggtgttcatcccccaggacggcaagaaggtgacctggtactgctgcggccccaccgtgtatgatgccagccacatgggccacgcccggagctacatcagctttgacatcctgcggcgggtgctgaaggactacttcaagtttgatgtgttctactgcatgaacatcacagacattgatgacaagatcatcaagagggcccggcagaaccacctgtttgagcagtaccgggagaagaggcctgaggccgcccagctgctggaggatgtgcaggccgccctgaagcccttctctgtgaagctgaatgagaccacagatcctgacaagaagcagatgctggagcgcatccagcacgctgtgcagctggccacagagcccctggagaaggctgtgcagagccggctgactggagaggaggtgaacagctgtgtggaggtgctgctggaggaggccaaggacctgctgagtgactggctggacagcaccctgggctgtgatgtgacagacaacagcatcttcagcaagctgcccaagttctgggagggggacttccaccgggacatggaggccctgaatgtgctgcccccagatgtgctgaccagggtgtctgaatatgtgcctgagatcgtgaactttgtgcagaagatcgtggacaatggctacggctacgtgtccaatggatctgtgtactttgacacagccaagtttgccagcagcgagaagcacagctatggcaagctggtgcctgaggccgtgggggaccagaaggccctgcaggagggggagggggacctgagcatctctgctgaccggctgtctgagaagaggagccccaatgactttgccctgtggaaggccagcaagccaggagagcccagctggccctgcccctggggcaagggccggcccggctggcacattgaatgttctgccatggccggcaccctgctgggcgcctccatggacatccatggaggcggctttgacctgcgcttcccccaccacgacaatgagctggcccagagcgaggcctactttgaaaatgactgctgggtgcgctacttcctgcacacaggccacctgaccatcgccggctgcaagatgagcaagagcctgaagaacttcatcaccatcaaggatgccctgaagaagcacagcgcccggcagctgcggctggccttcctgatgcacagctggaaggacaccctggactacagcagcaacaccatggagagcgccctgcagtatgagaagttcctgaatgagttcttcctgaatgtgaaggacatcctgcgggcccctgtggacatcaccggccagtttgagaagtggggcgaggaggaggccgagctgaacaagaacttctatgacaagaagacagccatccacaaggccctgtgtgacaacgtggacaccaggacagtgatggaggagatgagggccctggtgtcccagtgcaacctgtacatggccgccaggaaggctgtgaggaagaggcccaaccaggccctgctggagaacatcgccctgtacctgacccacatgctgaagatctttggagctgtggaggaggacagcagcctgggcttccctgtgggcggccctggcaccagcctgagcctggaggccaccgtgatgccctacctgcaggtgctgtctgagttccgggagggcgtgaggaagatcgcccgggagcagaaggtgcctgagatcctgcagctgagtgatgccctgcgggacaacatcctgcctgagctgggcgtgcgctttgaggaccacgagggcctgcccaccgtggtgaagctggtggacaggaacaccctgctgaaggagcgggaggagaagagaagagtggaggaggagaagaggaagaagaaggaggaggccgcccggaggaagcaggagcaggaggccgccaagctggccaagatgaagatcccccccagcgagatgttcctgtctgaaacagacaagtacagcaagtttgatgaaaatgtgtccatggtgtgcccccacatgacctggagggccaagagcagcgccaagggcaagcccaggagctag

SEQ ID NO: 148943 - DNA, 2496 bp, Artificial Sequence
  Description of Artificial Sequence: Synthetic coding sequence
atggctgacagcagcggccagcaggccccagactaccgcagcatcctgagcatcagtgatgaggccgcccgggcccaggccctgaatgagcacctgagcaccaggagctatgtgcagggctacagcctgagccaggctgatgtggatgccttccggcagctgagcgcccctcctgctgacccccagctgttccacgtggcccgctggttccgccacatcgaggccctgctgggcagcccctgtgggaagggccagccctgccgcctgcaggccagcaaaggaagaagagtgcagccccagtggagccccccagctggcacccagccctgccgcctgcacctgtacaacagcctgaccaggaacaaggaggtgttcatcccccaggacggcaagaaggtgacctggtactgctgcggccccaccgtgtatgatgccagccacatgggccacgcccggagctacatcagctttgacatcctgcggcgggtgctgaaggactacttcaagtttgatgtgttctactgcatgaacatcacagacattgatgacaagatcatcaagagggcccggcagaaccacctgtttgagcagtaccgggagaagaggcctgaggccgcccagctgctggaggatgtgcaggccgccctgaagcccttctctgtgaagctgaatgagaccacagatcctgacaagaagcagatgctggagcgcatccagcacgctgtgcagctggccacagagcccctggagaaggctgtgcagagccggctgaccggggaggaggtgaacagctgtgtggaggtgctgctggaggaggccaaggacctgctgagtgactggctggacagcaccctgggctgtgatgtgacagacaacagcatcttcagcaagctgcccaagttctgggagggggacttccaccgggacatggaggccctgaatgtgctgcccccagatgtgctgaccagggtgtctgaatatgtgcctgagatcgtgaactttgtgcagaagatcgtggacaatggctacggctacgtgtccaatggatctgtgtactttgacacagccaagtttgccagcagcgagaagcacagctatggcaagctggtgcctgaggccgtgggggaccagaaggccctgcaggagggggagggggacctgagcatctctgctgaccggctgtctgagaagaggagccccaatgactttgccctgtggaaggccagcaagccaggagagcccagctggccctgcccctggggcaagggccggcccggctggcacatcgagtgcagcgccatggccggcaccctgctgggcgcctccatggacatccacggcggcggctttgacctgcgcttcccccaccacgacaatgagctggcccagagcgaggcctactttgaaaatgactgctgggtgcgctacttcctgcacacaggccacctgaccatcgccggctgcaagatgagcaagagcctgaagaacttcatcaccatcaaggatgccctgaagaagcacagcgcccggcagctgcggctggccttcctgatgcacagctggaaggacaccctggactacagcagcaacaccatggagagcgccctgcagtatgagaagttcctgaatgagttcttcctgaatgtgaaggacatcctgcgggcccctgtggacatcaccggccagtttgagaagtggggcgaggaggaggccgagctgaacaagaacttctatgacaagaagacagccatccacaaggccctgtgtgacaacgtggacaccaggacagtgatggaggagatgagggccctggtgtcccagtgcaacctgtacatggccgccaggaaggctgtgaggaagaggcccaaccaggccctgctggagaacatcgccctgtacctgacccacatgctgaagatctttggagctgtggaggaggacagcagcctgggcttccctgtgggcggccctggcaccagcctgagcctggaggccaccgtgatgccctacctgcaggtgctgtctgagttccgggagggcgtgaggaagatcgcccgggagcagaaggtgcctgagatcctgcagctgagtgatgccctgcgggacaacatcctgcctgagctgggcgtgcgctttgaagatcatgagggcctgcccaccgtggtgaagctggtggacaggaacaccctgctgaaggagcgggaggagaagagaagagtggaggaggagaagaggaagaagaaggaggaggccgcccggaggaagcaggagcaggaggccgccaagctggccaagatgaagatccccccatctgagatgttcctgtctgaaacagacaagtacagcaagtttgatgaaaatggcctgcccacccatgacatggagggcaaggagctgagcaagggccaggccaagaagctgaagaagctgtttgaggcccaggagaagctgtacaaggagtacctgcagatggcccagaatggcagcttccagtag

SEQ ID NO: 148944 - DNA, 2247 bp, Artificial Sequence
  Description of Artificial Sequence: Synthetic coding sequence
atggctgacagcagcggccagcagggcaagggccggcgggtgcagccccagtggagccccccagctggcacccagccctgccgcctgcacctgtacaacagcctgaccaggaacaaggaggtgttcatcccccaggacggcaagaaggtgacctggtactgctgcggccccaccgtgtatgatgccagccacatgggccacgcccggagctacatcagctttgacatcctgcggcgggtgctgaaggactacttcaagtttgatgtgttctactgcatgaacatcacagacattgatgacaagatcatcaagagggcccggcagaaccacctgtttgagcagtaccgggagaagaggcctgaggccgcccagctgctggaggatgtgcaggccgccctgaagcccttctctgtgaagctgaatgagaccacagatcctgacaagaagcagatgctggagcgcatccagcacgctgtgcagctggccacagagcccctggagaaggctgtgcagagccggctgactggagaggaggtgaacagctgtgtggaggtgctgctggaggaggccaaggacctgctgagtgactggctggacagcaccctgggctgtgatgtgacagacaacagcatcttcagcaagctgcccaagttctgggagggggacttccaccgggacatggaggccctgaatgtgctgcccccagatgtgctgaccagggtgtctgaatatgtgcctgagatcgtgaactttgtgcagaagatcgtggacaatggctacggctacgtgtccaatggatctgtgtactttgacacagccaagtttgccagcagcgagaagcacagctatggcaagctggtgcctgaggccgtgggggaccagaaggccctgcaggagggggagggggacctgagcatctctgctgaccggctgtctgagaagaggagccccaatgactttgccctgtggaaggccagcaagccaggagagcccagctggccctgcccctggggcaagggccggcccggctggcacattgaatgttctgccatggccggcaccctgctgggcgcctccatggacatccatggaggcggctttgacctgcgcttcccccaccacgacaatgagctggcccagagcgaggcctactttgaaaatgactgctgggtgcgctacttcctgcacacaggccacctgaccatcgccggctgcaagatgagcaagagcctgaagaacttcatcaccatcaaggatgccctgaagaagcacagcgcccggcagctgcggctggccttcctgatgcacagctggaaggacaccctggactacagcagcaacaccatggagagcgccctgcagtatgagaagttcctgaatgagttcttcctgaatgtgaaggacatcctgcgggcccctgtggacatcaccggccagtttgagaagtggggcgaggaggaggccgagctgaacaagaacttctatgacaagaagacagccatccacaaggccctgtgtgacaacgtggacaccaggacagtgatggaggagatgagggccctggtgtcccagtgcaacctgtacatggccgccaggaaggctgtgaggaagaggcccaaccaggccctgctggagaacatcgccctgtacctgacccacatgctgaagatctttggagctgtggaggaggacagcagcctgggcttccctgtgggcggccctggcaccagcctgagcctggaggccaccgtgatgccctacctgcaggtgctgtctgagttccgggagggcgtgaggaagatcgcccgggagcagaaggtgcctgagatcctgcagctgagtgatgccctgcgggacaacatcctgcctgagctgggcgtgcgctttgaggaccacgagggcctgcccaccgtggtgaagctggtggacaggaacaccctgctgaaggagcgggaggagaagagaagagtggaggaggagaagaggaagaagaaggaggaggccgcccggaggaagcaggagcaggaggccgccaagctggccaagatgaagatcccccccagcgagatgttcctgtctgaaacagacaagtacagcaagtttgatgaaaatggcctgcccacccatgacatggagggcaaggagctgagcaagggccaggccaagaagctgaagaagctgtttgaggcccaggagaagctgtacaaggagtacctgcagatggcccagaatggcagcttccagtag

SEQ ID NO: 148945 - DNA, 2217 bp, Artificial Sequence
  Description of Artificial Sequence: Synthetic coding sequence
atgcagaccccacccctgcagcagccccaccaggagcaggtgttcctggccttcctggtgattgtcatccccagcttcctgaccaaggaggtgttcatcccccaggacggcaagaaggtgacctggtactgctgcggccccaccgtgtatgatgccagccacatgggccacgcccggagctacatcagctttgacatcctgcggcgggtgctgaaggactacttcaagtttgatgtgttctactgcatgaacatcacagacattgatgacaagatcatcaagagggcccggcagaaccacctgtttgagcagtaccgggagaagaggcctgaggccgcccagctgctggaggatgtgcaggccgccctgaagcccttctctgtgaagctgaatgagaccacagatcctgacaagaagcagatgctggagcgcatccagcacgctgtgcagctggccacagagcccctggagaaggctgtgcagagccggctgactggagaggaggtgaacagctgtgtggaggtgctgctggaggaggccaaggacctgctgagtgactggctggacagcaccctgggctgtgatgtgacagacaacagcatcttcagcaagctgcccaagttctgggagggggacttccaccgggacatggaggccctgaatgtgctgcccccagatgtgctgaccagggtgtctgaatatgtgcctgagatcgtgaactttgtgcagaagatcgtggacaatggctacggctacgtgtccaatggatctgtgtactttgacacagccaagtttgccagcagcgagaagcacagctatggcaagctggtgcctgaggccgtgggggaccagaaggccctgcaggagggggagggggacctgagcatctctgctgaccggctgtctgagaagaggagccccaatgactttgccctgtggaaggccagcaagccaggagagcccagctggccctgcccctggggcaagggccggcccggctggcacattgaatgttctgccatggccggcaccctgctgggcgcctccatggacatccatggaggcggctttgacctgcgcttcccccaccacgacaatgagctggcccagagcgaggcctactttgaaaatgactgctgggtgcgctacttcctgcacacaggccacctgaccatcgccggctgcaagatgagcaagagcctgaagaacttcatcaccatcaaggatgccctgaagaagcacagcgcccggcagctgcggctggccttcctgatgcacagctggaaggacaccctggactacagcagcaacaccatggagagcgccctgcagtatgagaagttcctgaatgagttcttcctgaatgtgaaggacatcctgcgggcccctgtggacatcaccggccagtttgagaagtggggcgaggaggaggccgagctgaacaagaacttctatgacaagaagacagccatccacaaggccctgtgtgacaacgtggacaccaggacagtgatggaggagatgagggccctggtgtcccagtgcaacctgtacatggccgccaggaaggctgtgaggaagaggcccaaccaggccctgctggagaacatcgccctgtacctgacccacatgctgaagatctttggagctgtggaggaggacagcagcctgggcttccctgtgggcggccctggcaccagcctgagcctggaggccaccgtgatgccctacctgcaggtgctgtctgagttccgggagggcgtgaggaagatcgcccgggagcagaaggtgcctgagatcctgcagctgagtgatgccctgcgggacaacatcctgcctgagctgggcgtgcgctttgaggaccacgagggcctgcccaccgtggtgaagctggtggacaggaacaccctgctgaaggagcgggaggagaagagaagagtggaggaggagaagaggaagaagaaggaggaggccgcccggaggaagcaggagcaggaggccgccaagctggccaagatgaagatcccccccagcgagatgttcctgtctgaaacagacaagtacagcaagtttgatgaaaatggcctgcccacccatgacatggagggcaaggagctgagcaagggccaggccaagaagctgaagaagctgtttgaggcccaggagaagctgtacaaggagtacctgcagatggcccagaatggcagcttccagtag

SEQ ID NO: 148946 - DNA, 2220 bp, Artificial Sequence
  Description of Artificial Sequence: Synthetic coding sequence
atggagcccaccagcggccccttcagaacagacctgggctaccacctggtgggctgcagcagtggaaaaggaagaagagtgcagccccagtggagccccccagctggcacccagccctgccgcctgcacctgtacaacagcctgaccaggaacaaggaggtgttcatcccccaggacggcaagaaggtgacctggtactgctgcggccccaccgtgtatgatgccagccacatgggccacgcccggagctacatcagctttgacatcctgcggcgggtgctgaaggactacttcaagtttgatgtgttctactgcatgaacatcacagacattgatgacaagatcatcaagagggcccggcagaaccacctgtttgagcagtaccgggagaagaggcctgaggccgcccagctgctggaggatgtgcaggccgccctgaagcccttctctgtgaagctgaatgagaccacagatcctgacaagaagcagatgctggagcgcatccagcacgctgtgcagctggccacagagcccctggagaaggctgtgcagagccggctgaccggggaggaggtgaacagctgtgtggaggtgctgctggaggaggccaaggacctgctgagtgactggctggacagcaccctgggctgtgatgtgacagacaacagcatcttcagcaagctgcccaagttctgggagggggacttccaccgggacatggaggccctgaatgtgctgcccccagatgtgctgaccagggtgtctgaatatgtgcctgagatcgtgaactttgtgcagaagatcgtggacaatggctacggctacgtgtccaatggatctgtgtactttgacacagccaagtttgccagcagcgagaagcacagctatggcaagctggtgcctgaggccgtgggggaccagaaggccctgcaggagggggagggggacctgagcatctctgctgaccggctgtctgagaagaggagccccaatgactttgccctgtggaaggccagcaagccaggagagcccagctggccctgcccctggggcaagggccggcccggctggcacatcgagtgcagcgccatggccggcaccctgctgggcgcctccatggacatccacggcggcggctttgacctgcgcttcccccaccacgacaatgagctggcccagagcgaggcctactttgaaaatgactgctgggtgcgctacttcctgcacacaggccacctgaccatcgccggctgcaagatgagcaagagcctgaagaacttcatcaccatcaaggatgccctgaagaagcacagcgcccggcagctgcggctggccttcctgatgcacagctggaaggacaccctggactacagcagcaacaccatggagagcgccctgcagtatgagaagttcctgaatgagttcttcctgaatgtgaaggacatcctgcgggcccctgtggacatcaccggccagtttgagaagtggggcgaggaggaggccgagctgaacaagaacttctatgacaagaagacagccatccacaaggccctgtgtgacaacgtggacaccaggacagtgatggaggagatgagggccctggtgtcccagtgcaacctgtacatggccgccaggaaggctgtgaggaagaggcccaaccaggccctgctggagaacatcgccctgtacctgacccacatgctgaagatctttggagctgtggaggaggacagcagcctgggcttccctgtgggcggccctggcaccagcctgagcctggaggccaccgtgatgccctacctgcaggtgctgtctgagttccgggagggcgtgaggaagatcgcccgggagcagaaggtgcctgagatcctgcagctgagtgatgccctgcgggacaacatcctgcctgagctgggcgtgcgctttgaagatcatgagggcctgcccaccgtggtgaagctggtggacaggaacaccctgctgaaggagcgggaggagaagagaagagtggaggaggagaagaggaagaagaaggaggaggccgcccggaggaagcaggagcaggaggccgccaagctggccaagatgaagatccccccatctgagatgttcctgtctgaaacagacaagtacagcaagtttgatgaaaatgtgtccatggtgtgcccccacatgacctggagggccaagagcagcgccaagggcaagcccaggagctag

SEQ ID NO: 148947 - DNA, 1695 bp, Artificial Sequence
  Description of Artificial Sequence: Synthetic coding sequence
atgctgcggaccacccggggccctggcctgggcccccccctgctgcaggccgccctgggcctgggccgggccggctggcactggccagctggccgggccgccagcggcggccggggccgggcctggctgcagcccaccggccgggagaccggggtgcaggtgtacaacagcctgactggaaggaaggagcccctcatcgtggcccacgccgaggccgcctcctggtacagctgtggccccaccgtgtatgaccacgcccacctgggccacgcctgcagctatgtgcgctttgacatcatccgccgcatcctgaccaaggtgtttggctgcagcatcgtgatggtgatgggcatcacagatgtggatgacaagatcatcaagagggccaatgagatgaacatcagccctgccagcctggccagcctgtatgaggaggacttcaagcaggacatggccgccctgaaggtgctgccccccaccgtgtacctgcgggtgacagagaacatcccccagatcatctccttcatcgagggcatcatcgcccggggaaatgcctacagcacagccaagggaaatgtgtactttgacctgaagagcagaggagacaagtatggcaagctggtgggcgtggtgcccggccctgtgggggagcctgctgacagcgacaagagacatgccagtgactttgccctgtggaaggccgccaagccccaggaggtgttctgggccagcccctggggccctggccggcccggctggcacatcgagtgcagcgccatcgcctccatggtgtttggcagccagctggacatccacagcggcggcatcgacctggccttcccccaccatgaaaatgaaattgcccagtgtgaggtgttccaccagtgtgagcagtggggcaactacttcctgcacagcggccacctgcacgccaagggcaaggaggagaagatgagcaagagcctgaagaactacatcaccatcaaggacttcctgaagaccttctccccagatgtgttccgcttcttctgcctgcggagcagctacagaagtgccatcgactacagcgacagcgccatgctgcaggcccagcagctgctgctgggcctgggcagcttcctggaggatgcccgggcctacatgaagggccagctggcctgtggctctgtgcgggaggccatgctgtgggagcggctgagcagcaccaagagagctgtgaaggccgccctggctgatgactttgacaccccccgggtggtggatgccatcctgggcctggcccaccacggcaatggccagctgcgggccagcctgaaggagcctgagggccccaggagccctgctgtgtttggagccatcatctcctactttgagcagttctttgaaacagtgggcatcagcctggccaaccagcagtatgtgtctggagatggcagcgaggccaccctgcacggcgtggtggatgagctggtgcgcttccggcagaaggtgcggcagtttgccctggccatgcctgaggccactggagatgcccggcggcagcagctgctggagcggcagcccctgctggaggcctgtgacaccctgcggcggggcctgacagcccacggcatcaacatcaaggacaggagcagcaccaccagcacctgggagctgctggaccagaggaccaaggaccagaagtctgctggatag

SEQ ID NO: 148948 - DNA, 549 bp, Artificial Sequence
  Description of Artificial Sequence: Synthetic coding sequence
atggtgtttggcagccagctggacatccacagcggcggcatcgacctggccttcccccaccatgaaaatgaaattgcccagtgtgaggtgttccaccagtgtgagcagtggggcaactacttcctgcacagcggccacctgcacgccaagggcaaggaggagaagatgagcaagagcctgaagaactacatcaccatcaaggacttcctgaagaccttctccccagatgtgttccgcttcttctgcctgcggagcagctacagaagtgccatcgactacagcgacagcgccatgctgcaggcccagcagctgctgctgggcctgggcagcttcctggaggatgcccgggcctacatgaagggccagctggcctgtggctctgtgcgggaggccatgctgtgggagcggctgagcagcaccaagagagctgtgaaggccgccctggctgatgactttgacaccccccgggtggtggatgccatcctgggcctggcccaccacggcaatggccagctgcgggccagcctgaagaagccaggcagcgcctag

SEQ ID NO: 148949 - DNA, 441 bp, Artificial Sequence
  Description of Artificial Sequence: Synthetic coding sequence
atggcccagaagaggcctgcctgcaccctgaagccagaatgtgtgcagcagctgctggtgtgcagccaggaggccaagaagagcgcctactgcccctacagccacttccctgtgggcgccgccctgctgacccaggagggccgcatcttcaagggctgcaacattgaaaatgcctgctaccccctgggcatctgtgccgagaggacagccatccagaaggctgtgtctgagggctacaaggacttccgggccatcgccatcgccagtgacatgcaggatgacttcatcagcccctgtggggcctgccggcaggtgatgagggagtttggcaccaactggcctgtgtacatgaccaagccagatggcacctacatcgtgatgacagtgcaggagctgctgcccagcagctttggacctgaggacctgcagaagacccagtag

SEQ ID NO: 148950 - DNA, 687 bp, Artificial Sequence
  Description of Artificial Sequence: Synthetic coding sequence
atgctgagccgctgccgcagcggcctgctgcacgtgctgggcctgtccttcctgctgcagacccggcggcccatcctgctgtgcagcccccggctgatgaagcccctggtggtgtttgtgctgggcggccctggggccggcaagggcacccagtgtgccagaattgtggagaagtatggctacacccacctgtctgctggggagctgctgagagatgagaggaagaacccagacagccagtatggagagctgattgagaagtacatcaaggagggcaagatcgtgcctgtggagatcaccatcagcctgctgaagcgggagatggaccagaccatggccgccaatgcccagaagaacaagttcctgattgatggcttccccaggaaccaggacaacctgcagggctggaacaagaccatggatggcaaggcagatgtgtcctttgtgctcttctttgactgcaacaatgagatctgcatcgagcgctgcctggagcggggcaagagcagcggccgcagtgatgacaaccgggagagcctggagaagaggatccagacctacctgcagagcaccaagcccatcatcgacctgtatgaggagatgggcaaggtgaagaagattgatgccagcaagtctgtggatgaggtgtttgatgaggtggtgcagatctttgacaaggagggctag

SEQ ID NO: 148951 - DNA, 540 bp, Artificial Sequence
  Description of Artificial Sequence: Synthetic coding sequence
atgctgagccgctgccgcagcggcctgctgcacgtgctgggcctgtccttcctgctgcagacccggcggcccatcctgctgtgcagcccccggctgatgaagcccctggtggtgtttgtgctgggcggccctggggccggcaagggcacccagtgtgccagaattgtggaggagatggaccagaccatggccgccaatgcccagaagaacaagttcctgattgatggcttccccaggaaccaggacaacctgcagggctggaacaagaccatggatggcaaggcagatgtgtcctttgtgctcttctttgactgcaacaatgagatctgcatcgagcgctgcctggagcggggcaagagcagcggccgcagtgatgacaaccgggagagcctggagaagaggatccagacctacctgcagagcaccaagcccatcatcgacctgtatgaggagatgggcaaggtgaagaagattgatgccagcaagtctgtggatgaggtgtttgatgaggtggtgcagatctttgacaaggagggctag

SEQ ID NO: 148952 - DNA, 1230 bp, Artificial Sequence
  Description of Artificial Sequence: Synthetic coding sequence
atggcctttgcccggcggctgctgcggggccccctgagcggccccctgctgggcagaagaggagtgtgtgccggggccatggcccccccaagaagatttgtgctggagctgcctgactgcaccctggcccactttgccctgggcgcagatgcccctggagatgctgatgccccagacccccggctggccgccctgctgggccccccagagaggagctacagcctgtgtgtgcctgtgaccccagatgctggctgtggggcccgggtgcgggccgcccggctgcaccagaggctgctgcaccagctgcggcggggccccttccagcgctgccagctgctgcggctgctgtgctactgccctgggggccaggccggcggggcccagcagggcttcctgctgcgggaccccctggatgatcctgacacccggcaggccctgctggagctgctgggcgcctgccaggaggccccccggccccacctgggggagtttgaggccgacccccggggccagctgtggcagaggctgtgggaggtgcaggatggaagaaggctgcaggtgggctgtgcccaggtggtgcctgtgcctgagccccccctgcaccctgtggtgcctgacctgcccagctctgtggtgtttcctgaccgggaggccgcccgggctgtgctggaggagtgcaccagcttcatccctgaggcccgggctgtgctggacctggtggaccagtgccccaagcagatccagaagggcaagttccaggtggtggccatcgagggcctggatgccaccgggaagaccaccgtgacccagagcgtggccgacagcctgaaggctgtgctgctgaagagcccccccagctgcatcggccagtggaggaagatctttgatgatgagcccaccatcatcagaagagccttctacagcctgggcaactacatcgtggccagcgagatcgccaaggagagcgccaagagccctgtgattgtggaccgctactggcacagcacagccacctacgccatcgccacagaggtgtctgggggcctgcagcacctgcccccagcccaccaccctgtgtaccagtggccagaggacctgctgaagccagacctgatcctgctgctgactgtgtccccagaggagcggctgcagaggctgcagggccggggcatggagaagacccgggaggaggccgagctggaggccaacagcgtcttccggcagaagtag

SEQ ID NO: 148953 - DNA, 1350 bp, Artificial Sequence
  Description of Artificial Sequence: Synthetic coding sequence
atggcctttgcccggcggctgctgcggggccccctgagcggccccctgctgggcagaagaggagtgtgtgccggggccatggcccccccaagaagatttgtgctggagctgcctgactgcaccctggcccactttgccctgggcgcagatgcccctggagatgctgatgccccagacccccggctggccgccctgctgggccccccagagaggagctacagcctgtgtgtgcctgtgaccccagatgctggctgtggggcccgggtgcgggccgcccggctgcaccagaggctgctgcaccagctgcggcggggccccttccagcgctgccagctgctgcggctgctgtgctactgccctgggggccaggccggcggggcccagcagggcttcctgctgcgggaccccctggatgatcctgacacccggcaggccctgctggagctgctgggcgcctgccaggaggccccccggccccacctgggggagtttgaggccgacccccggggccagctgtggcagaggctgtgggaggtgcaggatggaagaaggctgcaggtgggctgtgcccaggtggtgcctgtgcctgagccccccctgcaccctgtggtgcctgacctgcccagctctgtggtgtttcctgaccgggaggccgcccgggctgtgctggaggagtgcaccagcttcatccctgaggcccgggctgtgctggacctggtggaccagtgccccaagcagatccagaagggcaagttccaggtggtggccatcgagggcctggatgccaccgggaagaccaccgtgacccagagcgtggccgacagcctgaaggctgtgctgctgaagagcccccccagctgcatcggccagtggaggaagatctttgatgatgagcccaccatcatcagaagagccttctacagcctgggcaactacatcgtggccagcgagatcgccaaggagagcgccaagagccctgtgattgtggaccgctactggcacagcacagccacctacgccatcgccacagaggtgtctgggggcctgcagcacctgcccccagcccaccaccctgtgtaccagtggccagaggacctgctgaagccagacctgatcctgctgctgactgtgtccccagaggagcggctgcagaggctgcagggccggggcatggagaagacccgggaggaggccgagctggaggccaacagcgtcttccggcagaaggtggagatgagctaccagaggatggagaaccctggctgccacgtggtggatgccagccccagccgggagaaggtgctgcagacagtgctgagcctcatccagaacagcttcagcgagccctag

SEQ ID NO: 148954 - DNA, 1101 bp, Artificial Sequence
  Description of Artificial Sequence: Synthetic coding sequence
atggcctttgcccggcggctgctgcggggccccctgagcggccccctgctgggcagaagaggagtgtgtgccggggccatggcccccccaagaagatttgtgctggagctgcctgactgcaccctggcccactttgccctgggcgcagatgcccctggagatgctgatgccccagacccccggctggccgccctgctgggccccccagagaggagctacagcctgtgtgtgcctgtgaccccagatgctggctgtggggcccgggtgcgggccgcccggctgcaccagaggctgctgcaccagctgcggcggggccccttccagcgctgccagctgctgcggctgctgtgctactgccctgggggccaggccggcggggcccagcagggcttcctgctgcgggaccccctggatgatcctgacacccggcaggccctgctggagctgctgggcgcctgccaggaggccccccggccccacctgggggagtttgaggccgacccccggggccagctgtggcagaggctgtgggaggtgcaggatggaagaaggctgcaggtgggctgtgcccaggtggtgcctgtgcctgagccccccctgcaccctgtggtgcctgacctgcccagctctgtggtgtttcctgaccgggaggccgcccgggctgtgctggaggagtgcaccagcttcatccctgaggcccgggctgtgctggacctggtggaccagtgccccaagcagatccagaagggcaagttccaggtggtggccatcgagggcctggatgccaccgggaagaccaccgtgacccagagcgtggccgacagcctgaaggctgtgctgctgaagagcccccccagctgcatcggccagtggaggaagatctttgatgatgagcccaccatcatcagaagagccttctacagcctgggcaactacatcgtggccagcgagatcgccaaggagagcgccaagagccctgtgattgtggacaggagccagctgggcggcaccctgtaccaccccagcctgcacctgctgggcagcgaggtgtgtggcaccggcatcctggacagcagccacagcagccagggcctggagtag

SEQ ID NO: 148955 - DNA, 813 bp, Artificial Sequence
  Description of Artificial Sequence: Synthetic coding sequence
atgggcaacaccagcagcgagagagctgccctggagcggcacggcggccacaagaccccaagaagagacagcagcggcggcaccaaggatggagaccggcccaagatcctgatggacagcccagaagatgctgacctcttccacagcgaggagatcaaggcccctgagaaggaggagttcctggcctggcagcacgacctggaggtgaatgacaaggccccagcccaggcccggcccaccgtcttccgctggacaggaggcggcaaggaggtgtacctgagcggcagcttcaacaactggagcaagctgcccctgaccaggagccacaacaactttgtggccatcctggacctgcctgagggggagcaccagtacaagttctttgtggatggccagtggacccatgaccccagcgagcccatcgtgaccagccagctgggcaccgtgaacaacatcatccaggtgaagaagacagactttgaggtgtttgatgccctgatggtggacagccagaagtgcagtgatgtgtctgagctgagcagcagccccccaggcccctaccaccaggagccctacgtgtgcaagccagaggagcgcttccgggccccacccatcctgcccccccacctgctgcaggtgatcctgaacaaggacaccggcatcagctgtgaccctgccctgctgcctgagcccaaccacgtgatgctgaaccacctgtatgccctgagcatcaaggatggagtgatggtgctgagcgccacccaccgctacaagaagaagtatgtgaccaccctgctgtacaagcccatctag

SEQ ID NO: 148956 - DNA, 588 bp, Artificial Sequence
  Description of Artificial Sequence: Synthetic coding sequence
atgggccagatcgagtgggccatgtgggccaatgagcaggccctggccagcggcctcatcctgatcactggaggcatcgtggccacagctggccgcttcacccagtggtactttggagcctacagcatcgtggccggcgtgtttgtgtgcctgctggagtacccccggggcaagaggaagaagggcagcaccatggagcgctggggccagaagtacatgacagctgtggtgaagctgtttggccccttcaccaggaactactacgtgcgggctgtgctgcacctgctgctgtctgtgcctgctggcttcctgctggccaccatcctgggcacagcctgcctggccatcgccagcggcatctacctgctggccgctgtgcggggggagcagtggacccccatcgagcccaagccccgggagcggccccagatcggcggcaccatcaagcagccccccagcaaccccccacccaggcctcctgctgaggccaggaagaagcccagcgaggaggaggccgctgtggccgccggcggccccccaggcggcccccaggtgaaccccatccctgtgacagatgaggtggtgtag

SEQ ID NO: 148957 - DNA, 1713 bp, Artificial Sequence
  Description of Artificial Sequence: Synthetic coding sequence
atgggcaactgggccgtgaatgaaggcctgagcatctttgtgatcctggtgtggctgggcctgaatgtgttcctgtttgtgtggtactacagagtgtatgacatcccccccaagttcttctacaccaggaagctgctgggcagcgccctggccctggcccgggccccagctgcctgcctgaacttcaactgcatgctgatcctgctgcctgtgtgcaggaacctgctgtccttcctgcggggcagcagcgcctgctgcagcaccagggtgcggcggcagctggacaggaacctgaccttccacaagatggtggcctggatgattgccctgcacagcgccatccacaccatcgcccacctgttcaacgtggagtggtgtgtgaatgcccgggtgaacaacagcgacccctacagcgtggccctgtctgagctgggggaccggcagaatgaaagctacctgaactttgccaggaagaggatcaagaaccctgagggcggcctgtacctggccgtgaccctgctggccggcatcaccggggtggtgatcaccctgtgcctgatcctgatcatcaccagcagcaccaagaccatccgccgcagctactttgaggtgttctggtacacccaccacctgtttgtgatcttcttcatcggcctggccatccacggggctgagagaattgtgcggggccagacagctgagagcctggccgtgcacaacatcaccgtgtgtgagcagaagatcagcgagtggggcaagatcaaggagtgccccatcccccagtttgctggcaacccccccatgacctggaagtggatcgtgggccccatgttcctgtacctgtgtgagcggctggtgcgcttctggaggagccagcagaaggtggtgatcaccaaggtggtgacccaccccttcaagaccatcgagctgcagatgaagaagaagggcttcaagatggaggtgggccagtacatctttgtgaagtgccccaaggtgtccaagctggagtggcaccccttcaccctgaccagcgcccctgaggaggacttcttcagcatccacatcagaattgtgggggactggacagagggcctcttcaatgcctgtggctgtgacaagcaggagttccaggatgcctggaagctgcccaagattgctgtggatggcccctttggaacagcctctgaagatgtgttctcctatgaggtggtgatgctggtgggcgccggcattggagtgaccccatttgccagcatcctgaagtctgtgtggtacaagtactgcaacaatgccaccaacctgaagctgaagaagatctacttctactggctgtgccgggacacccacgcctttgagtggtttgctgacctgctgcagctgctggagagccagatgcaggagaggaacaatgccggcttcctgagctacaacatctacctgaccggctgggatgagagccaggccaaccactttgctgtgcaccatgatgaggagaaggatgtgatcaccggcctgaagcagaagaccctgtatggccggcccaactgggacaatgagttcaagaccatcgccagccagcaccccaacacccgcatcggggtcttcctgtgtggccctgaggccctggccgagaccctgagcaagcagagcatcagcaacagcgagagcggcccccggggcgtgcacttcatcttcaacaaggagaacttctag

SEQ ID NO: 148958 - DNA, 912 bp, Artificial Sequence
  Description of Artificial Sequence: Synthetic coding sequence
atgacctggaagtggatcgtgggccccatgttcctgtacctgtgtgagcggctggtgcgcttctggaggagccagcagaaggtggtgatcaccaaggtggtgacccaccccttcaagaccatcgagctgcagatgaagaagaagggcttcaagatggaggtgggccagtacatctttgtgaagtgccccaaggtgtccaagctggagtggcaccccttcaccctgaccagcgcccctgaggaggacttcttcagcatccacatccgcatcgtgggggactggacagagggcctcttcaatgcctgtggctgtgacaagcaggagttccaggatgcctggaagctgcccaagattgctgtggatggccccttcggcacagcctctgaagatgtgttctcctatgaggtggtgatgctggtgggcgccggcatcggcgtgaccccatttgccagcatcctgaagtctgtgtggtacaagtactgcaacaatgccaccaacctgaagctgaagaagatctacttctactggctgtgccgggacacccacgcctttgagtggtttgctgacctgctgcagctgctggagagccagatgcaggagagaaataatgccggcttcctgagctacaacatctacctgaccggctgggatgagagccaggccaaccactttgctgtgcaccatgatgaggagaaggatgtgatcaccggcctgaagcagaagaccctgtatggccggcccaactgggacaatgagttcaagaccatcgccagccagcaccccaacaccagaattggagtcttcctgtgtggccctgaggccctggccgagaccctgagcaagcagagcatcagcaacagcgagagcggcccccggggcgtgcacttcatcttcaacaaggagaacttctag

SEQ ID NO: 148959 - DNA, 1617 bp, Artificial Sequence
  Description of Artificial Sequence: Synthetic coding sequence
atgggcaactgggccgtgaatgaaggcctgagcatctttgtgatcagcgccctggccctggcccgggccccagctgcctgcctgaacttcaactgcatgctgatcctgctgcctgtgtgcaggaacctgctgtccttcctgcggggcagcagcgcctgctgcagcaccagggtgcggcggcagctggacaggaacctgaccttccacaagatggtggcctggatgattgccctgcacagcgccatccacaccatcgcccacctgttcaacgtggagtggtgtgtgaatgcccgggtgaacaacagcgacccctacagcgtggccctgtctgagctgggggaccggcagaatgaaagctacctgaactttgccaggaagaggatcaagaaccctgagggcggcctgtacctggccgtgaccctgctggccggcatcaccggggtggtgatcaccctgtgcctgatcctgatcatcaccagcagcaccaagaccatccgccgcagctactttgaggtgttctggtacacccaccacctgtttgtgatcttcttcatcggcctggccatccacggggctgagagaattgtgcggggccagacagctgagagcctggccgtgcacaacatcaccgtgtgtgagcagaagatcagcgagtggggcaagatcaaggagtgccccatcccccagtttgctggcaacccccccatgacctggaagtggatcgtgggccccatgttcctgtacctgtgtgagcggctggtgcgcttctggaggagccagcagaaggtggtgatcaccaaggtggtgacccaccccttcaagaccatcgagctgcagatgaagaagaagggcttcaagatggaggtgggccagtacatctttgtgaagtgccccaaggtgtccaagctggagtggcaccccttcaccctgaccagcgcccctgaggaggacttcttcagcatccacatcagaattgtgggggactggacagagggcctcttcaatgcctgtggctgtgacaagcaggagttccaggatgcctggaagctgcccaagattgctgtggatggcccctttggaacagcctctgaagatgtgttctcctatgaggtggtgatgctggtgggcgccggcattggagtgaccccatttgccagcatcctgaagtctgtgtggtacaagtactgcaacaatgccaccaacctgaagctgaagaagatctacttctactggctgtgccgggacacccacgcctttgagtggtttgctgacctgctgcagctgctggagagccagatgcaggagaggaacaatgccggcttcctgagctacaacatctacctgaccggctgggatgagagccaggccaaccactttgctgtgcaccatgatgaggagaaggatgtgatcaccggcctgaagcagaagaccctgtatggccggcccaactgggacaatgagttcaagaccatcgccagccagcaccccaacacccgcatcggggtcttcctgtgtggccctgaggccctggccgagaccctgagcaagcagagcatcagcaacagcgagagcggcccccggggcgtgcacttcatcttcaacaaggagaacttctag

SEQ ID NO: 148960 - DNA, 714 bp, Artificial Sequence
  Description of Artificial Sequence: Synthetic coding sequence
atgaacagcagaagaagagagcccatcaccctgcaggaccctgaggccaagtaccccctgcccctgattgagaaggagaagatcagccacaacacccggcgcttccgcttcggcctgcccagcccagaccacgtgctgggcctgcctgtgggcaactacgtgcagctgctggccaagattgacaatgagctggtggtgcgggcctacacccctgtgtccagtgatgatgaccggggctttgtggacctgatcatcaagatctacttcaagaatgtgcacccccagtacccagagggcggcaagatgacccagtacctggagaacatgaagattggagagaccatcttcttccggggcccccggggccgcctcttctaccacggccctggcaacctgggcatccggccagaccagaccagcgagcccaagaagaccctggccgaccacctgggcatgattgctgggggcaccggcatcacccccatgctgcagctgatccgccacatcaccaaggaccccagcgacaggaccaggatgagcctcatctttgccaaccagacagaggaggacatcctggtgaggaaggagctggaggagatcgcccggacccacccagaccagttcaacctgtggtacaccctggacaggcctcccatcggcccctggagcgctgagggcgccaccctgctgagcaacagcgcccagttccactag

SEQ ID NO: 148961 - DNA, 831 bp, Artificial Sequence
  Description of Artificial Sequence: Synthetic coding sequence
atgaacagcagaagaagagagcccatcaccctgcaggaccctgaggccaagtaccccctgcccctgattgagaaggagaagatcagccacaacacccggcgcttccgcttcggcctgcccagcccagaccacgtgctgggcctgcctgtgggcaactacgtgcagctgctggccaagattgacaatgagctggtggtgcgggcctacacccctgtgtccagtgatgatgaccggggctttgtggacctgatcatcaagatctacttcaagaatgtgcacccccagtacccagagggcggcaagatgacccagtacctggagaacatgaagattggagagaccatcttcttccggggcccccggggccgcctcttctaccacggccctggcaacctgggcatccggccagaccagaccagcgagcccaagaagaccctggccgaccacctgggcatgattgctgggggcaccggcatcacccccatgctgcagctgatccgccacatcaccaaggaccccagcgacaggaccaggatgagcctcatctttgccaaccagacagaggaggacatcctggtgaggaaggagctggaggagatcgcccggacccacccagaccagttcaacctgtggtacaccctggacaggcctcccatcggctggaagtacagcagcggctttgtgacagctgacatgatcaaggagcacctgcccccaccagccaagagcaccctcatcctggtgtgtggccccccacccctcatccagacagctgcccaccccaacctggagaagctgggctacacccaggacatgatcttcacctactag

SEQ ID NO: 148962 - DNA, 351 bp, Artificial Sequence
  Description of Artificial Sequence: Synthetic coding sequence
atgaacagcagaagaagagagcccatcaccctgcaggaccctgaggccaagtaccccctgcccctgattgagaaggagaagatcagccacaacacccggcgcttccgcttcggcctgcccagcccagaccacgtgctgggcctgcctgtgggcaactacgtgcagctgctggccaagattgacaatgagctggtggtgcgggcctacacccctgtgtccagtgatgatgaccggggctttgtggacctgatcatcaagatctacttcaagaatgtgcacccccagtacccagagggcggcaagatgacccagtacctggagaacatgaagattggagagaccatcttctag

SEQ ID NO: 148963 - DNA, 714 bp, Artificial Sequence; identical to SEQ ID NO: 148960
  Description of Artificial Sequence: Synthetic coding sequence

SEQ ID NO: 148964 - DNA, 441 bp, Artificial Sequence
  Description of Artificial Sequence: Synthetic coding sequence
atgaacagcagaagaagagagcccatcaccctgcaggaccctgaggccaagtaccccctgcccctgattgagaaggagaagatcagccacaacacccggcgcttccgcttcggcctgcccagcccagaccacgtgctgggcctgcctgtgggcaactacgtgcagctgctggccaagattgacaatgagctggtggtgcgggcctacacccctgtgtccagtgatgatgaccggggctttgtggacctgatcatcaagatctacttcaagaatgtgcacccccagtacccagagggcggcaagatgacccagtacctggagaacatgaagattggagagaccatcttcttccggggcccccggggccgcctcttctaccacggccctggcaacctgggcatccggccagaccagaccagcgagcccaagaagaccctgtag

SEQ ID NO: 148965 - DNA, 516 bp, Artificial Sequence
  Description of Artificial Sequence: Synthetic coding sequence
atgaacagcagaagaagagagcccatcaccctgcaggaccctgaggccaagtaccccctgcccctgattgagaaggagaagatcagccacaacacccggcgcttccgcttcggcctgcccagcccagaccacgtgctgggcctgcctgtgggcaactacgtgcagctgctggccaagattgacaatgagctggtggtgcgggcctacacccctgtgtccagtgatgatgaccggggctttgtggacctgatcatcaagatctacttcaagaatgtgcacccccagtacccagagggcggcaagatgacccagtacctggagaacatgaagattggagagaccatcttcttccggggcccccggggccgcctcttctaccacggccctggcaacctgggcatccggccagaccagaccagcgagcccaagaagaccctggccgaccacctgggcatgattgctgggggcaccggcatcacccccatgctgcagctgatccgccacatcaccaagtag

SEQ ID NO: 148966 - DNA, 831 bp, Artificial Sequence; identical to SEQ ID NO: 148961
  Description of Artificial Sequence: Synthetic coding sequence

SEQ ID NO: 148967 - DNA, 906 bp, Artificial Sequence
  Description of Artificial Sequence: Synthetic coding sequence
atgggcgcccagctgagcaccctgggccacatggtgctcttccctgtgtggttcctgtacagcctgctgatgaagctgttccagaggagcaccccagccatcaccctggagagcccagacatcaagtaccccctgcggctgattgaccgggagatcatcagccatgacacccggcgcttccgctttgccctgcccagcccccagcacatcctgggcctgcctgtgggccagcacatctacctgagcgccagaattgatggcaacctggtggtgcggccctacacccccatcagcagtgatgatgacaagggctttgtggacctggtgatcaaggtgtacttcaaggacacccaccccaagtttcctgctgggggcaagatgagccagtacctggagagcatgcagatcggggacaccatcgagttccggggccccagcggcctgctggtgtaccagggcaagggcaagtttgccatccggccagacaagaagagcaaccccatcatcagaacagtgaagtctgtgggcatgattgctgggggcaccggcatcacccccatgctgcaggtgatccgggccatcatgaaggaccctgatgaccacacagtgtgccacctgctgtttgccaaccagacagagaaggacatcctgctgcggcctgagctggaggagctgaggaacaagcacagcgcccgcttcaagctgtggtacaccctggaccgggcccctgaggcctgggactatggccagggctttgtgaatgaggagatgatccgggaccacctgcccccacctgaggaggagcccctggtgctgatgtgtggccccccacccatgatccagtatgcctgcctgcccaacctggaccacgtgggccaccccacagagcgctgctttgtgttctag

SEQ ID NO: 148968 - DNA, 1005 bp, Artificial Sequence
  Description of Artificial Sequence: Synthetic coding sequence
atgaacagaagcctgctggtgggctgcatgcagagcaaggacatctggggccgggaggagagcatctgtgagcggctgaagcaggacggcctggatgtggagcgggcagagagctgggagctgggccacatggtgctcttccctgtgtggttcctgtacagcctgctgatgaagctgttccagaggagcaccccagccatcaccctggagagcccagacatcaagtaccccctgcggctgattgaccgggagatcatcagccatgacacccggcgcttccgctttgccctgcccagcccccagcacatcctgggcctgcctgtgggccagcacatctacctgagcgccagaattgatggcaacctggtggtgcggccctacacccccatcagcagtgatgatgacaagggctttgtggacctggtgatcaaggtgtacttcaaggacacccaccccaagtttcctgctgggggcaagatgagccagtacctggagagcatgcagattggagacaccatcgagttccggggccccagcggcctgctggtgtaccagggcaagggcaagtttgccatccggccagacaagaagagcaaccccatcatcagaacagtgaagtctgtgggcatgattgctgggggcaccggcatcacccccatgctgcaggtgatccgggccatcatgaaggaccctgatgaccacacagtgtgccacctgctgtttgccaaccagacagagaaggacatcctgctgcggcctgagctggaggagctgaggaacaagcacagcgcccgcttcaagctgtggtacaccctggaccgggcccctgaggcctgggactatggccagggctttgtgaatgaggagatgatccgggaccacctgcccccacctgaggaggagcccctggtgctgatgtgtggccccccacccatgatccagtatgcctgcctgcccaacctggaccacgtgggccaccccacagagcgctgctttgtgttctag

SEQ ID NO: 148969 - DNA, 837 bp, Artificial Sequence
  Description of Artificial Sequence: Synthetic coding sequence
atgaagctgttccagaggagcaccccagccatcaccctggagagcccagacatcaagtaccccctgcggctgattgaccgggagatcatcagccatgacacccggcgcttccgctttgccctgcccagcccccagcacatcctgggcctgcctgtgggccagcacatctacctgagcgccagaattgatggcaacctggtggtgcggccctacacccccatcagcagtgatgatgacaagggctttgtggacctggtgatcaaggtgtacttcaaggacacccaccccaagtttcctgctgggggcaagatgagccagtacctggagagcatgcagattggagacaccatcgagttccggggccccagcggcctgctggtgtaccagggcaagggcaagtttgccatccggccagacaagaagagcaaccccatcatcagaacagtgaagtctgtgggcatgattgctgggggcaccggcatcacccccatgctgcaggtgatccgggccatcatgaaggaccctgatgaccacacagtgtgccacctgctgtttgccaaccagacagagaaggacatcctgctgcggcctgagctggaggagctgaggaacaagcacagcgcccgcttcaagctgtggtacaccctggaccgggcccctgaggcctgggactatggccagggctttgtgaatgaggagatgatccgggaccacctgcccccacctgaggaggagcccctggtgctgatgtgtggccccccacccatgatccagtatgcctgcctgcccaacctggaccacgtgggccaccccacagagcgctgctttgtgttctag

SEQ ID NO: 148970 - DNA, 837 bp, Artificial Sequence; identical to SEQ ID NO: 148969
  Description of Artificial Sequence: Synthetic coding sequence

SEQ ID NO: 148971 - DNA, 837 bp, Artificial Sequence; identical to SEQ ID NO: 148969
  Description of Artificial Sequence: Synthetic coding sequence

SEQ ID NO: 148972 - DNA, 837 bp, Artificial Sequence; identical to SEQ ID NO: 148969
  Description of Artificial Sequence: Synthetic coding sequence

SEQ ID NO: 148973 - DNA, 444 bp, Artificial Sequence
  Description of Artificial Sequence: Synthetic coding sequence
atgaagctgttccagaggagcaccccagccatcaccctggagagcccagacatcaagtaccccctgcggctgattgaccgggagatcatcagccatgacacccggcgcttccgctttgccctgcccagcccccagcacatcctgggcctgcctgtgggccagcacatctacctgagcgccagaattgatggcaacctggtggtgcggccctacacccccatcagcagtgatgatgacaagggctttgtggacctggtgatcaaggtgtacttcaaggacacccaccccaagtttcctgctgggggcaagatgagccagtacctggagagcatgcagattggagacaccatcgagttccggggccccagcggcctgctggtgtaccagggcaagggcaagtttgccatccggccagacaagaagagcaaccccatcatcagatag

SEQ ID NO: 148974 - DNA, 330 bp, Artificial Sequence
  Description of Artificial Sequence: Synthetic coding sequence
atggactggatccggctgaccaagagcggcaaggacctgaccggcctgaagggccgcctgattgaggtgacagaggaggagctgaagaagcacaacaagaaggatgactgctggatctgcatccggggctttgtgtacaacgtgagcccctacatggagtaccaccctggaggagaagatgagctgatgagagctgctggcagtgatggaacagagctgtttgaccaggtgcaccgctgggtgaactatgaatccatgctgaaggaatgtctggtgggccgcatggccatcaagccagctgtgctgaagggcaagctgtggcacctgtag

SEQ ID NO: 148975 - DNA, 1566 bp, Artificial Sequence
  Description of Artificial Sequence: Synthetic coding sequence
atgctgaatgtgcccagccagagcttccctgcccccaggagccagcagagggtggccagcggcggccgcagcaaggtgcccctgaagcagggccgcagcctgatggactggatccggctgaccaagagcggcaaggacctgaccggcctgaagggccgcctgattgaggtgacagaggaggagctgaagaagcacaacaagaaggatgactgctggatctgcatccggggctttgtgtacaacgtgagcccctacatggagtaccaccctggaggagaagatgagctgatgagagctgctggcagtgatggaacagagctgtttgaccaggtgcaccgctgggtgaactatgaatccatgctgaaggaatgtctggtgggccgcatggccatcaagccagctgtgctgaaggactaccgggaggaggagaagaaggtgctgaatggcatgctgcccaagagccaggtgacagacaccctggccaaggagggccccagctaccccagctatgactggttccagacagacagcctggtgaccatcgccatctacaccaagcagaaggacatcaacctggacagcatcatcgtggaccaccagaatgacagcttccgggcagagaccatcatcaaggactgcctgtacctgatccacatcggcctgagccatgaggtgcaggaggacttctctgtgcgggtggtggagagcgtgggcaagattgagatcgtgctgcagaagaaggagaacacctcctgggacttcctgggccaccccctgaagaaccacaacagcctcatccccaggaaggacaccggcctgtactacaggaagtgccagctgatcagcaaggaggatgtgacccatgacaccaggctcttctgcctgatgctgccccccagcacccacctgcaggtgcccatcggccagcacgtgtacctgaagctgcccatcaccggcacagagatcgtgaagccctacacccctgtgtctggcagcctgctgtctgagttcaaggagcctgtgctgcccaacaacaagtacatctacttcctgatcaagatctaccccaccggcctcttcaccccagagctggaccggctgcagattggagactttgtgtctgtgagcagccctgagggcaacttcaagatcagcaagttccaggagctggaggacctcttcctgctggccgccggcaccggcttcacccccatggtgaagatcctgaactatgccctgacagacatccccagcctgaggaaggtgaagctgatgttcttcaacaagacagaagatgacatcatctggaggagccagctggagaagctggccttcaaggacaagaggctggatgtggagtttgtgctgagcgcccccatcagcgagtggaatggcaagcagggccacatcagccctgccctgctgtctgagttcctgaagaggaacctggacaagagcaaggtgctggtgtgcatctgtggccctgtgcccttcacagagcagggcgtgcggctgctgcatgacctgaacttcagcaagaatgagatccacagcttcaccgcctag

SEQ ID NO: 148976 - DNA, 297 bp, Artificial Sequence
  Description of Artificial Sequence: Synthetic coding sequence
atggccgagcagagtgatgaggccgtgaagtactacaccctggaggagatccagaagcacaaccacagcaagagcacctggctgatcctgcaccacaaggtgtatgacctgaccaagttcctggaggagcaccctggaggagaggaggtgctgcgggagcaggccggaggagatgccacagaaaattttgaagatgtgggccacagcacagatgcccgggagatgagcaagaccttcatcattggagagctgcacccagatgaccggcccaagctgaacaagccacccaagccctag

SEQ ID NO: 148977 - DNA, 405 bp, Artificial Sequence
  Description of Artificial Sequence: Synthetic coding sequence
atggccgagcagagtgatgaggccgtgaagtactacaccctggaggagatccagaagcacaaccacagcaagagcacctggctgatcctgcaccacaaggtgtatgacctgaccaagttcctggaggagcaccctggaggagaggaggtgctgcgggagcaggccggaggagatgccacagaaaattttgaagatgtgggccacagcacagatgcccgggagatgagcaagaccttcatcattggagagctgcacccagatgaccggcccaagctgaacaagcccccagagaccctcatcaccaccatcgacagcagcagctcctggtggaccaactgggtgatcccagccatctctgctgtggccgtggccctgatgtaccgcctgtacatggctgaagattag

SEQ ID NO: 148978 - DNA, 375 bp, Artificial Sequence
  Description of Artificial Sequence: Synthetic coding sequence
atggccgagcagagtgatgaggccgtgaagtactacaccctggaggagatccagaagcacaaccacagcaagagcacctggctgatcctgcaccacaaggtgtatgacctgaccaagttcctggaggagcaccctggaggagaggaggtgctgcgggagcaggccggaggagatgccacagaaaattttgaagatgtgggccacagcacagatgcccgggagatgagcaagaccttcatcattggagagctgcaccctgagaccctcatcaccaccatcgacagcagcagctcctggtggaccaactgggtgatcccagccatctctgctgtggccgtggccctgatgtaccgcctgtacatggctgaagattag

SEQ ID NO: 148979 - DNA, 297 bp, Artificial Sequence
  Description of Artificial Sequence: Synthetic coding sequence
atggccgagcagagtgatgaggccgtgaagtactacaccctggaggagatccagaagcacaaccacagcaagagcacctggctgatcctgcaccacaaggtgtatgacctgaccaagttcctggaggagcaccctggaggagaggaggtgctgcgggagcaggccggaggagatgccacagaaaattttgaagatgtgggccacagcacagatgcccgggagatgagcaagaccttcatcattggagagctgcacccagatgaccggcccaagctgaacaagcccccagagccctag

SEQ ID NO: 148980 - DNA, 453 bp, Artificial Sequence
  Description of Artificial Sequence: Synthetic coding sequence
atgagcggctccatggccacagctgaggccagcggcagtgatggcaagggccaggaggtggagacctctgtgacctactaccgcctggaggaggtggccaagaggaacagcctgaaggagctgtggctggtgatccacggccgggtgtatgatgtgacccgcttcctgaatgagcaccctggaggagaggaggtgctgctggagcaggccggcgtggatgccagcgagagctttgaagatgtgggccacagcagtgatgcccgggagatgctgaagcagtactacatcggggacatccaccccagcgacctgaagccagagagcggcagcaaggaccccagcaagaatgacacctgcaagagctgctgggcctactggatcctgcccatcattggagctgtgctgctgggcttcctgtaccgctactacaccagcgagagcaagagcagctag

SEQ ID NO: 148981 - DNA, 441 bp, Artificial Sequence
  Description of Artificial Sequence: Synthetic coding sequence
atggccacagctgaggccagcggcagtgatggcaagggccaggaggtggagacctctgtgacctactaccgcctggaggaggtggccaagaggaacagcctgaaggagctgtggctggtgatccacggccgggtgtatgatgtgacccgcttcctgaatgagcaccctggaggagaggaggtgctgctggagcaggccggcgtggatgccagcgagagctttgaagatgtgggccacagcagtgatgcccgggagatgctgaagcagtactacatcggggacatccaccccagcgacctgaagccagagagcggcagcaaggaccccagcaagaatgacacctgcaagagctgctgggcctactggatcctgcccatcattggagctgtgctgctgggcttcctgtaccgctactacaccagcgagagcaagagcagctag

SEQ ID NO: 148982 - DNA, 756 bp, Artificial Sequence
  Description of Artificial Sequence: Synthetic coding sequence
atggagggcggcgctgctgctgccacccccacagccctgccctactacgtggccttcagccagctgctgggcctgaccctggtggccatgactggagcctggctgggcctgtaccggggcggcatcgcctgggagagtgacctgcagttcaatgcccaccccctgtgcatggtgattggcctcatcttcctgcagggcaatgccctgctggtgtacagagtcttcagaaatgaggccaagaggaccaccaaggtgctgcacggcctgctgcacatctttgccctggtgattgccctggtgggcctggtggccgtgtttgactaccacaggaagaagggctatgctgacctgtacagcctgcacagctggtgtggcatcctggtgtttgtgctgtactttgtgcagtggctggtgggcttctccttcttcctgtttcctggggccagcttcagcctgcggagccgctaccggccccagcacatcttctttggagccaccatcttcctgctgtctgtgggcacagccctgctgggcctgaaggaggccctgctcttcaacctgggcggcaagtacagcgcctttgagcctgagggcgtgctggccaacgtgctgggcctgctgctggcctgctttggaggagctgtgctgtacatcctgaccagggctgactggaagaggcccagccaggccgaggagcaggccctgtccatggacttcaagaccctgacagaaggagacagccctggcagccagtag

SEQ ID NO: 148983 - DNA, 756 bp, Artificial Sequence; identical to SEQ ID NO: 148982
  Description of Artificial Sequence: Synthetic coding sequence

SEQ ID NO: 148984 - DNA, 756 bp, Artificial Sequence; identical to SEQ ID NO: 148982
  Description of Artificial Sequence: Synthetic coding sequence

SEQ ID NO: 148985 - DNA, 417 bp, Artificial Sequence
  Description of Artificial Sequence: Synthetic coding sequence
atggagggcggcgctgctgctgccacccccacagccctgccctactacgtggccttcagccagctgctgggcctgaccctggtggccatgactggagcctggctgggcctgtaccggggcggcatcgcctgggagagtgacctgcagttcaatgcccaccccctgtgcatggtgattggcctcatcttcctgcagggcaatgccctgctggtgtacagagtcttcagaaatgaggccaagaggaccaccaaggtgctgcacggcctgctgcacatctttgccctggtgattgccctggtgggcctggtggccgtgtttgactaccacaggaagaagggctatgctgacctgtacagcctgcacagctggtgtggcatcctggtgtttgtgctgtactttgtgcagggccaggtgtag

SEQ ID NO: 148986 - DNA, 957 bp, Artificial Sequence
  Description of Artificial Sequence: Synthetic coding sequence
atgaagcagaagaccaagccaggcaccggccccctgagcagcctggagtttggagtgtccttcctggcccccagcccccacatggagctgctggccagctgccccaggagccggctgagcccctggggcggctgggcccccccacccagccacagccgggacctgcggcccctgccccaggatgatggagtgtgcctgtccatggagggcggcgctgctgctgccacccccacagccctgccctactacgtggccttcagccagctgctgggcctgaccctggtggccatgaccggggcctggctgggcctgtacagaggaggcatcgcctgggagagtgacctgcagttcaatgcccaccccctgtgcatggtgattggcctcatcttcctgcagggcaatgccctgctggtgtacagagtcttcagaaatgaggccaagaggaccaccaaggtgctgcacggcctgctgcacatctttgccctggtgattgccctggtgggcctggtggccgtgtttgactaccacaggaagaagggctacgccgacctgtacagcctgcacagctggtgtggcatcctggtgtttgtgctgtactttgtgcagtggctggtgggcttctccttcttcctgtttcctggggccagcttcagcctgcggagccgctaccggccccagcacatcttcttcggggccaccatcttcctgctgtctgtgggcacagccctgctgggcctgaaggaggccctgctcttcaacctgggcggcaagtacagcgcctttgagcctgagggcgtgctggccaacgtgctgggcctgctgctggcctgcttcggcggcgctgtgctgtacatcctgaccagggctgactggaagaggcccagccaggccgaggagcaggccctgtccatggacttcaagaccctgacagaaggagacagccctggcagccagtag

SEQ ID NO: 148987 - DNA, 1143 bp, Artificial Sequence
  Description of Artificial Sequence: Synthetic coding sequence
atgggcagcggctgcagaattgagtgcatcttcttcagcgagttccaccccaccctgggccccaagatcacctaccaggtgcctgaggacttcatcagccgggagctgtttgacacagtgcaggtgtacatcatcaccaagccagagctgcagaacaagctgatcaccgtgacagccatggagaagaagctgattggctgccctgtgtgcatcgagcacaagaagtacagcagaaatgccctgctcttcaacctgggctttgtgtgtgatgcccaggccaagacctgtgccctggagcccatcgtgaagaagctggccggctacctgaccaccctggagctggagagcagctttgtgtccatggaggagagcaagcagaagctggtgcccatcatgaccatcctgctggaggagctgaatgccagcggccgctgcaccctgcccattgatgagagcaacaccatccacctgaaggtgattgagcagaggccagacccccctgtggcccaggagtatgatgtgcctgtgttcaccaaggacaaggaggacttcttcaacagccagtgggacctgaccacccagcagatcctgccctacattgatggcttccgccacatccagaagatctctgctgaggctgatgtggagctgaacctggtgcgcatcgccatccagaacctgctgtactacggcgtggtgaccctggtgtccatcctgcagtacagcaatgtgtactgccccacccccaaggtgcaggacctggtggatgacaagagcctgcaggaggcctgcctgtcctatgtgaccaagcagggccacaagagggccagcctgagagatgtgttccagctgtactgcagcctgagccctggcaccaccgtgcgggacctgattggccgccacccccagcagctgcagcacgtggatgagaggaagctgatccagtttggcctgatgaagaacctgatccggcggctgcagaagtaccctgtgcgggtgacccgggaggagcagagccacccagcccggctgtacacaggctgccacagctatgatgagatctgctgcaagacaggcatgagctaccacgagctggatgagcggctggagaatgaccccaacatcatcatctgctggaagtag

SEQ ID NO: 148988 - DNA, 669 bp, Artificial Sequence
  Description of Artificial Sequence: Synthetic coding sequence
atggccctgtctgctgagacagagagccacatctaccgggccctgaggacagccagcggggccgccgcccacctggtggccctgggcttcaccatctttgtggccgtgctggcccggcccggcagcagcctcttctcctggcaccctgtgctgatgagcctggccttctccttcctgatgacagaggccctgctggtgttcagccctgagagcagcctgctgcacagcctgagcaggaagggccgggcccgctgccactgggtgctgcagctgctggccctgctgtgtgccctgctgggcctgggcctggtgatcctgcacaaggagcagctgggcaaggcccacctggtgaccaggcatggccaggccggcctgctggccgtgctgtgggccggcctgcagtgcagcggcggcgtgggcctgctgtaccccaagctgctgccccgctggcccctggccaagctgaagctgtaccacgccaccagcggcctggtgggctacctgctgggcagcgccagcctgctgctgggcatgtgcagcctgtggttcaccgcctctgtgactggagctgcctggtacctggccgtgctgtgccctgtgctgaccagcctggtgatcatgaaccaggtgtccaatgcctacctgtacaggaagaggatccagccctag

SEQ ID NO: 148989 - DNA, 669 bp, Artificial Sequence; identical to SEQ ID NO: 148988
  Description of Artificial Sequence: Synthetic coding sequence

SEQ ID NO: 148990 - DNA, 669 bp, Artificial Sequence; identical to SEQ ID NO: 148988
  Description of Artificial Sequence: Synthetic coding sequence

SEQ ID NO: 148991 - DNA, 696 bp, Artificial Sequence
  Description of Artificial Sequence: Synthetic coding sequence
atgggcggcctgtggaggcctggctggaggtgtgtgcccttctgtggctggcgctggatccaccctggcagccccaccagggctgctgagcgggtggagcccttcctgcggcctgagtggagcggcactggaggagctgagcggggcctgcgctggctgggcacctggaagcgctgcagcctgcgggcccggcacccagccctgcagcccccccggcggcccaagagcagcaaccccttcacccgggcccaggaggaggagcggcggcggcagaacaagaccaccctgacctacgtggccgctgtggccgtgggcatgctgggcgccagctatgctgctgtgcccctgtaccgcctgtactgccagaccaccggcctgggcggcagcgctgtggccggccacgccagtgacaagattgagaacatggtgcctgtgaaggaccgcatcatcaagatctccttcaatgctgatgtgcacgccagcctgcagtggaacttccggccccagcagacagagatctacgtggtgcctggagaaacagccctggccttctaccgggccaagaaccccacagacaagcctgtgattggcatcagcacctacaacatcgtgccctttgaggccggccagtacttcaacaagatccaggccagcaagctgcaccgggtgtatgtgctggagagctggcacctgtag

SEQ ID NO: 148992 - DNA, 510 bp, Artificial Sequence
  Description of Artificial Sequence: Synthetic coding sequence
atgctggccaccagggtcttcagcctggtgggcaagagggccatcagcacctctgtgtgtgtgcgggcccacgagagcgtggtgaagtctgaggacttcagcctgcctgcctacatggacagaagagaccaccccctgcctgaggtggcccacgtgaagcacctgagcgccagccagaaggccctgaaggagaaggagaaggcctcctggagcagcctgtccatggatgagaaggtggagctgtaccgcatcaagttcaaggagagctttgctgagatgaacagaggcagcaatgagtggaagacagtggtgggcggggccatgttcttcatcggcttcaccgccctggtgatcatgtggcagaagcactacgtgtatggccccctgccccagagctttgacaaggagtgggtggccaagcagaccaagaggatgctggacatgaaggtgaaccccatccagggcctggccagcaagtgggactatgagaagaatgagtggaagaagtag

SEQ ID NO: 148993 - DNA, 516 bp, Artificial Sequence
  Description of Artificial Sequence: Synthetic coding sequence
atgctgcccagggctgcctggagcctggtgctgaggaaaggaggcggcggccggcggggcatgcacagcagcgagggcaccacccggggcggcggcaagatgagcccctacaccaactgctacgcccagcgctactaccccatgcctgaggagcccttctgcacagagctgaatgctgaggagcaggccctgaaggagaaggagaagggctcctggacccagctgacccacgccgagaaggtggccctgtaccgcctgcagttcaatgagacctttgctgagatgaacagaagaagcaatgagtggaagacagtgatgggctgtgtgttcttcttcatcggctttgctgccctggtgatctggtggcagagggtgtatgtgtttcctcccaagcccatcaccctgacagatgagaggaaggcccagcagctgcagaggatgctggacatgaaggtgaaccctgtgcagggcctggccagccgctgggactatgagaagaagcagtggaagaagtag

SEQ ID NO: 148994 - DNA, 390 bp, Artificial Sequence
  Description of Artificial Sequence: Synthetic coding sequence
atggccagccggctgctgcggggagctggcaccctggccgcccaggccctgcgggcccggggccccagcggggccgccgccatgaggtccatggccagcggcggcggcgtgcccacagatgaggagcaggccaccggcctggagcgggagatcatgctggccgccaagaagggcctggacccctacaacgtgctggcccccaagggggccagcggcacccgggaggaccccaacctggtgcccagcatcagcaacaagagaattgtgggctgcatctgtgaggaggacaacacctctgtggtgtggttctggctgcacaagggggaggcccagcgctgcccccgctgtggggcccactacaagctggtgccccagcagctggcccactag

SEQ ID NO: 148995 - DNA, 606 bp, Artificial Sequence
  Description of Artificial Sequence: Synthetic coding sequence
atggcccgggactatgaccacctgttcaagctgctgatcatcggggacagcggcgtgggcaagagcagcctgctgctgcgctttgctgacaacaccttcagcggcagctacatcaccaccatcggcgtggacttcaagatcagaacagtggagatcaatggagagaaggtgaagctgcagatctgggacacagctggccaggagcgcttccgcaccatcaccagcacctactaccggggcacccacggcgtgattgtggtgtatgatgtgaccagcgctgagagctttgtgaatgtgaagcgctggctgcacgagatcaaccagaactgtgatgatgtgtgccgcatcctggtgggcaacaagaatgatgatcctgagaggaaggtggtggagacagaagatgcctacaagtttgctggccagatgggcatccagctgtttgagaccagcgccaaggaaaatgtgaatgtggaggagatgttcaactgcatcacagagctggtgctgcgggccaagaaggacaacctggccaagcagcagcagcagcagcagaatgatgtggtgaagctgaccaagaacagcaagaggaagaagcgctgctgctag

SEQ ID NO: 148996 - DNA, 261 bp, Artificial Sequence
  Description of Artificial Sequence: Synthetic coding sequence
atggccgaggacatggagaccaagatcaagaactacaagacagccccctttgacagccgcttccccaaccagaaccagaccaggaactgctggcagaactacctggacttccaccgctgccagaaggccatgacagccaagggcggggacatctctgtgtgtgagtggtaccagagggtgtaccagagcctgtgccccacctcctgggtgacagactgggatgagcagagagctgagggcaccttccctgggaagatctag

SEQ ID NO: 148997 - DNA, 312 bp, Artificial Sequence
  Description of Artificial Sequence: Synthetic coding sequence
atgcacccccacccccagatccctggccgggacctggccggcttcagcaccatggccgaggacatggagaccaagatcaagaactacaagacagccccctttgacagccgcttccccaaccagaaccagaccaggaactgctggcagaactacctggacttccaccgctgccagaaggccatgacagccaagggcggggacatctctgtgtgtgagtggtaccagagggtgtaccagagcctgtgccccacctcctgggtgacagactgggatgagcagagagctgagggcaccttccctgggaagatctag

SEQ ID NO: 148998 - DNA, 228 bp, Artificial Sequence
  Description of Artificial Sequence: Synthetic coding sequence
atggcccctgaggtgctgcccaagcccaggatgaggggcctgctggcccggcggctgaggaaccacatggctgtggcctttgtgctgagcctgggcgtggccgccctgtacaagttccgggtggccgaccagaggaagaaggcctatgctgacttctacagaaattatgatgtgatgaaggactttgaggagatgaggaaggccggcatcttccagagcgtgaagtag

SEQ ID NO: 148999 - DNA, 228 bp, Artificial Sequence; identical to SEQ ID NO: 148998
  Description of Artificial Sequence: Synthetic coding sequence

SEQ ID NO: 149000 - DNA, 228 bp, Artificial Sequence; identical to SEQ ID NO: 148998
  Description of Artificial Sequence: Synthetic coding sequence

SEQ ID NO: 149001 - DNA, 228 bp, Artificial Sequence; identical to SEQ ID NO: 148998
  Description of Artificial Sequence: Synthetic coding sequence

SEQ ID NO: 149002 - DNA, 228 bp, Artificial Sequence; identical to SEQ ID NO: 148998
  Description of Artificial Sequence: Synthetic coding sequence

SEQ ID NO: 149003 - DNA, 228 bp, Artificial Sequence; identical to SEQ ID NO: 148998
  Description of Artificial Sequence: Synthetic coding sequence

SEQ ID NO: 149004 - DNA, 228 bp, Artificial Sequence; identical to SEQ ID NO: 148998
  Description of Artificial Sequence: Synthetic coding sequence

SEQ ID NO: 149005 - DNA, 228 bp, Artificial Sequence; identical to SEQ ID NO: 148998
  Description of Artificial Sequence: Synthetic coding sequence

SEQ ID NO: 149006 - DNA, 228 bp, Artificial Sequence; identical to SEQ ID NO: 148998
  Description of Artificial Sequence: Synthetic coding sequence

SEQ ID NO: 149007 - DNA, 228 bp, Artificial Sequence; identical to SEQ ID NO: 148998
  Description of Artificial Sequence: Synthetic coding sequence

SEQ ID NO: 149008 - DNA, 240 bp, Artificial Sequence
  Description of Artificial Sequence: Synthetic coding sequence
atgcaggccctgcgggtgtcccaggccctgatccgctccttcagcagcacagccaggaaccgcttccagaacagagtgcgggagaagcagaagctgttccaggaggacaatgacatccccctgtacctgaagggcggcatcgtggacaacatcctgtacagagtgaccatgaccctgtgcctgggcggcaccgtgtacagcctgtacagcctgggctgggccagcttccccaggaactag

SEQ ID NO: 149009 - DNA, 330 bp, Artificial Sequence
  Description of Artificial Sequence: Synthetic coding sequence
tgaagcttctgggtgctgagcctgcccggccccagccggcagcccggccacccccaggcccggctgcagggcgagagcccccccaacccagctggcagcagccgggtgtcccaggccctgatccgctccttcagcagcacagccaggaaccgcttccagaacagagtgcgggagaagcagaagctgttccaggaggacaatgacatccccctgtacctgaagggcggcatcgtggacaacatcctgtacagagtgaccatgaccctgtgcctgggcggcaccgtgtacagcctgtacagcctgggctgggccagcttccccaggaactag

SEQ ID NO: 149010 - DNA, 2775 bp, Artificial Sequence
  Description of Artificial Sequence: Synthetic coding sequence
atgagccgcagccggcagccccccctggtgacaggcatcagccccaatgaaggcatcccctggaccaaggtgaccatcagaggagagaacctgggcaccggccccacagacctgattggcctgaccatctgtggccacaactgcctgctgacagctgagtggatgtctgccagcaagatcgtgtgccgggtgggccaggccaagaatgacaagggggacatcatcgtgaccaccaagagcggcggccggggcaccagcacagtgtccttcaagctgctgaagccagagaagattggcatcctggaccagagcgctgtgtgggtggatgagatgaactactatgacatgaggacagacaggaacaagggcatcccccccctgagcctgcggcctgccaaccccctgggcattgaaattgagaagagcaagttcagccagaaggacctggagatgctgttccacggcatgtctgctgacttcaccagcgagaacttctctgctgcctggtacctgattgagaaccacagcaacaccagctttgagcagctgaagatggctgtgaccaacctgaagaggcaggccaacaagaagtctgagggcagcctggcctacgtgaagggcggcctgagcaccttctttgaggcccaggatgccctgagcgccatccaccagaagctggaggctgatggaacagagaaggtggagggctccatgacccagaagctggagaatgtgctgaacagagccagcaacacagctgacaccctcttccaggaggtgctgggcaggaaggacaaggctgacagcaccagaaatgccctgaatgtgctgcagcgcttcaagttcctgttcaacctgcccctgaacatcgagaggaacatccagaagggggactatgatgtggtgatcaatgactatgagaaggccaagagcctgtttgggaagacagaggtgcaggtgttcaagaagtactatgcagaggtggagacccgcatcgaggccctgcgggagctgctgctggacaagctgctggagacccccagcaccctgcatgaccagaagcgctacatccgctacctgagtgacctgcacgccagcggggaccctgcctggcagtgcatcggggcccagcacaagtggatcctgcagctgatgcacagctgcaaggagggctacgtgaaggacctgaagggcaaccctggcctgcacagccccatgctggacctggacaatgacacccggcccagcgtgctgggccacctgagccagacagccagcctgaagaggggcagcagcttccagagcggcagagatgacacctggagatacaagaccccccaccgggtggcctttgtggagaagctgaccaagctggtgctgagccagctgcccaacttctggaagctgtggatctcctatgtgaatggcagcctcttcagcgagacagctgagaagagcggccagatcgagaggagcaagaatgtgcggcagaggcagaatgacttcaagaagatgatccaggaggtgatgcacagcctggtgaagctgaccaggggggccctgctgcccctgagcatcagagatggagaggccaagcagtatggaggctgggaggtgaagtgtgagctgagcggccagtggctggcccacgccatccagacagtgcggctgacccatgagagcctgacagccctggagatccccaatgacctgctgcagaccatccaggacctgatcctggacctgcgggtgcgctgtgtgatggccaccctgcagcacacagctgaggagatcaagaggctggccgagaaggaggactggatcgtggacaatgaaggcctgaccagcctgccctgccagtttgagcagtgcatcgtgtgcagcctgcagagcctgaagggcgtgctggagtgcaagccaggagaggccagcgtcttccagcagcccaagacccaggaggaggtgtgccagctgagcatcaacatcatgcaggtgttcatctactgcctggagcagctgagcaccaagccagatgctgacatcgacaccacccacctgtctgtggatgtgagcagcccagacctgtttggcagcatccacgaggacttcagcctgaccagcgagcagaggctgctgattgtgctgagcaactgctgctacctggagcggcacaccttcctgaacattgctgagcactttgagaagcacaacttccagggcatcgagaagatcacccaggtgtccatggccagcctgaaggagctggaccagaggctgtttgagaactacatcgagctgaaggctgaccccatcgtgggcagcctggagcccggcatctatgccggctactttgactggaaggactgcctgcccccaactggagtgaggaactacctgaaggaggccctggtgaacatcatcgctgtgcatgctgaggtgttcaccatcagcaaggagctggtgccccgggtgctgagcaaggtgattgaagctgtgtctgaggagctgagccggctgatgcagtgtgtgtcctccttcagcaagaatggagccctgcaggcccggctggagatctgtgccctgcgggacacagtggccgtgtacctgaccccagagagcaagagcagcttcaagcaggccctggaggccctgccccagctgagcagtggagctgacaagaagctgctggaggagctgctgaacaagttcaagagctccatgcacctgcagctgacctgcttccaggccgccagcagcaccatgatgaagacctag

SEQ ID NO: 149011 - DNA, 348 bp, Artificial Sequence
  Description of Artificial Sequence: Synthetic coding sequence
atgcacacccaggacagcgaggtggtgcctgtgcctgcctggcccttcagcctggtggtgttcagctgtggcggctgctggagcgtgacagccaagatgctgaggaacctgctggccctgcggcagatcggccagaggaccatcagcacagccagcagaagacacttcaagaacaaggtgcctgagaagcagaagctgttccaggaggatgatgagatccccctgtacctgaagggcggcgtggctgatgccctgctgtaccgggccaccatgatcctgactgtgggcggcacagcctatgccatctatgagctggccgtggccagcttccccaagaagcaggagtag

SEQ ID NO: 149012 - DNA, 348 bp, Artificial Sequence; identical to SEQ ID NO: 149011
  Description of Artificial Sequence: Synthetic coding sequence

SEQ ID NO: 149013 - DNA, 1734 bp, Artificial Sequence
  Description of Artificial Sequence: Synthetic coding sequence
atgagcaagccagagctgaaggaggacaagatgctggaggtgcactttgtgggagatgatgatgtgctgaaccacatcctggaccgggagggcggggccaagctgaagaaggagcgggcccagctgctggtgaaccccaagaagatcatcaagaagccagaatatgacctggaggaggatgaccaggaggtgctgaaggaccagaactacgtggagatcatgggcagagatgtgcaggagagcctgaagaatggcagcgccaccggcggcggcaacaaggtgtacagcttccagaacaggaagcacagcgagaagatggccaagctggccagcgagctggccaagaccccccagaagtctgtgtccttcagcctgaagaatgaccctgagatcaccatcaacgtgccccagagcagcaagggccacagcgccagtgacaaggtgcagcccaagaacaatgacaagtctgagttcctgagcacagcccccaggagcctgaggaagaggctgattgtgcccaggagccacagcgacagcgagagcgagtacagcgccagcaacagtgaagatgatgaaggagtggcccaggagcacgaggaggacaccaatgctgtgatcttcagccagaagatccaggcccagaacagagtggtgtctgcccctgtgggcaaggagacccccagcaagaggatgaagagggacaagaccagtgacctggtggaggagtactttgaggcccacagcagcagcaaggtgctgaccagtgacaggaccctgcagaagctgaagagggccaagctggaccagcagaccctgaggaacctgctgagcaaggtgagccccagcttctctgctgagctgaagcagctgaaccagcagtatgagaagctgttccacaagtggatgctgcagctgcacctgggcttcaacatcgtgctgtatggcctgggcagcaagagggacctgctggagcgcttccgcaccaccatgctgcaggacagcatccacgtggtgatcaatggcttcttccctggcatctctgtgaagtctgtgctgaacagcatcacagaggaggtgctggaccacatgggcaccttccgcagcatcctggaccagctggactggatcgtgaacaagttcaaggaggacagcagcctggagctgttcctgctgatccacaacctggacagccagatgctgcggggggagaagagccagcagatcatcggccagctgagcagcctgcacaacatctacctgattgccagcattgaccacctgaatgcccccctgatgtgggaccacgccaagcagagcctcttcaactggctgtggtatgagaccaccacctacagcccctacacagaggagaccagctatgagaacagcctgctggtgaagcagagcggcagcctgcccctgagcagcctgacccacgtgctgcggagcctgaccccaaatgcccggggcatcttccggctgctgatcaagtaccagctggacaaccaggacaaccccagctacatcggcctgtccttccaggacttctaccagcagtgccgggaggccttcctggtgaacagcgacctgaccctgcgggcccagctgacagagttccgggaccacaagctgatccgcaccaagaagggcacagatggagtggagtacctgctgatccctgtggacaatggcaccctgacagacttcctggagaaggaggaggaggaggcctag

SEQ ID NO: 149014 - DNA, 345 bp, Artificial Sequence
  Description of Artificial Sequence: Synthetic coding sequence
atgtactacaagttcagcggcttcacccagaagctggccggggcctgggccagcgaggcctacagcccccagggcctgaagcctgtggtgtccacagaggccccacccatcatctttgccacccccaccaagctgaccagtgacagcacagtgtatgactatgccggcaagaacaaggtgcctgagctgcagaagttcttccagaaggcagatggagtgcctgtgtacctgaagaggggcctgcctgaccagatgctgtaccgcaccaccatggccctgactgtgggcggcaccatctactgcctgattgccctgtacatggccagccagcccaagaacaagtag

SEQ ID NO: 149015 - DNA, 246 bp, Artificial Sequence
  Description of Artificial Sequence: Synthetic coding sequence
atgatgttccccctggccagaaatgccctgagcagcctgaagatccagagcatcctgcagagcatggcccggcacagccacgtgaagcacagcccagacttccatgacaagtatggaaatgctgtgctggccagcggcacagccttctgtgtggccacctgggtgttcaccgccacccagattggaattgagtggaacctgagccctgtgggccgggtgacccccaaggagtggaagcaccagtag

SEQ ID NO: 149016 - DNA, 246 bp, Artificial Sequence; identical to SEQ ID NO: 149015
  Description of Artificial Sequence: Synthetic coding sequence

SEQ ID NO: 149017 - DNA, 246 bp, Artificial Sequence; identical to SEQ ID NO: 149015
  Description of Artificial Sequence: Synthetic coding sequence

SEQ ID NO: 149018 - DNA, 99 bp, Artificial Sequence
  Description of Artificial Sequence: Synthetic coding sequence
atgatgttccccctggccagaaatgccctgagcagcctgaagatccagagcatcctgcagagcatggcccggcacagccacgtgaagcacagcccctag

SEQ ID NO: 149019 - DNA, 243 bp, Artificial Sequence
  Description of Artificial Sequence: Synthetic coding sequence
atgttccccctggccagaaatgccctgagcagcctgaagatccagagcatcctgcagagcatggcccggcacagccacgtgaagcacagcccagacttccatgacaagtatggaaatgctgtgctggccagcggcacagccttctgtgtggccacctgggtgttcaccgccacccagatcggcatcgagtggaacctgagccctgtgggccgggtgacccccaaggagtggaagcaccagtag

SEQ ID NO: 149020 - DNA, 192 bp, Artificial Sequence
  Description of Artificial Sequence: Synthetic coding sequence
atgctgggccagagcatccgccgcttcaccacctctgtggtgagaagaagccactatgaggagggccctgggaagaacctgcccttctctgtggagaacaagtggagcctgctggccaagatgtgcctgtactttggaagtgcctttgccacccccttcctggtggtgcgccaccagctgctgaagacctag

SEQ ID NO: 149021 - DNA, 192 bp, Artificial Sequence; identical to SEQ ID NO: 149020
  Description of Artificial Sequence: Synthetic coding sequence

SEQ ID NO: 149022 - DNA, 978 bp, Artificial Sequence
  Description of Artificial Sequence: Synthetic coding sequence
atggctgctgctgctgccagcctgcggggcgtggtgctgggccccaggggggccggcctgcccggggcccgggcccggggcctgctgtgcagcgcccggcccggccagctgcccctgcggaccccccaggccgtggccctgagcagcaagagcggcctgagccggggcaggaaggtgatgctgagcgccctgggcatgctggccgccggcggggccggcctggccatggccctgcacagcgctgtgtctgccagtgacctggagctgcaccccccatcctacccctggagccaccggggcctgctgagcagcctggaccacaccagcatcagaagaggcttccaggtgtacaagcaggtgtgtgccagctgccacagcatggactttgtggcctaccgccacctggtgggcgtgtgctacacagaagatgaggccaaggagctggccgctgaggtggaggtgcaggacggccccaatgaagatggagagatgttcatgaggcctgggaagctgtttgactacttccccaagccctaccccaacagcgaggccgcccgggccgccaacaacggggccctgcccccagacctgagctacatcgtgcgggcccggcatggaggagaggactatgtgttcagcctgctgaccggctactgtgagcccccaactggagtgtccctgcgggagggcctgtacttcaacccctacttccctggccaggccatcgccatggccccacccatctacacagatgtgctggagtttgatgatggcaccccagccaccatgagccagatcgccaaggatgtgtgcaccttcctgcgctgggccagcgagcctgagcatgaccacaggaagaggatgggcctgaagatgctgatgatgatggccctgctggtgcccctggtgtacaccatcaagaggcacaagtggagcgtgctgaagagcaggaagctggcctacagaccacccaagtag

SEQ ID NO: 149023 - DNA, 252 bp, Artificial Sequence
  Description of Artificial Sequence: Synthetic coding sequence
atggagccctttgtggtgctggtgctgtgcctgtccttcatgctgctcttcagcctgtggaggcagagctgcagaagaaggaagctgcccccaggccccacccccctgcccatcatcggcaacatgctgcagattgatgtgaaggacatctgcaagagcttcaccaacgtgtccctgccctacgtgcccccagccaactgcaagggcagccagaagtccatggtgctgtgcagcccctgcatcctggcctag

SEQ ID NO: 149024 - DNA, 219 bp, Artificial Sequence
  Description of Artificial Sequence: Synthetic coding sequence
atggagccctttgtggtgctggtgctgtgcctgtccttcatgctgctcttcagcctgtggaggcagagctgcagaagaaggaagctgcccccaggccccacccccctgcccatcatcggcaacatgctgcagattgatgtgaaggacatctgcaagagcttcaccaacgtgtccctgccctacgtgcccccagccaactgcaagggcgtgctgctgtag

SEQ ID NO: 149025 - DNA, 423 bp, Artificial Sequence
  Description of Artificial Sequence: Synthetic coding sequence
atggacctgatccccaacctggccgtggagacctggctgctgctggccgtgtccctggtgctgctgtacctgtatggcaccaggacccacggcctcttcaagaggctgggcatccctggccccacccccctgcccctgctgggcaatgtgctgagctaccggcagggcctgtggaagtttgacacagagtgctacaagaagtatggcaagatgtggggcacctatgagggccagctgcctgtgctggccatcacagatcctgatgtgatcagaacagtgctggtgaaggagtgctacagcgtcttcaccaacagacgcatctgtgccaccaccagcaccatcaagatgcagacccacagcgtgaccatgtggctgcccccagctgtgctgcagagccagcacggcgtgtgcctcttcctgtag

SEQ ID NO: 149026 - DNA, 1563 bp, Artificial Sequence
  Description of Artificial Sequence: Synthetic coding sequence
atgccccagctgagcctgagcagcctgggcctgtggcccatggccgccagcccctggctgctgctgctgctggtgggcgcctcctggctgctggcccgcatcctggcctggacctacaccttctatgacaactgctgccgcctgcgctgcttcccccagccccccaagaggaactggttcctgggccacctgggcctggtgacccccacagagcagggcatgagggtgctgacccagctggtggccacctacccccagggcttcaaggtgtggatgggccccatcttccctgtgatccgcttctgccaccccaacatcatccgcagcgtcatcaatgccagcgctgccatcgtgcccaaggacaaggtgttctacagcttcctgaagccctggctgggagatggcctgctgctgtctgctggggagaagtggagccgccacaggaggatgctgaccccagccttccacttcaacatcctgaagccctacatgaagatcttcaatgaatctgtgaacatcatgcacgccaagtggcagctgctggccagcgagggcagcgcccggctggacatgtttgagcacatcagcctgatgaccctggacagcctgcagaagtgtgtgttctcctttgacagccactgccaggagaagcccagcgagtacatcgccgccatcctggagctgagcgccctggtgaccaagaggcaccagcagatcctgctgtacatcgacttcctgtactacctgaccccagatggccagcgcttcagaagagcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggatgaagatggcaagaagctgagtgatgaggacatccgggcagaggccgacaccttcatgtttgagggccatgacaccacagccagcggcctgtcctgggtgctgtaccacctggccaagcaccctgagtaccaggagcgctgccggcaggaggtgcaggagctgctgaaggaccgggagcccaaggagattgagtgggatgacctggcccagctgcccttcctgaccatgtgcatcaaggagagcctgcggctgcacccccctgtgcctgctgtgagccgctgctgcacccaggacatcgtgctgcctgatggccgggtcatccccaagggcatcatctgcctgatctctgtgtttggcacccaccacaacccagctgtgtggccagaccctgaggtgtatgaccccttccgctttgaccccaagaacatcaaggagaggagccccctggccttcatccccttctctgctggccccaggaactgcatcggccaggcctttgccatggccgagatgaaggtggtgctgggcctgaccctgctgcgcttccgggtgctgcctgaccacacagagcccaggaggaagccagagctggtgctgcgggcagagggcggcctgtggctgcgggtggagcccctgtcctag

SEQ ID NO: 149027 - DNA, 1455 bp, Artificial Sequence
  Description of Artificial Sequence: Synthetic coding sequence
atgctgttccccatctccatgtctgccacagagttcctgctggccagcgtcatcttctgcctggtgttctgggtgatccgggccagccggccccaggtgcccaagggcctgaagaaccccccaggcccctggggctggcccctgattggccacatgctgaccctgggcaagaacccccacctggccctgagcaggatgagccagcagtatggagatgtgctgcagatccgcatcggcagcacccctgtggtggtgctgagcggcctggacaccatccggcaggccctggtgcggcagggagatgacttcaagggccgcccagacctgtacaccttcaccctcatcagcaatggccagagcatgtccttctccccagattctggccctgtgtgggccgcccggcggcggctggcccagaatggcctgaagagcttcagcatcgccagtgaccctgccagcagcaccagctgctacctggaggagcacgtgtccaaggaggccgaggtgctgatcagcaccctgcaggagctgatggccggccctggccacttcaacccctaccgctacgtggtggtgtctgtgaccaacgtcatctgtgccatctgctttggaagaagatatgaccacaaccaccaggagctgctgagcctggtgaacctgaatgccttcaaggacctgaatgagaagttctacagcttcatgcagaagatggtgaaggagcactacaagacctttgagaagggccacatccgggacatcacagacagcctcatcgagcactgccaggagaagcagctggatgaaaatgccaacgtgcagctgagtgatgagaagatcatcaacatcgtgctggacctgtttggagctggctttgacacagtgaccacagccatctcctggagcctgatgtacctggtgatgaacccccgggtgcagaggaagatccaggaggagctggacacagtgattggccgcagcagaagaccccggctgagtgacaggagccacctgccctacatggaggccttcatcctggagaccttccgccacagcagctttgtgcccttcaccatcccccacagcaccacccgggacaccagcctgaagggcttctacatccccaagggccgctgtgtgtttgtgaaccagtggcagatcaaccacgaccagaagctgtgggtgaaccccagcgagttcctgcctgagcgcttcctgaccccagatggagccatcgacaaggtgctgtctgagaaggtgatcatcttcggcatgggcaagaggaagtgcatcggggagaccatcgcccgctgggaggtgttcctgttcctggccatcctgctgcagagggtggagttctctgtgcccctgggcgtgaaggtggacatgacccccatctacggcctgaccatgaagcacgcctgctgtgagcacttccagatgcagctgcggagctag

SEQ ID NO: 149028 - DNA, 1539 bp, Artificial Sequence
  Description of Artificial Sequence: Synthetic coding sequence
atgctgttccccatctccatgtctgccacagagttcctgctggccagcgtcatcttctgcctggtgttctgggtgatccgggccagccggccccaggtgcccaagggcctgaagaaccccccaggcccctggggctggcccctgattggccacatgctgaccctgggcaagaacccccacctggccctgagcaggatgagccagcagtatggagatgtgctgcagatccgcatcggcagcacccctgtggtggtgctgagcggcctggacaccatccggcaggccctggtgcggcagggagatgacttcaagggccgcccagacctgtacaccttcaccctcatcagcaatggccagagcatgtccttctccccagattctggccctgtgtgggccgcccggcggcggctggcccagaatggcctgaagagcttcagcatcgccagtgaccctgccagcagcaccagctgctacctggaggagcacgtgtccaaggaggccgaggtgctgatcagcaccctgcaggagctgatggccggccctggccacttcaacccctaccgctacgtggtggtgtctgtgaccaacgtcatctgtgccatctgctttggaagaagatatgaccacaaccaccaggagctgctgagcctggtgaacctgaacaacaactttggagaggtggtgggcagcggcaacccagctgacttcatccccatcctgcgctacctgcccaaccccagcctgaatgccttcaaggacctgaatgagaagttctacagcttcatgcagaagatggtgaaggagcactacaagacctttgagaagggccacatccgggacatcacagacagcctcatcgagcactgccaggagaagcagctggatgaaaatgccaacgtgcagctgagtgatgagaagatcatcaacatcgtgctggacctgtttggagctggctttgacacagtgaccacagccatctcctggagcctgatgtacctggtgatgaacccccgggtgcagaggaagatccaggaggagctggacacagtgattggccgcagcagaagaccccggctgagtgacaggagccacctgccctacatggaggccttcatcctggagaccttccgccacagcagctttgtgcccttcaccatcccccacagcaccacccgggacaccagcctgaagggcttctacatccccaagggccgctgtgtgtttgtgaaccagtggcagatcaaccacgaccagaagctgtgggtgaaccccagcgagttcctgcctgagcgcttcctgaccccagatggagccatcgacaaggtgctgtctgagaaggtgatcatcttcggcatgggcaagaggaagtgcatcggggagaccatcgcccgctgggaggtgttcctgttcctggccatcctgctgcagagggtggagttctctgtgcccctgggcgtgaaggtggacatgacccccatctacggcctgaccatgaagcacgcctgctgtgagcacttccagatgcagctgcggagctag

SEQ ID NO: 149029 - DNA, 1539 bp, Artificial Sequence; identical to SEQ ID NO: 149028
  Description of Artificial Sequence: Synthetic coding sequence

SEQ ID NO: 149030 - DNA, 1452 bp, Artificial Sequence
  Description of Artificial Sequence: Synthetic coding sequence
atgctgttccccatctccatgtctgccacagagttcctgctggccagcgtcatcttctgcctggtgttctgggtgatccgggccagccggccccaggtgcccaagggcctgaagaaccccccaggcccctggggctggcccctgattggccacatgctgaccctgggcaagaacccccacctggccctgagcaggatgagccagcagtatggagatgtgctgcagatccgcatcggcagcacccctgtggtggtgctgagcggcctggacaccatccggcaggccctggtgcggcagggagatgacttcaagggccgcccagacctgtacaccttcaccctcatcagcaatggccagagcatgtccttctccccagattctggccctgtgtgggccgcccggcggcggctggcccagaatggcctgaagagcttcagcatcgccagtgaccctgccagcagcaccagctgctacctggaggagcacgtgtccaaggaggccgaggtgctgatcagcaccctgcaggagctgatggccggccctggccacttcaacccctaccgctacgtggtggtgtctgtgaccaacgtcatctgtgccatctgctttggaagaagatatgaccacaaccaccaggagctgctgagcctggtgaacctgaacaacaactttggagaggtggtgggcagcggcaacccagctgacttcatccccatcctgcgctacctgcccaaccccagcctgaatgccttcaaggacctgaatgagaagttctacagcttcatgcagaagatggtgaaggagcactacaagacctttgagaagggccacatccgggacatcacagacagcctcatcgagcactgccaggagaagcagctggatgaaaatgccaacgtgcagctgagtgatgagaagatcatcaacatcgtgctggacctgtttggagctggctttgacacagtgaccacagccatctcctggagcctgatgtacctggtgatgaacccccgggtgcagaggaagatccaggaggagctggacacagtgattggccgcagcagaagaccccggctgagtgacaggagccacctgccctacatggaggccttcatcctggagaccttccgccacagcagctttgtgcccttcaccatcccccacaggaagctgtgggtgaaccccagcgagttcctgcctgagcgcttcctgaccccagatggagccatcgacaaggtgctgtctgagaaggtgatcatcttcggcatgggcaagaggaaatgtattggagagaccatcgcccgctgggaggtgttcctgttcctggccatcctgctgcagagggtggagttctctgtgcccctgggcgtgaaggtggacatgacccccatctacggcctgaccatgaagcacgcctgctgtgagcacttccagatgcagctgcggagctag

SEQ ID NO: 149031 - DNA, 1551 bp, Artificial Sequence
  Description of Artificial Sequence: Synthetic coding sequence
atggccctgagccagagcgtgcccttcagcgccacagagctgctgctggccagcgccatcttctgcctggtgttctgggtgctgaagggcctgcggccccgggtgcccaagggcctgaagagccccccagagccctggggctggcccctgctgggccacgtgctgaccctgggcaagaacccccacctggccctgagcaggatgagccagagatatggagatgtgctgcagatccgcatcggcagcacccctgtgctggtgctgagccggctggacaccatccggcaggccctggtgcggcagggagatgacttcaagggccgcccagacctgtacaccagcaccctcatcacagatggccagagcctgaccttcagcacagattctggccctgtgtgggccgcccggcggcggctggcccagaatgccctgaacaccttcagcatcgccagtgaccctgccagcagcagcagctgctacctggaggagcacgtgtccaaggaggccaaggccctgatcagccggctgcaggagctgatggccggccctggccactttgacccctacaaccaggtggtggtgtctgtggccaacgtcatcggggccatgtgcttcggccagcacttccctgagagcagtgatgagatgctgagcctggtgaagaacacccatgaatttgtggagacagccagcagcggcaaccccctggacttcttccccatcctgcgctacctgcccaacccagccctgcagcgcttcaaggccttcaaccagcgcttcctgtggttcctgcagaagacagtgcaggagcactaccaggactttgacaagaacagcgtgcgggacatcaccggggccctcttcaagcacagcaagaagggcccccgggccagcggcaacctgatcccccaggagaagatcgtgaacctggtgaatgacatctttggagctggctttgacacagtgaccacagccatctcctggagcctgatgtacctggtgaccaagccagagatccagaggaagatccagaaggagctggacacagtgattggccgggagcggcggccccggctgagtgaccggccccagctgccctacctggaggccttcatcctggagaccttccgccacagcagcttcctgcccttcaccatcccccacagcaccacccgggacaccaccctgaatggcttctacatccccaagaagtgctgcgtgtttgtgaaccagtggcaggtgaaccacgaccctgagctgtgggaggaccccagcgagttccggcctgagcgcttcctgacagcagatggaacagccatcaacaagcccctgtctgagaagatgatgctgtttggcatgggcaagaggcgctgcattggagaggtgctggccaagtgggagatcttcctgttcctggccatcctgctgcagcagctggagttctctgtgcccccaggagtgaaggtggacctgacccccatctacggcctgaccatgaagcacgcccgctgtgagcacgtgcaggcccggctgcgcttcagcatcaactag

SEQ ID NO: 149032 - DNA, 1512 bp, Artificial Sequence
  Description of Artificial Sequence: Synthetic coding sequence
atggccctgcgggccaaggccgaggtgtgcatggctgtgccctggctgagcctgcagagggcccaggccctgggcacccgggccgcccgggtgcccaggacagtgctgccctttgaggccatgcccaggaggcctggcaaccgctggctgcggctgctgcagatctggagggagcagggctatgaggacctgcacctggaggtgcaccagaccttccaggagctgggccccatcttccgctatgacctgggcggggccggcatggtgtgtgtgatgctgcctgaagatgtggagaagctgcagcaggtggacagcctgcacccccacaggatgagcctggagccctgggtggcctaccggcagcaccggggccacaagtgtggggtcttcctgctgaatggacctgagtggaggttcaaccggctgcggctgaaccctgaggtgctgagccccaatgctgtgcagcgcttcctgcccatggtggatgctgtggcccgggacttcagccaggccctgaagaagaaggtgctgcagaatgcccggggcagcctgaccctggatgtgcagcccagcatcttccactacaccatcgaggccagcaacctggccctgtttggagagcggctgggcctggtgggccacagccccagcagcgccagcctgaacttcctgcacgccctggaggtgatgttcaagagcacagtgcagctgatgttcatgcccaggagcctgagccgctggaccagccccaaggtgtggaaggagcactttgaggcctgggactgcatcttccagtacggggacaactgcatccagaagatctaccaggagctggccttcagccggccccagcagtacaccagcatcgtggccgagctgctgctgaatgctgagctgagcccagatgccatcaaggccaacagcatggagctgacagctggctctgtggacaccaccgtcttccccctgctgatgaccctgtttgagctggccaggaaccccaacgtgcagcaggccctgcggcaggagagcctggccgccgccgccagcatcagcgagcacccccagaaggccaccacagagctgcccctgctgcgggccgccctgaaggagaccctgcggctgtaccctgtgggcctcttcctggagcgggtggccagcagtgacctggtgctgcagaactaccacatcccagctggcaccctggtgcgggtcttcctgtacagcctgggcaggaacccagccctcttccccaggcctgagcgctacaacccccagcgctggctggacatccggggcagcggcaggaacttctaccacgtgccctttggatttggcatgaggcagtgcctgggccgccgcctggccgaggccgagatgctgctgctgctgcaccacgtgctgaagcacctgcaggtggagaccctgacccaggaggacatcaagatggtgtacagcttcatcctgcggcccagcatgttccccctgctgaccttccgggccatcaactag

SEQ ID NO: 149033 - DNA, 1314 bp, Artificial Sequence
  Description of Artificial Sequence: Synthetic coding sequence
atggccctgcgggccaaggccgaggtgtgcatggctgtgccctggctgagcctgcagagggcccaggccctgggcacccgggccgcccgggtgcccaggacagtgctgccctttgaggccatgcccaggaggcctggcaaccgctggctgcggctgctgcagatctggagggagcagggctatgaggacctgcacctggaggtgcaccagaccttccaggagctgggccccatcttccgctatgacctgggcggggccggcatggtgtgtgtgatgctgcctgaagatgtggagaagctgcagcaggtggacagcctgcacccccacaggatgagcctggagccctgggtggcctaccggcagcaccggggccacaagtgtggggtcttcctgctgaatggacctgagtggaggttcaaccggctgcggctgaaccctgaggtgctgagccccaatgctgtgcagcgcttcctgcccatggtggatgctgtggcccgggacttcagccaggccctgaagaagaaggtgctgcagaatgcccggggcagcctgaccctggatgtgcagcccagcatcttccactacaccatcgaggccagcaacctggccctgtttggagagcggctgggcctggtgggccacagccccagcagcgccagcctgaacttcctgcacgccctggaggtgatgttcaagagcacagtgcagctgatgttcatgcccaggagcctgagccgctggaccagccccaaggtgtggaaggagcactttgaggcctgggactgcatcttccagtacggggacaactgcatccagaagatctaccaggagctggccttcagccggccccagcagtacaccagcatcgtggccgagctgctgctgaatgctgagctgagcccagatgccatcaaggccaacagcatggagctgacagctggctctgtggacaccaccgtcttccccctgctgatgaccctgtttgagctggccaggaaccccaacgtgcagcaggccctgcggcaggagagcctggccgccgccgccagcatcagcgagcacccccagaaggccaccacagagctgcccctgctgcgggccgccctgaaggagaccctgcggctgtaccctgtgggcctcttcctggagcgggtggccagcagtgacctggtgctgcagaactaccacatcccagctggggtgctgaagcacctgcaggtggagaccctgacccaggaggacatcaagatggtgtacagcttcatcctgcggcccagcatgttccccctgctgaccttccgggccatcaactag

SEQ ID NO: 149034 - DNA, 1512 bp, Artificial Sequence
  Description of Artificial Sequence: Synthetic coding sequence
atggccctgcgggccaaggccgaggtgtgtgtggccgccccctggctgagcctgcagagggcccgggccctgggcacccgggccgcccgggcccccaggacagtgctgccctttgaggccatgccccagcaccctggcaaccgctggctgcggctgctgcagatctggagggagcagggctatgagcacctgcacctggagatgcaccagaccttccaggagctgggccccatcttccgctacaacctgggcggccccaggatggtgtgtgtgatgctgcctgaagatgtggagaagctgcagcaggtggacagcctgcacccctgcaggatgatcctggagccctgggtggcctaccggcagcaccggggccacaagtgtggggtcttcctgctgaatggacctgagtggaggttcaaccggctgcggctgaacccagatgtgctgagccccaaggctgtgcagcgcttcctgcccatggtggatgctgtggcccgggacttcagccaggccctgaagaagaaggtgctgcagaatgcccggggcagcctgaccctggatgtgcagcccagcatcttccactacaccatcgaggccagcaacctggccctgtttggagagcggctgggcctggtgggccacagccccagcagcgccagcctgaacttcctgcacgccctggaggtgatgttcaagagcacagtgcagctgatgttcatgcccaggagcctgagccgctggatcagccccaaggtgtggaaggagcactttgaggcctgggactgcatcttccagtacggggacaactgcatccagaagatctaccaggagctggccttcaaccggccccagcactacacaggaattgtggccgagctgctgctgaaggccgagctgagcctggaggccatcaaggccaacagcatggagctgacagctggctctgtggacaccacagccttccccctgctgatgaccctgtttgagctggccaggaacccagatgtgcagcagatcctgcggcaggagagcctggccgccgccgccagcatcagcgagcacccccagaaggccaccacagagctgcccctgctgcgggccgccctgaaggagaccctgcggctgtaccctgtgggcctcttcctggagcgggtggtgtccagtgacctggtgctgcagaactaccacatcccagctggcaccctggtgcaggtgttcctgtacagcctgggcagaaatgctgccctcttccccaggcctgagcgctacaacccccagcgctggctggacatccggggcagcggcaggaacttccaccacgtgccctttggatttggcatgaggcagtgcctgggccgccgcctggccgaggccgagatgctgctgctgctgcaccacgtgctgaagcacttcctggtggagaccctgacccaggaggacatcaagatggtgtacagcttcatcctgcggcccggcaccagccccctgctgaccttccgggccatcaactag

SEQ ID NO: 149035 - DNA, 1527 bp, Artificial Sequence
  Description of Artificial Sequence: Synthetic coding sequence
atgtgggagctggtggccctgctgctgctgaccctggcctacctgttctggcccaagaggcgctgccctggggccaagtaccccaagagcctgctgagcctgcccctggtgggcagcctgcccttcctgcccaggcatggccacatgcacaacaacttcttcaagctgcagaagaagtatggccccatctacagcgtgaggatgggcaccaagaccaccgtgattgtgggccaccaccagctggccaaggaggtgctgatcaagaagggcaaggacttcagcggccggccccagatggccaccctggacatcgccagcaacaacaggaagggcatcgcctttgctgacagcggggcccactggcagctgcaccggcggctggccatggccacctttgccctcttcaaggatggagaccagaagctggagaagatcatctgccaggagatcagcaccctgtgtgacatgctggccacccacaacggccagagcattgacatctccttccctgtgtttgtggccgtgaccaacgtcatcagcctcatctgcttcaacaccagctacaagaatggagaccctgagctgaatgtcatccagaactacaatgaaggcatcatcgacaacctgagcaaggacagcctggtggacctggtgccctggctgaagatcttccccaacaagaccctggagaagctgaagagccacgtgaagatcagaaatgacctgctgaacaagatcctggagaactacaaggagaagttcagaagtgacagcatcaccaacatgctggacaccctgatgcaggccaagatgaacagcgacaatggaaatgccggccctgaccaggacagcgagctgctgagtgacaaccacatcctgaccaccatcggggacatctttggagctggggtggagaccaccacctctgtggtgaagtggaccctggccttcctgctgcacaacccccaggtgaagaagaagctgtatgaggagattgaccagaatgtgggcttcagcaggacccccaccatcagtgacaggaaccggctgctgctgctggaggccaccatccgggaggtgctgcggctgcggcctgtggcccccatgctgatcccccacaaggccaacgtggacagcagcattggagaatttgctgtggacaagggcacagaggtgatcatcaacctgtgggccctgcaccacaatgagaaggagtggcaccagcctgaccagttcatgcctgagcgcttcctgaacccagctggcacccagctgatcagccccagcgtgtcctacctgccctttggagctggccccaggagctgcattggagagatcctggcccggcaggagctgttcctgatcatggcctggctgctgcagagatttgacctggaggtgcctgatgatggccagctgcccagcctggagggcatccccaaggtggtgttcctgattgacagcttcaaggtgaagatcaaggtgcggcaggcctggagggaggcccaggccgagggcagcacctag

SEQ ID NO: 149036 - DNA, 1512 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatgaaagtgccatcgtggtgaagatccagggctactttgatgcctggcaggccctgctgatcaagccagacatcttcttcaagatctcctggctgtacaagaagtatgagaagtctgtgaaggacctgaaggatgccatcgaggtgctgattgctgagaagagaagacgcatcagcacagaggagaagctggaggagtgcatggactttgccacagagctgatcctggccgagaagagaggagacctgacccgggagaatgtgaaccagtgcatcctggagatgctgattgctgccccagacaccatgtctgtgtccctcttcttcatgctgttcctgattgccaagcaccccaacgtggaggaggccatcatcaaggagatccagaccgtcatcggggagcgggacatcaagattgatgacatccagaagctgaaggtgatggagaacttcatctatgaatccatgagataccagcctgtggtggacctggtgatgaggaaggccctggaggatgatgtgattgatggctaccctgtgaagaagggcaccaacatcatcctgaacatcggccgcatgcaccggctggagttcttccccaagcccaatgagttcaccctggagaactttgccaagaatgtgccctaccgctacttccagcccttcggcttcggcccccggggctgtgccggcaagtacatcgccatggtgatgatgaaggccatcctggtgaccctgctgcggcgcttccacgtgaagaccctgcagggccagtgtgtggagagcatccagaagatccatgacctgagcctgcacccagatgagaccaagaacatgctggagatgatcttcaccccaagaaacagcgaccgctgcctggagcactag

SEQ ID NO: 149037 - DNA, 1512 bp, Artificial Sequence; identical to SEQ ID NO: 149036
  Description of Artificial Sequence: Synthetic coding sequence

SEQ ID NO: 149038 - DNA, 1512 bp, Artificial Sequence; identical to SEQ ID NO: 149036
  Description of Artificial Sequence: Synthetic coding sequence

SEQ ID NO: 149039 - DNA, 501 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagtag

SEQ ID NO: 149040 - DNA, 657 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatggaacagagatcttcaccctgaccagctag

SEQ ID NO: 149041 - DNA, 1080 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatgaaagtgccatcgtggtgaagatccagggctactttgatgcctggcaggccctgctgatcaagccagacatcttcttcaagatctcctggctgtacaagaagtatgagaagtctgtgaaggacctgaaggatgccatcgaggtgctgattgctgagaagagaagacgcatcagcacagaggagaagctggaggagtgcatggactttgccacagagctgatcctggccgagaagagaggagacctgacccgggagaatgtgaaccagtgcatcctggagatgctgattgctgccccagacaccatgtctgtgtccctcttcttcatgctgttcctgattgccaagcaccccaacgtggaggaggccatcatcaaggagatccagaccgtcatcggggagcgggacatcaagattgatgacatccagaagctgaagaagcatgatgccaagtag

SEQ ID NO: 149042 - DNA, 1059 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatgaaagtgccatcgtggtgaagatccagggctactttgatgcctggcaggccctgctgatcaagccagacatcttcttcaagatctcctggctgtacaagaagtatgagaagtctgtgaaggacctgaaggatgccatcgaggtgctgattgctgagaagagaagacgcatcagcacagaggagaagctggaggagtgcatggactttgccacagagctgatcctggccgagaagagaggagacctgacccgggagaatgtgaaccagtgcatcctggagatgctgattgctgccccagacaccatgtctgtgtccctcttcttcatgctgttcctgattgccaagcaccccaacgtggaggaggccatcatcaaggagatccagaccgtcatcggggagcgggacatcaagattgatgacatccagaagtag

SEQ ID NO: 149043 - DNA, 729 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatgaaagtgccatcgtggtgaagatccagggctactttgatgcctggcaggccctgctgatcaagccagacatcttcttcaagatctcctggctgtacaagtag

SEQ ID NO: 149044 - DNA, 546 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctgctgctcttcaccccagcctctgtgaactag

SEQ ID NO: 149045 - DNA, 657 bp, Artificial Sequence; identical to SEQ ID NO: 149040
  Description of Artificial Sequence: Synthetic coding sequence

SEQ ID NO: 149046 - DNA, 1059 bp, Artificial Sequence; identical to SEQ ID NO: 149042
  Description of Artificial Sequence: Synthetic coding sequence

SEQ ID NO: 149047 - DNA, 852 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctggaccggctggaggaggtgaccaatgaaagtggctacgtggatgtgctgaccctgctgcggcgggtgatgctggacaccagcaacaccctcttcctgcgcatccccctggatgaaagtgccatcgtggtgaagatccagggctactttgatgcctggcaggccctgctgatcaagccagacatcttcttcaagatctcctggctgtacaagaagtatgagaagtctgtgaaggacctgaaggatgccatcgaggtgctgattgctgagaagagaagacgcatcagcacagaggagaagctggaggagtgcatggactttgccacagagctgatctag

SEQ ID NO: 149048 - DNA, 498 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgcctag

SEQ ID NO: 149049 - DNA, 1512 bp, Artificial Sequence; identical to SEQ ID NO: 149036
  Description of Artificial Sequence: Synthetic coding sequence

SEQ ID NO: 149050 - DNA, 519 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggccctgagcggccctggcctggtgaggatggtgacagtgtgtgccgagagcctgaagacccacctgtag

SEQ ID NO: 149051 - DNA, 735 bp, Artificial Sequence
  Description of Artificial Sequence: Synthetic coding sequence
atggtgctggagatgctgaaccccatccactacaacatcaccagcatcgtgcctgaggccatgcctgctgccaccatgcctgtgctgctgctgaccggcctcttcctgctggtgtggaactatgagggcaccagcagcatccctggccctggctactgcatgggcatcggccccctcatcagccacggccgcttcctgtggatgggcatcggcagcgcctgcaactactacaacagagtgtatggagagttcatgagggtgtggatcagcggggaggagaccctcatcatcagcaagagcagctccatgttccacatcatgaagcacaaccactacagcagccgcttcggcagcaagctgggcctgcagtgcatcggcatgcatgagaagggcatcatcttcaacaacaaccctgagctgtggaagaccacccggcccttcttcatgaaggagagcgccatcgtggtgaagatccagggctactttgatgcctggcaggccctgctgatcaagccagacatcttcttcaagatctcctggctgtacaagaagtatgagaagtctgtgaaggacctgaaggatgccatcgaggtgctgattgctgagaagagaagacgcatcagcacagaggagaagctggaggagtgcatggactttgccacagagctgatcctggccgagaagagaggagacctgaccagagaaaatgtgaaccagtgcatcctggagatgtag

SEQ ID NO: 149052 - DNA, 1485 bp, Artificial Sequence
  Description of Artificial Sequence: Synthetic coding sequence
atgctggccagcggcctgctgctggtgaccctgctggcctgcctgactgtgatggtgctgatgtctgtgtggaggcagaggaagagccggggcaagctgcccccaggccccacccccctgcccttcatcggcaactacctgcagctgaacacagagcagatgtacaacagcctgatgaagatcagcgagagatatggccctgtgttcaccatccacctgggcccccggcgggtggtggtgctgtgtggccatgatgctgtgaaggaggccctggtggaccaggccgaggagttcagcggccgcggggagcaggccacctttgactggctgttcaagggctacggcgtggccttcagcaatggagagcgggccaagcagctgcggcgcttcagcatcgccaccctgcggggcttcggcgtgggcaagaggggcatcgaggagcgcatccaggaggaggccggcttcctgattgatgccctgcggggcacccacggggccaacatcgaccccaccttcttcctgagcaggacagtgtccaatgtcatcagcagcatcgtgtttggagacagatttgattatgaggacaaggagttcctgagcctgctgaggatgatgctgggcagcttccagttcaccgccaccagcacaggccagctgtatgagatgttcagctctgtgatgaagcacctgcccggcccccagcagcaggccttcaaggagctgcagggcctggaggacttcatcgccaagaaggtggagcacaaccagaggaccctggaccccaacagcccccgggacttcatcgacagcttcctgatccgcatgcaggaggaggagaagaaccccaacacagagttctacctgaagaacctggtgatgaccaccctgaacctcttctttgctggaacagaaacagtgtccaccaccctgcgctatggcttcctgctgctgatgaagcaccctgaggtggaggccaaggtgcatgaggagattgacagagtgattggcaagaaccggcagcccaagtttgaggaccgggccaagatgccctacacagaggccgtcatccacgagatccagagatttggagacatgctgcccatgggcctggcccaccgggtgaacaaggacaccaagttccgggacttcttcctgcccaagggcacagaggtgttccccatgctgggctctgtgctgcgggacccccgcttcttcagcaacccccgggacttcaacccccagcacttcctggacaagaagggccagttcaagaagagtgatgcctttgtgcccttcagcatcggcaagcgctactgcttcggggagggcctggccaggatggagctgttcctgttcttcaccaccatcatgcagaacttccgcttcaagagcccccagagccccaaggacattgatgtgagccccaagcacgtgggctttgccaccatccccaggaactacaccatgtccttcctgcccaggtag

SEQ ID NO: 149053 - DNA, 1485 bp, Artificial Sequence
  Description of Artificial Sequence: Synthetic coding sequence
atgctggccagcggcatgctgctggtggccctgctggtgtgcctgactgtgatggtgctgatgtctgtgtggcagcagaggaagagcaagggcaagctgcccccaggccccacccccctgcccttcatcggcaactacctgcagctgaacacagagcagatgtacaacagcctgatgaagatcagcgagagatatggccctgtgttcaccatccacctgggcccccggcgggtggtggtgctgtgtggccatgatgctgtgcgggaggccctggtggaccaggccgaggagttcagcggccgcggggagcaggccacctttgactgggtgttcaagggctacggcgtggtgttcagcaatggagagcgggccaagcagctgcggcgcttcagcatcgccaccctgcgggactttggagtgggcaagaggggcatcgaggagcgcatccaggaggaggccggcttcctgattgatgccctgcggggcactggaggagccaacatcgaccccaccttcttcctgagcaggacagtgtccaatgtcatcagcagcatcgtgtttggagacagatttgactacaaggacaaggagttcctgagcctgctgaggatgatgctgggcatcttccagttcaccagcaccagcacaggccagctgtatgagatgttcagctctgtgatgaagcacctgcccggcccccagcagcaggccttccagctgctgcagggcctggaggacttcatcgccaagaaggtggagcacaaccagaggaccctggaccccaacagcccccgggacttcatcgacagcttcctgatccgcatgcaggaggaggagaagaaccccaacacagagttctacctgaagaacctggtgatgaccaccctgaacctcttcatcggcggcacagaaacagtgtccaccaccctgcgctatggcttcctgctgctgatgaagcaccctgaggtggaggccaaggtgcatgaggagattgacagagtgattggcaagaaccggcagcccaagtttgaggaccgggccaagatgccctacatggaggccgtcatccacgagatccagagatttggagatgtgatccccatgagcctggcccggcgggtgaagaaggacaccaagttccgggacttcttcctgcccaagggcacagaggtgttccccatgctgggctctgtgctgcgggaccccagcttcttcagcaacccccaggacttcaacccccagcacttcctgaatgagaagggccagttcaagaagagtgatgcctttgtgcccttcagcatcggcaagaggaactgcttcggggagggcctggccaggatggagctgttcctgttcttcaccaccgtgatgcagaacttccggctgaagagcagccagagccccaaggacattgatgtgagccccaagcacgtgggctttgccaccatccccaggaactacaccatgtccttcctgcccaggtag

SEQ ID NO: 149054 - DNA, 1332 bp, Artificial Sequence
  Description of Artificial Sequence: Synthetic coding sequence
atgctggccagcggcctgctgctggtggccctgctggcctgcctgactgtgatggtgctgatgtctgtgtggcagcagaggaagagccggggcaagctgcccccaggccccacccccctgcccttcatcggcaactacctgcagctgaacacagagcacatctgtgacagcatcatgaaggtgtcccagggcgtggccttcagcaatggagagcgggccaagcagctgctgcgctttgccatcgccaccctgcgggactttggagtgggcaagaggggcatcgaggagcgcatccaggaggagagcggcttcctgattgaggccatccgcagcacccatggagccaacatcgaccccaccttcttcctgagcaggacagtgtccaatgtcatcagcagcatcgtgtttggagacagatttgattatgaggacaaggagttcctgagcctgctgtccatgatgctgggcatcttccagttcaccagcaccagcacaggccagctgtatgagatgttcagctctgtgatgaagcacctgcccggcccccagcagcaggccttcaagctgctgcagggcctggaggacttcatcgccaagaaggtggagcacaaccagaggaccctggaccccaacagcccccaggacttcatcgacagcttcctgatccacatgcaggaggaggagaagaaccccaacacagagttctacctgaagaacctgatgatgagcaccctgaacctcttcatcgccggcacagagaccgtgtccaccaccctgcgctatggcttcctgctgctgatgaagcaccctgaggtggaggccaaggtgcatgaggagattgacagagtcatcggcaagaaccggcagcccaagtttgaggacaggaccaagatgccctacatggaggccgtcatccacgagatccagagatttggagatgtgatccccatgagcctggccaggagagtgaagaaggacaccaagttccgggacttcttcctgcccaagggcacagaggtgttccccatgctgggctctgtgctgcgggaccccagcttcttcagcaacccccaggacttcaacccccagcacttcctggatgacaagggccagttcaagaagagtgatgcctttgtgcccttcagcatcggcaagaggaactgctttggagagggcctggccaggatggagctgttcctgttcttcaccaccgtgatgcagaacttccggctgaagagcagccagagccccaaggacattgatgtgagccccaagcacgtggtgtttgccaccatccccaggaactacaccatgtccttcctgcccaggtag

SEQ ID NO: 149055 - DNA, 1485 bp, Artificial Sequence
  Description of Artificial Sequence: Synthetic coding sequence
atgctggccagcggcctgctgctggtggccctgctggcctgcctgactgtgatggtgctgatgtctgtgtggcagcagaggaagagccggggcaagctgcccccaggccccacccccctgcccttcatcggcaactacctgcagctgaacacagagcacatctgtgacagcatcatgaagttctctgaatgttatggccctgtgttcaccatccacctgggcccccggcgggtggtggtgctgtgtggccatgatgctgtgcgggaggccctggtggaccaggccgaggagttcagcggccgcggggagcaggccacctttgactgggtgttcaagggctacggcgtggccttcagcaatggagagcgggccaagcagctgctgcgctttgccatcgccaccctgcgggactttggagtgggcaagaggggcatcgaggagcgcatccaggaggagagcggcttcctgattgaggccatccgcagcacccacggggccaacatcgaccccaccttcttcctgagcaggacagtgtccaatgtcatcagcagcatcgtgtttggagacagatttgattatgaggacaaggagttcctgagcctgctgtccatgatgctgggcatcttccagttcaccagcaccagcacaggccagctgtatgagatgttcagctctgtgatgaagcacctgcccggcccccagcagcaggccttcaagctgctgcagggcctggaggacttcatcgccaagaaggtggagcacaaccagaggaccctggaccccaacagcccccaggacttcatcgacagcttcctgatccacatgcaggaggaggagaagaaccccaacacagagttctacctgaagaacctgatgatgagcaccctgaacctcttcatcgccggcacagaaacagtgtccaccaccctgcgctatggcttcctgctgctgatgaagcaccctgaggtggaggccaaggtgcatgaggagattgacagagtgattggcaagaaccggcagcccaagtttgaggacaggaccaagatgccctacatggaggccgtcatccacgagatccagagatttggagatgtgatccccatgagcctggcccggcgggtgaagaaggacaccaagttccgggacttcttcctgcccaagggcacagaggtgttccccatgctgggctctgtgctgcgggaccccagcttcttcagcaacccccaggacttcaacccccagcacttcctggatgacaagggccagttcaagaagagtgatgcctttgtgcccttcagcatcggcaagaggaactgcttcggggagggcctggccaggatggagctgttcctgttcttcaccaccgtgatgcagaacttccggctgaagagcagccagagccccaaggacattgatgtgagccccaagcacgtggtgtttgccaccatccccaggaactacaccatgtccttcctgcccaggtag

SEQ ID NO: 149056 - DNA, 1476 bp, Artificial Sequence
  Description of Artificial Sequence: Synthetic coding sequence
atggagctgtctgtgctgctcttcctggccctgctgaccggcctgctgctgctgctggtgcagaggcaccccaacacccatgaccggctgcccccaggcccccggcccctgcccctgctgggcaacctgctgcagatggaccggcggggcctgctgaagagcttcctgcgcttccgggagaagtatggagatgtgttcaccgtgcacctgggccccaggcctgtggtgatgctgtgtggggtggaggccatccgggaggccctggtggacaaggccgaggccttcagcggccggggcaagatcgccatggtggaccccttcttccggggctatggagtcatctttgccaatggaaaccgctggaaggtgctgcggcgcttctctgtgaccaccatgagggactttggcatgggcaagaggtctgtggaggagcgcatccaggaggaggcccagtgcctgattgaggagctgaggaagagcaaaggagccctgatggaccccaccttcctgttccagagcatcacagccaacatcatctgcagcatcgtgtttgggaagcgcttccactaccaggaccaggagttcctgaagatgctgaacctcttctaccagaccttcagcctcatcagctctgtgtttggccagctgtttgagctgttcagcggcttcctgaagtacttccctggggcccaccggcaggtgtacaagaacctgcaggagatcaatgcctacatcggccacagcgtggagaagcaccgggagaccctggaccccagcgcccccaaggacctgattgacacctacctgctgcacatggagaaggagaagagcaatgcccacagcgagttcagccaccagaacctgaacctgaacaccctgagcctcttctttgctggaacagagaccaccagcaccaccctgcgctatggcttcctgctgatgctgaagtacccccacgtggccgagcgggtgtaccgggagattgagcaggtgattggcccccacaggcctcctgagctgcatgaccgggccaagatgccctacacagaagctgtgatctatgagatccagcgcttcagtgacctgctgcccatgggcgtgccccacatcgtgacccagcacaccagcttccggggctacatcatccccaaggacacagaggtgttcctgatcctgagcacagccctgcatgacccccactactttgagaagccagatgccttcaacccagaccacttcctggatgccaatggagccctgaagaagacagaggccttcatccccttcagcctgggcaagaggatctgcctgggggagggcatcgcccgggcagagctgttcctgttcttcaccaccatcctgcagaacttctccatggccagccctgtggcccctgaggacatcgacctgaccccccaggagtgtggggtgggcaagatcccccccacctaccagatccgcttcctgcccaggtag

SEQ ID NO: 149057 - DNA, 876 bp, Artificial Sequence
  Description of Artificial Sequence: Synthetic coding sequence
atgcgctgcatgctgaccaacagccacccctggtgtggctgtgactggcagttccgggagaagtatggagatgtgttcaccgtgcacctgggccccaggcctgtggtgatgctgtgtggggtggaggccatccgggaggccctggtggacaaggccgaggccttcagcggccggggcaagatcgccatggtggaccccttcttccggggctatggagtcatctttgccaatggaaaccgctggaaggtgctgcggcgcttctctgtgaccaccatgagggactttggcatgggcaagaggtctgtggaggagcgcatccaggaggaggcccagtgcctgattgaggagctgaggaagagcaaggagcgggtgtaccgggagattgagcaggtgattggcccccacaggcctcctgagctgcatgaccgggccaagatgccctacacagaagctgtgatctatgagatccagcgcttcagtgacctgctgcccatgggcgtgccccacatcgtgacccagcacaccagcttccggggctacatcatccccaaggacacagaggtgttcctgatcctgagcacagccctgcatgacccccactactttgagaagccagatgccttcaacccagaccacttcctggatgccaatggagccctgaagaagacagaggccttcatccccttcagcctgggcaagaggatctgcctgggggagggcatcgcccgggcagagctgttcctgttcttcaccaccatcctgcagaacttctccatggccagccctgtggcccctgaggacatcgacctgaccccccaggagtgtggggtgggcaagatcccccccacctaccagatccgcttcctgcccaggtag

SEQ ID NO: 149058 - DNA, 1473 bp, Artificial Sequence
  Description of Artificial Sequence: Synthetic coding sequence
atggacccctttgtggtgctggtgctgtgcctgagctgcctgctgctgctgagcatctggaggcagagcagcggccggggcaagctgcccccaggccccacccccctgcctgtgattggcaacatcctgcagattgacatcaaggatgtgtccaagagcctgaccaacctgagcaagatctacggccctgtgttcaccctgtacttcggcctggagaggatggtggtgctgcacggctatgaggtggtgaaggaggccctgattgacctgggggaggagttcagcggccggggccacttccccctggccgagcgggccaacagaggcttcggcatcgtgttcagcaatggcaagcgctggaaggagatccgccgcttcagcctgatgaccctgaggaactttggcatgggcaagaggagcattgaggacagagtgcaggaggaggcccgctgcctggtggaggagctgaggaagaccaaggccagcccctgtgaccccaccttcatcctgggctgtgccccctgcaacgtcatctgcagcatcatcttccagaagagatttgactacaaggaccagcagttcctgaacctgatggagaagctgaatgaaaacatcagaattgtgtccaccccctggatccagatctgcaacaacttccccaccatcatcgactacttccctggcacccacaacaagctgctgaagaacctggccttcatggagagtgacatcctggagaaggtgaaggagcaccaggagagcatggacatcaacaacccccgggacttcatcgactgcttcctgatcaagatggagaaggagaagcagaaccagcagagcgagttcaccatcgagaacctggtgatcacagctgctgacctgctgggcgccggcacagagaccaccagcaccaccctgcgctatgccctgctgctgctgctgaagcaccctgaggtgacagccaaggtgcaggaggagattgagcgggtggtgggcaggaacagaagcccctgcatgcaggaccggggccacatgccctacacagatgctgtggtgcatgaggtgcagcgctacatcgacctgatccccaccagcctgccccatgctgtgacctgtgatgtgaagttcaggaactacctgatccccaagggcaccaccatcctgaccagcctgacctctgtgctgcatgacaacaaggagttccccaaccctgagatgtttgaccccaggcacttcctggatgagggcggcaacttcaagaagagcaactacttcatgcccttctctgctgggaagaggatctgtgtgggggagggcctggccaggatggagctgttcctgttcctgaccttcatcctgcagaacttcaacctgaagagcctgattgaccccaaggacctggacaccacccctgtggtgaatggatttgcctctgtgccccccttctaccagctgtgcttcatccctgtgtag

SEQ ID NO: 149059 - DNA, 1473 bp, Artificial Sequence
  Description of Artificial Sequence: Synthetic coding sequence
atggagccctttgtggtgctggtgctgtgcctgtccttcatgctgctcttcagcctgtggaggcagagctgcagaagaaggaagctgcccccaggccccacccccctgcccatcatcggcaacatgctgcagattgatgtgaaggacatctgcaagagcttcaccaacttcagcaaggtgtatggccctgtgttcaccgtgtacttcggcatgaaccccatcgtggtgttccacggctatgaggccgtgaaggaggccctgattgacaacggggaggagttcagcggccggggcaacagccccatcagccagaggatcaccaagggcctgggcatcatcagcagcaatggcaagcgctggaaggagatccgccgcttcagcctgaccaccctgaggaactttggcatgggcaagaggagcattgaggacagagtgcaggaggaggcccactgcctggtggaggagctgaggaagaccaaggccagcccctgtgaccccaccttcatcctgggctgtgccccctgcaacgtcatctgcagcgtggtgttccagaagagatttgactacaaggaccagaacttcctgaccctgatgaagcgcttcaatgaaaacttccgcatcctgaacagcccctggatccaggtgtgcaacaacttccccctgctgattgactgcttccctggcacccacaacaaggtgctgaagaatgtggccctgaccaggagctacatccgggagaaggtgaaggagcaccaggccagcctggatgtgaacaacccccgggacttcatcgactgcttcctgatcaagatggagcaggagaaggacaaccagaagtctgagttcaacatcgagaacctggtgggcaccgtggccgacctgtttgtggccggcacagagaccaccagcaccaccctgcgctatggcctgctgctgctgctgaagcaccctgaggtgacagccaaggtgcaggaggagattgaccacgtgattggccgccacaggagcccctgcatgcaggacaggagccacatgccctacacagatgctgtggtgcatgagatccagcgctacagcgacctggtgcccaccggggtgccccatgctgtgaccacagacaccaagttcaggaactacctgatccccaagggcaccaccatcatggccctgctgacctctgtgctgcatgatgacaaggagttccccaaccccaacatctttgatcctggccacttcctggacaagaatggaaacttcaagaagagtgactacttcatgcccttctctgctgggaagaggatctgtgccggggagggcctggccaggatggagctgttcctgttcctgaccaccatcctgcagaacttcaacctgaagtctgtggatgacctgaagaacctgaacaccacagctgtgaccaagggcatcgtgtccctgccccccagctaccagatctgcttcatccctgtgtag

SEQ ID NO: 149060 - DNA, 1374 bp, Artificial Sequence
  Description of Artificial Sequence: Synthetic coding sequence
atggagaggagcttcctggaggaggccatcccccagtacctgaaggagctgctgaaggacctggtgggcgcccacatctctgtgtctgccctggtgactggagtgcggggcatggagaacagagccctgaagagcttctctgctgagctgagcctgagcgcctggctgcccagcgtggccgccctgagcagcctggccgtgaacagccccagcttctgccccttcttcctgggcatcatcagcagcaatggcaagcgctggaaggagatccgccgcttcagcctgaccaccctgaggaactttggcatgggcaagaggagcattgaagatagagtgcaggaggaggcccactgcctggtggaggagctgaggaagaccaaggccagcccctgtgaccccaccttcatcctgggctgtgccccctgcaacgtcatctgcagcgtggtgttccagaagagatttgactacaaggaccagaacttcctgaccctgatgaagcgcttcaatgaaaacttccgcatcctgaacagcccctggatccaggtgtgcaacaacttccccctgctgattgactgcttccctggcacccacaacaaggtgctgaagaatgtggccctgaccaggagctacatccgggagaaggtgaaggagcaccaggccagcctggatgtgaacaacccccgggacttcatcgactgcttcctgatcaagatggagcaggagaaggacaaccagaagtctgagttcaacatcgagaacctggtgggcaccgtggccgacctgtttgtggccggcacagagaccaccagcaccaccctgcgctatggcctgctgctgctgctgaagcaccctgaggtgacagccaaggtgcaggaggagattgaccacgtgattggccgccacaggagcccctgcatgcaggacaggagccacatgccctacacagatgctgtggtgcatgagatccagcgctacagcgacctggtgcccactggagtgccccatgctgtgaccacagacaccaagttcaggaactacctgatccccaagggcaccaccatcatggccctgctgacctctgtgctgcatgatgacaaggagttccccaaccccaacatctttgaccccggccacttcctggacaagaatggaaacttcaagaagagtgactacttcatgcccttctctgctgggaagaggatctgtgccggggagggcctggccaggatggagctgttcctgttcctgaccaccatcctgcagaacttcaacctgaagtctgtggatgacctgaagaacctgaacaccacagctgtgaccaagggcatcgtgtccctgcccccatcctaccagatctgcttcatccctgtgtag

SEQ ID NO: 149061 - DNA, 1167 bp, Artificial Sequence
  Description of Artificial Sequence: Synthetic coding sequence
atgttcctgcagcccatcgccaagggcatcatcagcagcaatggcaagcgctggaaggagatccgccgcttcagcctgaccaccctgaggaactttggcatgggcaagaggagcattgaggacagagtgcaggaggaggcccactgcctggtggaggagctgaggaagaccaaggccagcccctgtgaccccaccttcatcctgggctgtgccccctgcaacgtcatctgcagcgtggtgttccagaagagatttgactacaaggaccagaacttcctgaccctgatgaagcgcttcaatgaaaacttccgcatcctgaacagcccctggatccaggtgtgcaacaacttccccctgctgattgactgcttccctggcacccacaacaaggtgctgaagaatgtggccctgaccaggagctacatccgggagaaggtgaaggagcaccaggccagcctggatgtgaacaacccccgggacttcatcgactgcttcctgatcaagatggagcaggagaaggacaaccagaagtctgagttcaacatcgagaacctggtgggcaccgtggccgacctgtttgtggccggcacagagaccaccagcaccaccctgcgctatggcctgctgctgctgctgaagcaccctgaggtgacagccaaggtgcaggaggagattgaccacgtgattggccgccacaggagcccctgcatgcaggacaggagccacatgccctacacagatgctgtggtgcatgagatccagcgctacagcgacctggtgcccaccggggtgccccatgctgtgaccacagacaccaagttcaggaactacctgatccccaagggcaccaccatcatggccctgctgacctctgtgctgcatgatgacaaggagttccccaaccccaacatctttgatcctggccacttcctggacaagaatggaaacttcaagaagagtgactacttcatgcccttctctgctgggaagaggatctgtgccggggagggcctggccaggatggagctgttcctgttcctgaccaccatcctgcagaacttcaacctgaagtctgtggatgacctgaagaacctgaacaccacagctgtgaccaagggcatcgtgtccctgccccccagctaccagatctgcttcatccctgtgtag

SEQ ID NO: 149062 - DNA, 924 bp, Artificial Sequence
  Description of Artificial Sequence: Synthetic coding sequence
atggccgccaagtgctgcagcaccttcttcctgggctgtgagttcagccagttcctgcccctcttcctgctgggcatcatcagcagcaatggcaagcgctggaaggagatccgccgcttcagcctgaccaccctgaggaactttggcatgggcaagaggagcattgaggacagagtgcaggaggaggcccactgcctggtggaggagctgaggaagaccaaggccagcccctgtgaccccaccttcatcctgggctgtgccccctgcaacgtcatctgcagcgtggtgttccagaagagatttgactacaaggaccagaacttcctgaccctgatgaagcgcttcaatgaaaacttccgcatcctgaacagcccctggatccaggtgtgcaacaacttccccctgctgattgactgcttccctggcacccacaacaaggtgctgaagaatgtggccctgaccaggagctacatccgggagaaggtgaaggagcaccaggccagcctggatgtgaacaacccccgggacttcatcgactgcttcctgatcaagatggagcaggagaaggacaaccagaagtctgagttcaacatcgagaacctggtgggcaccgtggccgacctgtttgtggccggcacagagaccaccagcaccaccctgcgctatggcctgctgctgctgctgaagcaccctgaggtgacagccaaggtgcaggaggagattgaccacgtgattggccgccacaggagcccctgcatgcaggacaggagccacatgccctacacagatgctgtggtgcatgagatccagcgctacagcgacctggtgcccaccggggtgccccatgctgtgaccacagacaccaagttcaggaactacctgatccccaagagctttgacaacaagatcatgctggccgcctag

SEQ ID NO: 149063 - DNA, 1473 bp, Artificial Sequence
  Description of Artificial Sequence: Synthetic coding sequence
atggacagcctggtggtgctggtgctgtgcctgagctgcctgctgctgctgagcctgtggaggcagagcagcggccggggcaagctgcccccaggccccacccccctgcctgtgattggcaacatcctgcagatcggcatcaaggacatcagcaagagcctgaccaacctgagcaaggtgtatggccctgtgttcaccctgtacttcggcctgaagcccatcgtggtgctgcacggctatgaggccgtgaaggaggccctgattgacctgggggaggagttcagcggccggggcatcttccccctggccgagcgggccaacagaggcttcggcatcgtgttcagcaatggcaagaagtggaaggagatccgccgcttcagcctgatgaccctgaggaactttggcatgggcaagaggagcattgaggacagagtgcaggaggaggcccgctgcctggtggaggagctgaggaagaccaaggccagcccctgtgaccccaccttcatcctgggctgtgccccctgcaacgtcatctgcagcatcatcttccacaagagatttgactacaaggaccagcagttcctgaacctgatggagaagctgaatgaaaacatcaagatcctgagcagcccctggatccagatctgcaacaacttcagccccatcatcgactacttccctggcacccacaacaagctgctgaagaatgtggccttcatgaagagctacatcctggagaaggtgaaggagcaccaggagagcatggacatgaacaacccccaggacttcatcgactgcttcctgatgaagatggagaaggagaagcacaaccagcccagcgagttcaccatcgagagcctggagaacacagctgtggacctgtttggagctggaacagagaccaccagcaccaccctgcgctatgccctgctgctgctgctgaagcaccctgaggtgacagccaaggtgcaggaggagattgagcgggtgattggaagaaacagaagcccctgcatgcaggacaggagccacatgccctacacagatgctgtggtgcatgaggtgcagcgctacatcgacctgctgcccaccagcctgccccatgctgtgacctgtgacatcaagttcaggaactacctgatccccaagggcaccaccatcctgatcagcctgacctctgtgctgcatgacaacaaggagttccccaaccctgagatgtttgacccccaccacttcctggatgagggcggcaacttcaagaagagcaagtacttcatgcccttctctgctgggaagaggatctgtgtgggggaggccctggccggcatggagctgttcctgttcctgaccagcatcctgcagaacttcaacctgaagagcctggtggaccccaagaacctggacaccacccctgtggtgaatggatttgcctctgtgccccccttctaccagctgtgcttcatccctgtgtag

SEQ ID NO: 149064 - DNA, 1362 bp, Artificial Sequence
  Description of Artificial Sequence: Synthetic coding sequence
atggacagcctggtggtgctggtgctgtgcctgagctgcctgctgctgctgagcctgtggaggcagagcagcggccggggcaagctgcccccaggccccacccccctgcctgtgattggcaacatcctgcagatcggcatcaaggacatcagcaagagcctgaccaacctgagcaaggtgtatggccctgtgttcaccctgtacttcggcctgaagcccatcgtggtgctgcacggctatgaggccgtgaaggaggccctgattgacctgggggaggagttcagcggccggggcatcttccccctggccgagcgggccaacagaggcttcggcatcgtgttcagcaatggcaagaagtggaaggagatccgccgcttcagcctgatgaccctgaggaactttggcatgggcaagaggagcattgaggacagagtgcaggaggaggcccgctgcctggtggaggagctgaggaagaccaaggccagcccctgtgaccccaccttcatcctgggctgtgccccctgcaacgtcatctgcagcatcatcttccacaagagatttgactacaaggaccagcagttcctgaacctgatggagaagctgaatgaaaacatcaagatcctgagcagcccctggatccagatctgcaacaacttcagccccatcatcgactacttccctggcacccacaacaagctgctgaagaatgtggccttcatgaagagctacatcctggagaaggtgaaggagcaccaggagagcatggacatgaacaacccccaggacttcatcgactgcttcctgatgaagatggagaaggagaagcacaaccagcccagcgagttcaccatcgagagcctggagaacacagctgtggacctgtttggagctggaacagagaccaccagcaccaccctgcgctatgccctgctgctgctgctgaagcaccctgaggtgacagccaaggtgcaggaggagattgagcgggtgattggaagaaacagaagcccctgcatgcaggacaggagccacatgccctacacagatgctgtggtgcatgaggtgcagcgctacatcgacctgctgcccaccagcctgccccatgctgtgacctgtgacatcaagttcaggaactacctgatccccaagggcaccaccatcctgatcagcctgacctctgtgctgcatgacaacaaggagttccccaaccctgagatgtttgacccccaccacttcctggatgagggcggcaacttcaagaagagcaagtacttcatgctggtgctgaagatgatcagaacagagaggaccaagaggaagagggtgggcaagctgttctgggtgtctgtgcgggtgacctag

SEQ ID NO: 149065 - DNA, 1341 bp, Artificial Sequence
  Description of Artificial Sequence: Synthetic coding sequence
atgggcctggaggccctggtgcccctggccgtcatcgtggccatcttcctgctgctggtggacctgatgcaccggcggcagcgctgggccgcccgctacccacctggccccctgcccctgcccggcctgggcaacctgctgcacgtggacttccagaacaccccctactgctttgaccagctgcggaggagatttggagatgtgttcagcctgcagctggcctggacccctgtggtggtgctgaatggcctggccgctgtgcgggaggccctggtgacccacggggaggacacagctgaccggccccctgtgcccatcacccagatcctgggcttcggccccaggagccagggccggcccttccggcccaacggcctgctggacaaggctgtgtccaatgtgattgccagcctgacctgtggccgccgctttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccgagatggagaaggccaagggcaaccctgagagcagcttcaatgatgagaacctgtgcatcgtggtggccgacctcttctctgctggcatggtgaccaccagcaccaccctggcctggggcctgctgctgatgatcctgcacccagatgtgcagaggagagtgcagcaggagattgatgatgtgattggccaggtgcggcggcctgagatgggagaccaggcccacatgccctacaccacagctgtgatccacgaggtgcagagatttggagacatcgtgcccctgggcgtgacccacatgaccagccgggacatcgaggtgcagggcttccgcatccccaagggcaccaccctcatcaccaacctgagctctgtgctgaaggatgaggccgtgtgggagaagcccttccgcttccaccctgagcacttcctggatgcccagggccactttgtgaagccagaggccttcctgcccttctctgctggaagaagagcctgcctgggggagcccctggccaggatggagctgttcctgttcttcaccagcctgctgcagcacttctccttctctgtgcccaccggccagccccggcccagccaccacggcgtgtttgccttcctggtgacccccagcccctatgagctgtgtgctgtgcccaggtag

SEQ ID NO: 149066 - DNA, 1494 bp, Artificial Sequence
  Description of Artificial Sequence: Synthetic coding sequence
atgggcctggaggccctggtgcccctggccgtcatcgtggccatcttcctgctgctggtggacctgatgcaccggcggcagcgctgggccgcccgctacccacctggccccctgcccctgcccggcctgggcaacctgctgcacgtggacttccagaacaccccctactgctttgaccagctgcggaggagatttggagatgtgttcagcctgcagctggcctggacccctgtggtggtgctgaatggcctggccgctgtgcgggaggccctggtgacccacggggaggacacagctgaccggccccctgtgcccatcacccagatcctgggcttcggccccaggagccagggcgtcttcctggcccgctatggccctgcctggagggagcagaggcgcttctctgtgtccaccctgaggaacctgggcctgggcaagaagagcctggagcagtgggtgacagaggaggccgcctgcctgtgtgccgcctttgccaaccacagcggccggcccttccggcccaacggcctgctggacaaggctgtgtccaatgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccgagatggagaaggccaagggcaaccctgagagcagcttcaatgatgagaacctgtgcatcgtggtggccgacctcttctctgctggcatggtgaccaccagcaccaccctggcctggggcctgctgctgatgatcctgcacccagatgtgcagaggagagtgcagcaggagattgatgatgtgattggccaggtgagaagacctgagatgggagaccaggcccacatgccctacaccacagctgtgattcatgaggtgcagagatttggagacatcgtgcccctgggcgtgacccacatgaccagccgggacatcgaggtgcagggcttccgcatccccaagggcaccaccctcatcaccaacctgagctctgtgctgaaggatgaagctgtgtgggagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtgcccaccggccagccccggcccagccaccacggcgtgtttgccttcctggtgacccccagcccctatgagctgtgtgctgtgcccaggtag

SEQ ID NO: 149067 - DNA, 1494 bp, Artificial Sequence
  Description of Artificial Sequence: Synthetic coding sequence
atgggcctggaggccctggtgcccctggccgtcatcgtggccatcttcctgctgctggtggacctgatgcaccggcggcagcgctgggccgcccgctacccacctggccccctgcccctgcccggcctgggcaacctgctgcacgtggacttccagaacaccccctactgctttgaccagctgcggaggagatttggagatgtgttcagcctgcagctggcctggacccctgtggtggtgctgaatggcctggccgctgtgcgggaggccctggtgacccacggggaggacacagctgaccggccccctgtgcccatcacccagatcctgggcttcggcccccggggccagggcgtcttcctggcccgctatggccctgcctggagggagcagaggcgcttctctgtgtccaccctgaggaacctgggcctgggcaagaagagcctggagcagtgggtgacagaggaggccgcctgcctgtgtgccgcctttgccaaccacagcggccggcccttccggcccaacggcctgctggacaaggctgtgtccaatgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccgagatggagaaggccaagggcaaccctgagagcagcttcaatgatgagaacctgtgcatcgtggtggccgacctcttctctgctggcatggtgaccaccagcaccaccctggcctggggcctgctgctgatgatcctgcacccagatgtgcagaggagagtgcagcaggagattgatgatgtgattggccaggtgagaagacctgagatgggagaccaggcccacatgccctacaccacagctgtgattcatgaggtgcagagatttggagacatcgtgcccctgggcgtgacccacatgaccagccgggacatcgaggtgcagggcttccgcatccccaagggcaccaccctcatcaccaacctgagctctgtgctgaaggatgaagctgtgtgggagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtgcccaccggccagccccggcccagccaccacggcgtgtttgccttcctggtgacccccagcccctatgagctgtgtgctgtgcccaggtag

SEQ ID NO: 149068 - DNA, 1332 bp, Artificial Sequence
  Description of Artificial Sequence: Synthetic coding sequence
caggaggccctgaccctgcccctgcagctgcggaggagatttggagatgtgttcagcctgcagctggcctggacccctgtggtggtgctgaatggcctggccgctgtgcgggaggccctggtgacccatggagaggacacagctgacaggcctcctgtgcccatcacccagatcctgggcttcggcccccggggccagggcgtcttcctggcccgctatggccctgcctggagggagcagaggcgcttctctgtgtccaccctgaggaacctgggcctgggcaagaagagcctggagcagtgggtgacagaggaggccgcctgcctgtgtgccgcctttgccaaccatgatgccccctttgcccccaccgtgtcctggaccaagcccaacgtcatcgccagcctgacctgtggcagaagatttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccgagatggagaaggccaagggcaaccctgagagcagcttcaatgatgagaacctgtgcatcgtggtggccgacctcttctctgctggcatggtgaccaccagcaccaccctggcctggggcctgctgctgatgatcctgcacccagatgtgcagaggagagtgcagcaggagattgatgatgtgattggccaggtgagaagacctgagatgggagaccaggcccacatgccctacaccacagctgtgattcatgaggtgcagagatttggagacatcgtgcccctgggcgtgacccacatgaccagccgggacatcgaggtgcagggcttccgcatccccaagggcaccaccctcatcaccaacctgagctctgtgctgaaggatgaagctgtgtgggagaagcccttccgcttccaccctgagcacttcctggatgcccagggccactttgtgaagccagaggccttcctgcccttctctgctggccggcgggcctgcctgggggagcccctggccaggatggagctgttcctgttcttcaccagcctgctgcagcacttctccttctctgtgcccaccggccagccccggcccagccaccacggcgtgtttgccttcctggtgacccccagcccctatgagctgtgtgctgtgcccaggtag

SEQ ID NO: 149069 - DNA, 1341 bp, Artificial Sequence
  Description of Artificial Sequence: Synthetic coding sequence
atgggcctggaggccctggtgcccctggccatgattgtggccatcttcctgctgctggtggacctgatgcaccggcggcagcgctgggccgcccgctacccacctggccccctgcccctgcccggcctgggcaacctgctgcacgtggacttccagaacaccccctactgctttgaccagctgcggaggagatttggagatgtgttcagcctgcagctggcctggacccctgtggtggtgctgaatggcctggccgctgtgcgggaggccctggtgacccacggggaggacacagctgaccggccccctgtgcccatcacccagatcctgggcttcggccccaggagccagggccggcccttccggcccaacggcctgctggacaaggctgtgtccaatgtgattgccagcctgacctgtggccgccgctttgaatatgatgacccccgcttcctgcggctgctggacctggcccaggagggcctgaaggaggagagcggcttcctgcgggaggtgctgaatgctgtgcctgtgctgctgcacatcccagccctggccggcaaggtgctgcgcttccagaaggccttcctgacccagctggatgagctgctgacagagcacaggatgacctgggaccctgcccagcccccccgggacctgacagaggccttcctggccgagatggagaaggccaagggcaaccctgagagcagcttcaatgatgagaacctgtgcatcgtggtggccgacctcttctctgctggcatggtgaccaccagcaccaccctggcctggggcctgctgctgatgatcctgcacccagatgtgcagaggagagtgcagcaggagattgatgatgtgattggccaggtgcggcggcctgagatgggagaccaggcccacatgccctacaccacagctgtgatccacgaggtgcagagatttggagacatcgtgcccctgggcgtgacccacatgaccagccgggacatcgaggtgcagggcttccgcatccccaagggcaccaccctcatcaccaacctgagctctgtgctgaaggatgaggccgtgtgggagaagcccttccgcttccaccctgagcacttcctggatgcccagggccactttgtgaagccagaggccttcctgcccttctctgctggaagaagagcctgcctgggggagcccctggccaggatggagctgttcctgttcttcaccagcctgctgcagcacttctccttctctgtgcccaccggccagccccggcccagccaccacggcgtgtttgccttcctggtgacccccagcccctatgagctgtgtgctgtgcccaggtag

SEQ ID NO: 149070 - DNA, 1482 bp, Artificial Sequence
  Description of Artificial Sequence: Synthetic coding sequence
atgtctgccctgggcgtgacagtggccctgctggtgtgggccgccttcctgctgctggtgtccatgtggaggcaggtgcacagctcctggaacctgcccccaggccccttccccctgcccatcatcggcaacctcttccagctggagctgaagaacatccccaagagcttcacccggctggcccagcgcttcggccctgtgttcaccctgtatgtgggcagccagaggatggtggtgatgcacggctacaaggctgtgaaggaggccctgctggactacaaggatgagttcagcggccgcggggacctgcctgccttccacgcccaccgggaccggggcatcatcttcaacaacggccccacctggaaggacatccgccgcttcagcctgaccaccctgaggaactacggcatgggcaagcagggcaatgaaagccgcatccagcgggaggcccacttcctgctggaggccctgaggaagacccagggccagccctttgaccccaccttcctgattggctgtgccccctgcaatgtgattgctgacatcctcttcaggaagcactttgactacaatgatgagaagttcctgcggctgatgtacctgttcaatgaaaacttccacctgctgagcaccccctggctgcagctgtacaacaacttccccagcttcctgcactacctgcccggcagccacaggaaggtgatcaagaatgtggccgaggtgaaggagtatgtgtctgagcgggtgaaggagcaccaccagagcctggaccccaactgcccccgggacctgacagactgcctgctggtggagatggagaaggagaagcacagcgctgagcggctgtacaccatggatggcatcaccgtgacagtggccgacctcttctttgctggaacagagaccaccagcaccaccctgcgctatggcctgctgatcctgatgaagtacccagaaattgaggagaagctgcacgaggagattgacagagtgattggccccagccgcatcccagccatcaaggaccggcaggagatgccctacatggatgctgtggtgcatgagatccagcgcttcatcaccctggtgcccagcaacctgccccatgaggccacccgggacaccatcttccggggctacctgatccccaagggcaccgtggtggtgcccaccctggacagcgtgctgtatgacaaccaggagttcccagaccctgagaagttcaagccagagcacttcctgaatgaaaatggcaagttcaagtacagcgactacttcaagcccttcagcacaggcaagagggtgtgtgccggggagggcctggccaggatggagctgttcctgctgctgtgtgccatcctgcagcacttcaacctgaagcccctggtggaccccaaggacatcgacctgagccccatccacatcggcttcggctgcatccccccacgctacaagctgtgtgtgatccccaggagctag

SEQ ID NO: 149071 - DNA, 1482 bp, Artificial Sequence; identical to SEQ ID NO: 149070
  Description of Artificial Sequence: Synthetic coding sequence

SEQ ID NO: 149072 - DNA, 261 bp, Artificial Sequence
  Description of Artificial Sequence: Synthetic coding sequence
atgtctgccctgggcgtgacagtggccctgctggtgtgggccgccttcctgctgctggtgtccatgtggaggcaggtgcacagctcctggaacctgcccccaggccccttccccctgcccatcatcggcaacctcttccagctggagctgaagaacatccccaagagcttcacccggctggcccagcgcttcggccctgtgttcaccctgtatgtgggcagccagaggatggtggtgatgcacggctacaaggctgtgtag

SEQ ID NO: 149073 - DNA, 1476 bp, Artificial Sequence
  Description of Artificial Sequence: Synthetic coding sequence
atggacagcatcagcacagccatcctgctgctgctgctggccctggtgtgcctgctgctgaccctgagcagccgggacaagggcaagctgcccccaggcccccggcccctgagcatcctgggcaacctgctgctgctgtgcagccaggacatgctgaccagcctgaccaagctgagcaaggagtatggctccatgtacacagtgcacctgggccccaggagagtggtggtgctgagcggctaccaggccgtgaaggaggccctggtggaccagggcgaggagttcagcggccgcggggactacccagccttcttcaacttcaccaagggaaatggaattgccttcagcagcggggaccgctggaaggtgctgcggcagttcagcatccagatcctgaggaactttggcatgggcaagaggagcattgaggagcgcatcctggaggagggcagcttcctgctggccgagctgaggaagacagaaggagagccctttgaccccacctttgtgctgagccgctctgtgagcaacatcatctgcagcgtgctgtttggcagcagatttgattatgatgatgagcggctgctgaccatcatccgcctcatcaatgacaacttccagatcatgagcagcccctggggcgagctgtatgacatcttccccagcctgctggactgggtgcccggcccccaccagaggatcttccagaacttcaagtgcctgcgggacctgattgcccacagcgtgcatgaccaccaggccagcctggaccccaggagcccccgggacttcatccagtgcttcctgaccaagatggccgaggagaaggaggaccccctgagccacttccacatggacaccctgctgatgaccacccacaacctgctgtttggaggcaccaagacagtgtccaccaccctgcaccacgccttcctggccctgatgaagtaccccaaggtgcaggcccgggtgcaggaggagattgacctggtggtgggccgggcccggctgcctgccctgaaggaccgggccgccatgccctacacagatgctgtgatccacgaggtgcagagatttgctgacatcatccccatgaacctgccccaccgggtgacccgggacacagccttccggggcttcctgatccccaagggcacagatgtgatcaccctgctgaacacagtgcactatgaccccagccagttcctgaccccccaggagttcaaccctgagcacttcctggatgccaaccagagcttcaagaagagccctgccttcatgcccttctctgctggaagaaggctgtgcctgggggagagcctggccaggatggagctgttcctgtacctgacagccatcctgcagagcttcagcctgcagcccctgggcgcccctgaggacatcgacctgacccccctgagcagcggcctgggcaacctgccccggcccttccagctgtgcctgcggcccaggtag

SEQ ID NO: 149074 - DNA, 1509 bp, Artificial Sequence
  Description of Artificial Sequence: Synthetic coding sequence
atgctggccgccatgggcagcctggccgccgccctgtgggccgtggtgcaccccaggaccctgctgctgggcaccgtggccttcctgctggccgctgacttcctgaagagaagaagacccaagaactacccacctggcccctggaggctgcccttcctgggcaacttcttcctggtggactttgagcagagccacctggaggtgcagctgtttgtgaagaagtatggcaacctcttcagcctggagctgggggacatctctgctgtgctgatcaccggcctgcccctcatcaaggaggccctgatccacatggaccagaactttggaaacagacctgtgacccccatgagggagcacatcttcaagaagaatggcctcatcatgagcagcggccaggcctggaaggagcagaggcgcttcaccctgacagccctgaggaactttggcctgggcaagaagagcctggaggagcgcatccaggaggaggcccagcacctgacagaggccatcaaggaggagaatggccagccctttgacccccacttcaagatcaacaatgctgtgagcaacatcatctgcagcatcacctttggagagagatttgagtaccaggacagctggttccagcagctgctgaagctgctggatgaggtgacctacctggaggccagcaagacctgccagctgtacaacgtgttcccctggatcatgaagttcctgcccggcccccaccagaccctcttcagcaactggaagaagctgaagctgtttgtgagccacatgattgacaagcacaggaaggactggaacccagctgagacccgggacttcattgatgcctacctgaaggagatgagcaagcacactggaaaccccaccagcagcttccatgaagaaaatctcatctgcagcaccctggacctcttctttgctggaacagagaccaccagcaccaccctgcgctgggccctgctgtacatggccctgtacccagagatccaggagaaggtgcaggccgagattgacagagtgattggccagggccagcagcccagcacagctgcccgggagagcatgccctacaccaatgctgtgattcatgaggtgcagaggatgggcaacatcatccccctgaatgtgccccgggaggtgacagtggacaccaccctggccggctaccacctgcccaagggcaccatgatcctgaccaacctgacagccctgcaccgggaccccacagagtgggccaccccagacaccttcaacccagaccacttcctggagaatggccagttcaagaagcgggaggccttcatgcccttcagcatcggcaagagggcctgcctgggggagcagctggccaggacagagctgttcatcttcttcaccagcctgatgcagaagttcaccttccggccccccaacaatgagaagctgagcctgaagttcaggatgggcatcaccatcagccctgtgagccaccggctgtgtgctgtgccccaggtgtag

SEQ ID NO: 149075 - DNA, 1506 bp, Artificial Sequence
  Description of Artificial Sequence: Synthetic coding sequence
atgtggaagctgtggagggctgaggagggcgccgccgccctgggcggggccctcttcctgctgctgtttgccctgggcgtgcggcagctgctgaagcagaggcggcccatgggcttccccccaggccccccaggcctgcccttcatcggcaacatctacagcctggccgccagcagcgagctgccccacgtgtacatgaggaagcagagccaggtgtatggagagatcttcagcctggacctgggcggcatcagcacagtggtgctgaatggctatgatgtggtgaaggaatgtctggtgcaccagagcgagatctttgctgaccggccctgcctgcccctcttcatgaagatgaccaagatgggcggcctgctgaacagccgctatggccggggctgggtggaccaccggcggctggccgtgaacagcttccgctacttcggctacggccagaagagctttgagagcaagatcctggaggagaccaagttcttcaatgatgccatcgagacctacaagggccggccctttgacttcaagcagctgatcaccaatgctgtgagcaacatcaccaacctgatcatctttggagagcgcttcacctatgaggacacagacttccagcacatgattgagctgttctctgaaaatgtggagctggccgccagcgcctctgtgttcctgtacaatgccttcccctggattggcatcctgccctttgggaagcaccagcagctgttcagaaatgctgctgtggtgtatgacttcctgagccggctgattgagaaggcctctgtgaacaggaagccccagctgccccagcactttgtggatgcctacctggatgagatggaccagggcaagaatgaccccagcagcaccttcagcaaggagaacctgatcttctctgtgggggagctgatcatcgccggcacagagaccaccaccaacgtgctgcgctgggccatcctcttcatggccctgtaccccaacatccagggccaggtgcagaaggagattgacctgatcatgggccccaacgggaagcccagctgggatgacaagtgcaagatgccctacacagaagctgtgctgcacgaggtgctgcgcttctgcaacatcgtgcccctgggcatcttccacgccaccagtgaagatgctgtggtgcggggctacagcatccccaagggcaccaccgtcatcaccaacctgtacagcgtgcactttgatgagaagtactggagggaccctgaggtgttccaccctgagcgcttcctggacagcagcggctactttgccaagaaggaggccctggtgcccttcagcctgggcagaagacactgcctgggggagcacctggccaggatggagatgttcctgttcttcaccgccctgctgcagcgcttccacctgcacttcccccatgagctggtgcctgacctgaagccccggctgggcatgaccctgcagccccagccctacctgatctgtgccgagaggaggtag

SEQ ID NO: 149076 - DNA, 1695 bp, Artificial Sequence
  Description of Artificial Sequence: Synthetic coding sequence
atggaggccaccggcacctgggccctgctgctggccctggccctgctgctgctgctgaccctggccctgagcggcacccgggcccggggccacctgcccccaggccccacccccctgcccctgctgggcaacctgctgcagctgcggcctggggccctgtacagcggcctgatgaggctgagcaagaagtatggccctgtgttcaccatctacctgggcccctggaggcctgtggtggtgctggtgggccaggaggccgtgcgggaggccctgggcggccaggccgaggagttcagcggccggggcaccgtggccatgctggagggcacctttgatggccacggcgtcttcttcagcaatggagagcgctggaggcagctgaggaagttcaccatgctggccctgcgggacctgggcatgggcaagcgggagggggaggagctgatccaggccgaggcccgctgcctggtggagaccttccagggcacagagggccggccctttgaccccagcctgctgctggcccaggccaccagcaatgtggtgtgcagcctgctgtttggcctgcgcttctcctatgaggacaaggagttccaggccgtggtgcgggctgctgggggcaccctgctgggcgtgagcagccagggcggccagacctatgagatgttctcctggttcctgcggcccctgcccggcccccacaagcagctgctgcaccacgtgtccaccctggccgccttcaccgtgcggcaggtgcagcagcaccagggcaacctggatgccagcggccctgcccgggacctggtggatgccttcctgctgaagatggcccaggaggagcagaaccctggaacagagttcaccaacaagaacatgctgatgaccgtcatctacctgctgtttgctggcaccatgacagtgtccaccaccgtgggctacaccctgctgctgctgatgaagtacccccacgtgcagaagtgggtgcgggaggagctgaaccgggagctgggcgccggccaggcccccagcctgggggacaggacccggctgccctacacagatgctgtgctgcacgaggcccagaggctgctggccctggtgcccatgggcatccccaggaccctgatgaggaccacccgcttccggggctacaccctgccccagggcacagaggtgttccccctgctgggcagcatcctgcatgaccccaacatcttcaagcaccctgaggagttcaacccagaccgcttcctggatgctgatggccgcttcaggaagcatgaggccttcctgcccttcagcctgggcaagagggtgtgcctgggggagggcctggccaaggccgagctgttcctgttcttcaccaccatcctgcaggccttcagcctggagagcccctgccccccagacaccctgagcctgaagcccaccgtgtctggcctcttcaacatccccccagccagcacagtgggcatggacagagtgaatgtgtcccgggtgtacacagctggcagccacatctacaccccagctgtggtgttccgcagcctgagccacggcccccacgcccacctgacccacgccgccaagatgcacaacagaacacccatccacaactacaagggccacaaggccacagctggcctggccttccaccgccacaagtacagccccagcgccatcaccagcacctag

SEQ ID NO: 149077 - DNA, 1515 bp, Artificial Sequence
  Description of Artificial Sequence: Synthetic coding sequence
atggaggccaccggcacctgggccctgctgctggccctggccctgctgctgctgctgaccctggccctgagcggcacccgggcccggggccacctgcccccaggccccacccccctgcccctgctgggcaacctgctgcagctgcggcctggggccctgtacagcggcctgatgaggctgagcaagaagtatggccctgtgttcaccatctacctgggcccctggaggcctgtggtggtgctggtgggccaggaggccgtgcgggaggccctgggcggccaggccgaggagttcagcggccggggcaccgtggccatgctggagggcacctttgatggccacggcgtcttcttcagcaatggagagcgctggaggcagctgaggaagttcaccatgctggccctgcgggacctgggcatgggcaagcgggagggggaggagctgatccaggccgaggcccgctgcctggtggagaccttccagggcacagagggccggccctttgaccccagcctgctgctggcccaggccaccagcaatgtggtgtgcagcctgctgtttggcctgcgcttctcctatgaggacaaggagttccaggccgtggtgcgggctgctgggggcaccctgctgggcgtgagcagccagggcggccagacctatgagatgttctcctggttcctgcggcccctgcccggcccccacaagcagctgctgcaccacgtgtccaccctggccgccttcaccgtgcggcaggtgcagcagcaccagggcaacctggatgccagcggccctgcccgggacctggtggatgccttcctgctgaagatggcccaggaggagcagaaccctggaacagagttcaccaacaagaacatgctgatgaccgtcatctacctgctgtttgctggcaccatgacagtgtccaccaccgtgggctacaccctgctgctgctgatgaagtacccccacgtgcagaagtgggtgcgggaggagctgaaccgggagctgggcgccggccaggcccccagcctgggggacaggacccggctgccctacacagatgctgtgctgcacgaggcccagaggctgctggccctggtgcccatgggcatccccaggaccctgatgaggaccacccgcttccggggctacaccctgccccagggcacagaggtgttccccctgctgggcagcatcctgcatgaccccaacatcttcaagcaccctgaggagttcaacccagaccgcttcctggatgctgatggccgcttcaggaagcatgaggccttcctgcccttcagcctgggcaagagggtgtgcctgggggagggcctggccaaggccgagctgttcctgttcttcaccaccatcctgcaggccttcagcctggagagcccctgccccccagacaccctgagcctgaagcccaccgtgtctggcctcttcaacatccccccagccttccagctgcaggtgcggcccacagacctgcacagcaccacccagaccaggtag

SEQ ID NO: 149078 - DNA, 690 bp, Artificial Sequence
  Description of Artificial Sequence: Synthetic coding sequence
atggccatggaggagcagaaccctggaacagagttcaccaacaagaacatgctgatgaccgtcatctacctgctgtttgctggcaccatgacagtgtccaccaccgtgggctacaccctgctgctgctgatgaagtacccccacgtgcagaagtgggtgcgggaggagctgaaccgggagctgggcgccggccaggcccccagcctgggggacaggacccggctgccctacacagatgctgtgctgcacgaggcccagaggctgctggccctggtgcccatgggcatccccaggaccctgatgaggaccacccgcttccggggctacaccctgccccagggcacagaggtgttccccctgctgggcagcatcctgcatgaccccaacatcttcaagcaccctgaggagttcaacccagaccgcttcctggatgctgatggccgcttcaggaagcatgaggccttcctgcccttcagcctgggcaagagggtgtgcctgggggagggcctggccaaggccgagctgttcctgttcttcaccaccatcctgcaggccttcagcctggagagcccctgccccccagacaccctgagcctgaagcccaccgtgtctggcctcttcaacatccccccagccttccagctgcaggtgcggcccacagacctgcacagcaccacccagaccaggtag

SEQ ID NO: 149079 - DNA, 1635 bp, Artificial Sequence
  Description of Artificial Sequence: Synthetic coding sequence
atgagcagccctggccccagccagcccccagctgaggaccccccctggccagcccggctgctgcgggcccccctgggcctgctgcggctggaccccagcggcggggccctgctgctgtgtggcctggtggccctgctgggctggagctggctgcggcggcggcgggcccggggcatccccccaggccccaccccctggcccctggtgggcaactttggccacgtgctgctgccccccttcctgcggcggcgctcctggctgagcagcaggaccagggctgctggcatcgaccccagcgtgattggcccccaggtgctgctggcccacctggcccgggtgtatggcagcatcttctccttcttcatcggccactacctggtggtggtgctgagtgacttccacagcgtgcgggaggccctggtgcagcaggccgaggtgttcagtgaccggccccgggtgcccctcatcagcatcgtgaccaaggagaagggcgtggtgtttgcccactacggccctgtgtggaggcagcagaggaagttcagccacagcaccctgcggcacttcggcctgggcaagctgagcctggagcccaagatcatcgaggagttcaagtatgtgaaggccgagatgcagaagcatggagaggaccccttctgccccttcagcatcatcagcaatgctgtgagcaacatcatctgcagcctgtgcttcggccagagatttgactacaccaacagcgagttcaagaagatgctgggcttcatgagccggggcctggagatctgcctgaacagccaggtgctgctggtgaacatctgcccctggctgtactacctgcccttcggccccttcaaggagctgcggcagatcgagaaggacatcaccagcttcctgaagaagatcatcaaggaccaccaggagagcctggaccgggagaacccccaggacttcatcgacatgtacctgctgcacatggaggaggagaggaagaacaacagcaacagcagctttgatgaggagtacctgttctacatcatcggggacctcttcatcgccggcacagacaccaccaccaacagcctgctgtggtgcctgctgtacatgagcctgaacccagatgtgcaggagaaggtgcatgaggagattgaaagagtcatcggggccaacagagcccccagcctgacagacaaggcccagatgccctacacagaggccaccatcatggaggtgcagaggctgactgtggtggtgcccctggccatcccccacatgaccagtgaaaatacagtgctgcagggctacaccatccccaagggcaccctcatcctgcccaacctgtggagcgtgcaccgggaccctgccatctgggagaagccagaggacttctaccccaaccgcttcctggatgaccagggccagctgatcaagaaggagaccttcatcccctttggaattggcaagagggtgtgcatgggagagcagctggccaagatggagctgttcctgatgtttgtgtccctgatgcagagctttgcctttgccctgcctgaggacagcaagaagcccctgctgaccggccgcttcggcctgaccctggccccccaccccttcaacatcaccatcagcagaagatag

SEQ ID NO: 149080 - DNA, 1506 bp, Artificial Sequence
  Description of Artificial Sequence: Synthetic coding sequence
atgagcagccctggccccagccagcccccagctgaggaccccccctggccagcccggctgctgcgggcccccctggtgggcaactttggacatgtgctgctgccccccttcctgcggcggcgctcctggctgagcagcaggaccagggctgctggcatcgaccccagcgtcatcggcccccaggtgctgctggcccacctggcccgggtgtatggcagcatcttctccttcttcatcggccactacctggtggtggtgctgagtgacttccacagcgtgcgggaggccctggtgcagcaggccgaggtgttcagtgaccggccccgggtgcccctcatcagcatcgtgaccaaggagaagggcgtggtgtttgcccactacggccctgtgtggaggcagcagaggaagttcagccacagcaccctgcggcacttcggcctgggcaagctgagcctggagcccaagatcatcgaggagttcaagtatgtgaaggccgagatgcagaagcacggggaggaccccttctgccccttcagcatcatcagcaatgctgtgagcaacatcatctgcagcctgtgcttcggccagagatttgactacaccaacagcgagttcaagaagatgctgggcttcatgagccggggcctggagatctgcctgaacagccaggtgctgctggtgaacatctgcccctggctgtactacctgcccttcggccccttcaaggagctgcggcagatcgagaaggacatcaccagcttcctgaagaagatcatcaaggaccaccaggagagcctggaccgggagaacccccaggacttcatcgacatgtacctgctgcacatggaggaggagaggaagaacaacagcaacagcagctttgatgaggagtacctgttctacatcattggagacctcttcatcgccggcacagacaccaccaccaacagcctgctgtggtgcctgctgtacatgagcctgaacccagatgtgcaggagaaggtgcatgaggagattgagcgggtgattggagccaacagagcccccagcctgacagacaaggcccagatgccctacacagaggccaccatcatggaggtgcagaggctgactgtggtggtgcccctggccatcccccacatgaccagcgagaacacagtgctgcagggctacaccatccccaagggcaccctcatcctgcccaacctgtggagcgtgcaccgggaccctgccatctgggagaagccagaggacttctaccccaaccgcttcctggatgaccagggccagctgatcaagaaggagaccttcatccccttcggcatcggcaagagggtgtgcatgggagagcagctggccaagatggagctgttcctgatgtttgtgtccctgatgcagagctttgcctttgccctgcctgaggacagcaagaagcccctgctgaccggccgcttcggcctgaccctggccccccaccccttcaacatcaccatcagcagaagatag

SEQ ID NO: 149081 - DNA, 1398 bp, Artificial Sequence
  Description of Artificial Sequence: Synthetic coding sequence
atgctgctgctgggcctgctgctgctgctgcccctgctggccggggcccggctgctgtggaactggtggaagctgcggagcctgcacctgccccccctggcccctggcttcctgcacctgctgcagcctgacctgcccatctacctgctgggcctgacccagaagtttggccccatctaccgcctgcacctgggcctgcaggacaagctggtgtccaggaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgaccttcggggacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgaaacagtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagagccagtag

SEQ ID NO: 149082 - DNA, 1488 bp, Artificial Sequence
  Description of Artificial Sequence: Synthetic coding sequence
atgctgctgctgggcctgctgctgctgctgcccctgctggccggggcccggctgctgtggaactggtggaagctgcggagcctgcacctgccccccctggcccctggcttcctgcacctgctgcagcctgacctgcccatctacctgctgggcctgacccagaagtttggccccatctaccgcctgcacctgggcctgcaggatgtggtggtgctgaacagcaagaggaccatcgaggaggccatggtgaagaagtgggccgactttgctggccggcctgagcccctgacctacaagctggtgtccaggaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgaccttcggggacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgaaacagtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagagccagtag

SEQ ID NO: 149083 - DNA, 1488 bp, Artificial Sequence; identical to SEQ ID NO: 149082
  Description of Artificial Sequence: Synthetic coding sequence

SEQ ID NO: 149084 - DNA, 1398 bp, Artificial Sequence; identical to SEQ ID NO: 149081
  Description of Artificial Sequence: Synthetic coding sequence

SEQ ID NO: 149085 - DNA, 1398 bp, Artificial Sequence; identical to SEQ ID NO: 149081
  Description of Artificial Sequence: Synthetic coding sequence

SEQ ID NO: 149086 - DNA, 1485 bp, Artificial Sequence
  Description of Artificial Sequence: Synthetic coding sequence
atgctgctgctgggcctgctgctgctgcccctgctggccggggcccggctgctgtggaactggtggaagctgcggagcctgcacctgccccccctggcccctggcttcctgcacctgctgcagcctgacctgcccatctacctgctgggcctgacccagaagtttggccccatctaccgcctgcacctgggcctgcaggatgtggtggtgctgaacagcaagaggaccatcgaggaggccatggtgaagaagtgggccgactttgctggccggcctgagcccctgacctacaagctggtgtccaagaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgacctttggagacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgagaccgtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagaaccagtag

SEQ ID NO: 149087 - DNA, 1485 bp, Artificial Sequence; identical to SEQ ID NO: 149086
  Description of Artificial Sequence: Synthetic coding sequence

SEQ ID NO: 149088 - DNA, 1488 bp, Artificial Sequence; identical to SEQ ID NO: 149082
  Description of Artificial Sequence: Synthetic coding sequence

SEQ ID NO: 149089 - DNA, 1395 bp, Artificial Sequence
  Description of Artificial Sequence: Synthetic coding sequence
atgctgctgctgggcctgctgctgctgcccctgctggccggggcccggctgctgtggaactggtggaagctgcggagcctgcacctgccccccctggcccctggcttcctgcacctgctgcagcctgacctgcccatctacctgctgggcctgacccagaagtttggccccatctaccgcctgcacctgggcctgcaggacaagctggtgtccaagaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgacctttggagacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgagaccgtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagaaccagtag

SEQ ID NO: 149090 - DNA, 1398 bp, Artificial Sequence; identical to SEQ ID NO: 149081
  Description of Artificial Sequence: Synthetic coding sequence

SEQ ID NO: 149091 - DNA, 1395 bp, Artificial Sequence; identical to SEQ ID NO: 149089
  Description of Artificial Sequence: Synthetic coding sequence

SEQ ID NO: 149092 - DNA, 1488 bp, Artificial Sequence
  Description of Artificial Sequence: Synthetic coding sequence
atgctgctgctgggcctgctgctgctgctgcccctgctggccggggcccggctgctgtggaactggtggaagctgcggagcctgcacctgctgcccctggcccctggcttcctgcacctgctgcagcctgacctgcccatctacctgctgggcctgacccagaagtttggccccatctaccgcctgcacctgggcctgcaggatgtggtggtgctgaacagcaagaggaccatcgaggaggccatggtgaagaagtgggccgactttgctggccggcctgagcccctgacctacaagctggtgtccaagaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgaccttcggggacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgaaacagtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagaaccagtag

SEQ ID NO: 149093 - DNA, 1488 bp, Artificial Sequence
  Description of Artificial Sequence: Synthetic coding sequence
atgctgctgctgggcctgctgctgctgctgcccctgctggccggggcccggctgctgtggaactggtggaagctgcggagcctgcacctgccccccctggcccctggcttcctgcacctgctgcagcctgacctgcccatctacctgctgggcctgacccagaagtttggccccatctaccgcctgcacctgggcctgcaggatgtggtggtgctgaacagcaagaggaccatcgaggaggccatggtgaagaagtgggccgactttgctggccggcctgagcccctgacctacaagctggtgtccaagaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgaccttcggggacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgaaacagtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagaaccagtag

SEQ ID NO: 149094 - DNA, 1398 bp, Artificial Sequence
  Description of Artificial Sequence: Synthetic coding sequence
atgctgctgctgggcctgctgctgctgctgcccctgctggccggggcccggctgctgtggaactggtggaagctgcggagcctgcacctgctgcccctggcccctggcttcctgcacctgctgcagcctgacctgcccatctacctgctgggcctgacccagaagtttggccccatctaccgcctgcacctgggcctgcaggacaagctggtgtccaagaactacccagacctgagcctgggggactacagcctgctgtggaaggcccacaagaagctgaccaggtctgccctgctgctgggcatccgggacagcatggagcctgtggtggagcagctgacccaggagttctgtgagaggatgagggcccagcccggcacccctgtggccatcgaggaggagttcagcctgctgacctgcagcatcatctgctacctgaccttcggggacaagatcaaggatgacaacctgatgcctgcctactacaagtgcatccaggaggtgctgaagacctggagccactggagcatccagatcgtggatgtgatccccttcctgcgcttcttccccaaccctggcctgcggcggctgaagcaggccatcgagaagagggaccacatcgtggagatgcagctgcggcagcacaaggagagcctggtggccggccagtggagggacatgatggactacatgctgcagggcgtggcccagcccagcatggaggagggcagcggccagctgctggagggccacgtgcacatggctgctgtggacctgctgattggaggaacagagaccacagccaacaccctgtcctgggccgtggtgttcctgctgcaccaccctgagatccagcagaggctgcaggaggagctggaccacgagctgggccctggggccagcagcagccgggtgccctacaaggaccgggcccggctgcccctgctgaatgccaccatcgccgaggtgctgcggctgcggcctgtggtgcccctggccctgccccacaggaccacccggcccagcagcatcagcggctatgacatccctgagggcaccgtcatcatccccaacctgcagggcgcccacctggatgaaacagtgtgggagcggccccatgagttctggccagaccgcttcctggagcccgggaagaacagccgggccctggccttcggctgtggggcccgggtgtgcctgggggagcccctggcccggctggagctgtttgtggtgctgacccggctgctgcaggccttcaccctgctgcccagcggagatgccctgcccagcctgcagcccctgccccactgcagcgtcatcctgaagatgcagcccttccaggtgcggctgcagccccggggcatgggcgcccacagccctggccagaaccagtag

SEQ ID NO: 149095 - DNA, 1704 bp, Artificial Sequence
  Description of Artificial Sequence: Synthetic coding sequence
atgcacggccgcctgaaggtgaagaccagcgaggagcaggccgaggccaagaggctggagcgggagcagaagctgaagctgtaccagagcgccacccaggccgtgttccagaagaggcaggccggggagctggatgaatctgtgctggagctgaccagccagatcctgggcgccaacccagactttgccaccctgtggaactgcagaagagaggtgctgcagcagctggagacccagaagagccctgaggagctggccgccctggtgaaggccgagctgggcttcctggagagctgcctgcgggtgaaccccaagagctatggcacctggcaccaccgctgctggctgctgggccgcctgcctgagcccaactggacccgggagctggagctgtgtgcccgcttcctggaggtggatgaaagaaacttccactgctgggactacagaagatttgtggccacccaggccgctgtgcccccagctgaggagctggccttcacagacagcctcatcaccaggaacttcagcaactacagctcctggcactaccgcagctgcctgctgccccagctgcacccccagccagattctggcccccagggccgcctgcctgaagatgtgctgctgaaggagctggagctggtgcagaatgccttcttcacagaccccaatgaccagagcgcctggttctaccaccgctggctgctgggccgggctgacccccaggatgccctgcgctgcctgcacgtgtccagagatgaggcctgcctgactgtgtccttcagccggcccctgctggtgggcagcaggatggagatcctgctgctgatggtggatgacagccccctcatcgtggagtggaggaccccagatggaagaaaccggcccagccacgtgtggctgtgtgacctgcctgctgccagcctgaatgaccagctgccccagcacaccttccgggtcatctggacagctggagatgtgcagaaggaatgtgtgctgctgaagggccggcaggagggctggtgccgggacagcaccacagatgagcagctgttccgctgtgagctgtctgtggagaagagcacagtgctgcagagcgagctggagagctgcaaggagctgcaggagctggagcctgagaacaagtggtgcctgctgaccatcatcctgctgatgagggccctggaccccctgctgtatgagaaggagaccctgcagtacttccagaccctgaaggctgtggaccccatgagggccacctacctggatgacctgcggagcaagttcctgctggagaacagcgtgctgaagatggagtatgcagaggtgcgggtgctgcacctggcccacaaggacctgactgtgctgtgccacctggagcagctgctgctggtgacccacctggacctgagccacaaccggctgcggaccctgcccccagccctggccgccctgcgctgcctggaggtgctgcaggccagtgacaatgccatcgagagcctggatggagtgaccaacctgccccggctgcaggagctgctgctgtgcaacaaccggctgcagcagcctgctgtgctgcagcccctggccagctgcccccggctggtgctgctgaacctgcagggcaaccccctgtgccaggccgtgggcatcctggagcagctggccgagctgctgcccagcgtgtcctctgtgctgacctag

SEQ ID NO: 149096 - DNA, 1347 bp, Artificial Sequence
  Description of Artificial Sequence: Synthetic coding sequence
atgagcagccccatcagcaagagccgcagcctggccgccttcctgcagcagctgcggagcccccggcagcccccccggctggtgaccagcacagcctacaccagcccccagccccgggaggtgcctgtgtgccccctgacagctggaggagagacccagaatgctgctgccctgcccggccccacctcctggcccctgctgggcagcctgctgcagatcctgtggaagggcggcctgaagaagcagcacgacaccctggtggagtaccacaagaagtatggcaagatcttcaggatgaagctgggcagctttgagagcgtgcacctgggcagcccctgcctgctggaggccctgtacagaacagaaagtgcctacccccagaggctggagatcaagccctggaaggcctacagagactacaggaaggagggctacggcctgctgatcctggagggggaggactggcagagggtgcgcagcgccttccagaagaagctgatgaagccaggagaggtgatgaagctggacaacaagatcaatgaggtgctggccgacttcatgggcagaattgatgagctgtgtgatgagcggggccacgtggaggacctgtacagcgagctgaacaagtggagctttgagagcatctgcctggtgctgtatgagaagcgcttcggcctgctgcagaagaatgctggagatgaagctgtgaacttcatcatggccatcaagaccatgatgagcacctttggaaggatgatggtgacccctgtggagctgcacaagagcctgaacaccaaggtgtggcaggaccacaccctggcctgggacaccatcttcaagtctgtgaaggcctgcatcgacaaccggctggagaagtacagccagcagcccagcgctgacttcctgtgtgacatctaccaccagaaccggctgagcaagaaggagctgtatgctgctgtgacagagctgcagctggccgctgtggagaccacagccaacagcctgatgtggatcctgtacaacctgagcaggaacccccaggtgcagcagaagctgctgaaggagatccagagcgtgctgcctgagaaccaggtgcccagggctgaggacctgaggaacatgccctacctgaaggcctgcctgaaggagagcatgaggctgacccccagcgtgcccttcaccaccaggaccctggacaaggccaccgtgctgggggagtatgccctgcccaagggcatcgtgaggaaatatgacatccaggccacagacaatgaacctgtggagatgctgcacagcggcaccctggtgcccagccgggagctgcccatcgccttctgccagaggtag

SEQ ID NO: 149097 - DNA, 1371 bp, Artificial Sequence
  Description of Artificial Sequence: Synthetic coding sequence
atggacaagctgaacaagatcaccgtgcctgccagccagaagctgcggcagctgcagaagatggtgcatgacatcaagaacaatgaaggaggcatcatgaacaagatcaagaagctgaaggtgaaggccccacccagcgtgccccggcgggactatgccagcgagagccctgcagatgaggaggagcagtggagcgatgactttgacagcgactatgaaaatccagatgagcacagcgacagcgagatgtatgtgatgcctgctgaggagaatgctgatgacagctatgagcccccacctgtggagcaggagaccaggcctgtgcacccagccctgccctttgcccggggggagtacatcgacaacagaagcagccagaggcacagcccccccttcagcaagaccctgcccagcaagcccagctggcccagcgagaaggcccggctgaccagcaccctgcctgccctgacagccctgcagaagccccaggtgccccccaagcccaagggcctgctggaggatgaggccgactatgtggtgcctgtggaggacaatgatgagaactacatccaccccacagagagcagcagccccccacctgagaaggcccccatggtgaacagaagcaccaagcccaacagcagcaccccagccagccccccaggcacagccagcggcagaaattctggggcctgggagaccaagagccccccacctgctgcccccagccccctgccccgggccggcaagaagcccaccacccccctgaagaccacccctgtggccagccagcagaatgccagctctgtgtgtgaggagaagcccatcccagctgagcggcaccggggcagcagccaccggcaggaggccgtgcagagccctgtgtttcctccagcccagaagcagatccaccagaagcccatccccctgccccgcttcacagagggcggcaaccccaccgtggatggccccctgcccagcttcagcagcaacagcaccatcagcgagcaggaggccggcgtgctgtgcaagccctggtacgccggggcctgtgacaggaagtctgctgaggaggccctgcacaggagcaacaaggatggcagcttcctgatcaggaagagcagcggccatgacagcaagcagccctacaccctggtggtgttcttcaacaagagggtgtacaacatccctgtgcgcttcatcgaggccaccaagcagtatgccctgggcaggaagaagaatggagaggagtactttggatctgtggccgagatcatccggaaccaccagcacagccccctggtgctgattgacagccagaacaacaccaaggacagcacccggctgaagtatgctgtgaaggtgtcctag

SEQ ID NO: 149098 - DNA, 1287 bp, Artificial Sequence
  Description of Artificial Sequence: Synthetic coding sequence
atgaagaggaggaaatatggcttcatctacaagacccacctgtttggccggcccaccgtgcgggtgatgggcgctgacaacgtgcggcgcatcctgctgggggagcaccggctggtgtctgtgcactggccagcctctgtgaggaccatcctgggcagcggctgcctgagcaacctgcatgacagcagccacaagcagaggaagaaggtgatcatgagggccttcagccgggaggccctggagtgctacgtgcctgtgatcacagaggaggtgggcagcagcctggagcagtggctgagctgtggggagcggggcctgctggtgtacccagaggtgaagaggctgatgttcagaattgccatgaggatcctgctgggctgtgagccccagctggccggagatggagacagcgagcagcagctggtggaggcctttgaggagatgaccaggaacctcttcagcctgcccattgatgtgcccttcagcggcctgtaccggggcatgaaggccaggaacctgattcatgcccgcatcgagcagaacatccgggccaagatctgtggcctgcgggccagcgaggccggccagggctgcaaggatgccctgcagctgctgattgagcacagctgggagcggggggagcggctggacatgcaggccctgaagcagagcagcacagagctgctgtttggaggccacgagaccacagccagcgctgccaccagcctcatcacctacctgggcctgtacccccacgtgctgcagaaggtgcgggaggagctgaagagcaagggcctgctgtgcaagagcaaccaggacaacaagctggacatggagatcctggagcagctgaagtacatcggctgtgtgatcaaggagaccctgcggctgaacccccctgtgcctgggggcttccgggtggccctgaagacctttgagctgaatggctaccagatccccaagggctggaatgtcatctacagcatctgtgacacccatgatgtggccgagatcttcaccaacaaggaggagttcaacccagaccgcttcatgctgccccacccagaagatgccagccgcttctccttcatcccctttggaggcggcctgcggagctgtgtgggcaaggagtttgccaagatcctgctgaagatcttcaccgtggagctggcccggcactgtgactggcagctgctgaatggcccccccaccatgaagaccagccccaccgtgtaccctgtggacaacctgcctgcccgcttcacccacttccatggagagatctag

SEQ ID NO: 149099 - DNA, 1287 bp, Artificial Sequence; identical to SEQ ID NO: 149098
  Description of Artificial Sequence: Synthetic coding sequence

SEQ ID NO: 149100 - DNA, 1569 bp, Artificial Sequence
  Description of Artificial Sequence: Synthetic coding sequence
atgttcccctggggcctgagctgcctgtctgtgctgggcgctgctggaacagccctgctgtgtgccggcctgctgctgagcctggcccagcacctgtggaccctgcgctggatgctgagccgggaccgggccagcaccctgcccctgcccaagggctccatgggctggcccttctttggagagaccctgcactggctggtgcagggcagccgcttccacagcagccggcgggagagatatggcaccgtcttcaagacccacctgctgggccggcctgtgatccgggtgtctggagcagaaaatgtgaggaccatcctgctgggggagcaccggctggtgcgcagccagtggccccagagcgcccacatcctgctgggcagccacaccctgctgggcgctgtgggggagccccacagaagaagaaggaaggtgctggcccgggtcttcagccgggccgccctggagagatatgtgccccggctgcagggcgccctgcggcatgaggtgcgctcctggtgtgccgccggcggccctgtgtctgtgtatgatgccagcaaggccctgaccttcaggatggccgcccgcatcctgctgggcctgcggctggatgaggcccagtgtgccaccctggcccggacctttgagcagctggtggagaacctcttcagcctgcccctggatgtgcccttcagcggcctgaggaagggcatccgggcccgggaccagctgcaccgccacctggagggcgccatcagcgagaagctgcacgaggacaaggctgctgagcctggagatgccctggacctgatcatccacagcgcccgggagctgggccacgagcccagcatgcaggagctgaaggagagcgctgtggagctgctgtttgctgccttcttcaccacagccagcgccagcaccagcctggtgctgctgctgctgcagcaccctgctgccatcgccaagatccgggaggagctggtggcccagggcctgggccgggcctgtggctgtgcccctggagctgctgggggcagcgagggccccccaccagactgtggctgtgagccagacctgagcctggccgccctgggccgcctgcgctacgtggactgtgtggtgaaggaggtgctgcggctgctgccccctgtgtctgggggctacagaacagccctgcggacctttgagctggatggctaccagatccccaagggctggagcgtgatgtacagcatccgggacacccatgaaacagctgctgtgtaccgcagccccccagagggctttgatcctgagagatttggagctgcccgggaggacagcagaggagccagcagccgcttccactacatcccctttggaggaggagcccggagctgcctgggccaggagctggcccaggccgtgctgcagctgctggccgtggagctggtgaggacagcccgctgggagctggccaccccagccttccctgccatgcagacagtgcccatcgtgcaccctgtggatggcctgcggctcttcttccaccccctgacccccagcgtggccggaaatggcctgtgcctgtag

SEQ ID NO: 149101 - DNA, 1596 bp, Artificial Sequence
  Description of Artificial Sequence: Synthetic coding sequence
atggccgccctgggctgtgcccggctgcgctgggccctgcggggggccggccggggcctgtgcccccatggagcccgggccaaggccgccatcccagctgccctgcccagcgacaaggccactggagcccctggggccggccctggggtgagaagacggcagaggagcctggaggagatcccccggctgggccagctgcgcttcttcttccagctgtttgtgcagggctacgccctgcagctgcaccagctgcaggtgctgtacaaggccaagtatggccccatgtggatgagctacctgggcccccagatgcacgtgaacctggccagcgcccccctgctggagcaggtgatgaggcaggagggcaagtaccctgtgagaaatgacatggagctgtggaaggagcaccgggaccagcacgacctgacctacggccccttcaccacagagggccaccactggtaccagctgcggcaggccctgaaccagaggctgctgaagccagctgaggccgccctgtacacagatgccttcaatgaggtgattgatgacttcatgacccggctggaccagctgcgggcagagagcgccagcggcaaccaggtgtctgacatggcccagctgttctactactttgccctggaggccatctgctacatcctgtttgagaagagaattggctgcctgcagaggagcatcccagaagatactgtgacctttgtgcgcagcatcggcctgatgttccagaacagcctgtatgccaccttcctgcccaagtggaccaggcctgtgctgcccttctggaagcgctacctggatggctggaatgccatcttctcctttgggaagaagctgattgatgagaagctggaggacatggaggcccagctgcaggccgccggcccagatggcatccaggtgtctggctacctgcacttcctgctggccagcggccagctgagcccccgggaggccatgggcagcctgcctgagctgctgatggccggcgtggacaccaccagcaacaccctgacctgggccctgtaccacctgagcaaggaccctgagatccaggaggccctgcacgaggaggtggtgggcgtggtgcctgctggccaggtgccccagcacaaggactttgcccacatgcccctgctgaaggctgtgctgaaggagaccctgcggctgtaccctgtggtgcccaccaacagccgcatcatcgagaaggagattgaggtggatggcttcctgttccccaagaacacccagtttgtgttctgccactacgtggtgtcccgggaccccacagccttcagcgagcctgagagcttccagccccaccgctggctgaggaacagccagcctgccaccccccgcatccagcaccccttcggctctgtgcccttcggctatggagtgcgggcctgcctgggcagaagaattgctgagctggagatgcagctgctgctggcccggctcatccagaagtacaaggtggtgctggcccctgagactggagagctgaagtctgtggcccgcatcgtgctggtgcccaacaagaaggtgggcctgcagttcctgcagaggcagtgctag

SEQ ID NO: 149102 - DNA, 1572 bp, Artificial Sequence
  Description of Artificial Sequence: Synthetic coding sequence
atgtccttccacaaggaggatggagtgaacagcctgtgccagaaggccctgcacatcgtgacagagctgtgctttgctggccaggtggagtgggagaagtgcagcggcatcttcccccgggaccggggcagccagggcggcagcagcacagacatctctgtgtccctgctggccgtggtggtgtccttctgtggcctggccctgctggtggtgtccctgtttgtgttctggaagctgtgctggccctgctggaagagcaagcctgtgaccagcaacatcaccaccctgccccagagcatcagcagcgcccccacagaggtgtttgaaacagaggagaagaaggagatcaaggaaaatgagaagccagctgtgaaggccattgaaccagccatcaagatcagccacaccagcccagacatcccagctgaggtgcagacagccctgaaggagcacctgatcaagcacgcccgggtgcagaggcagatcacagagcccaccagcagcaccaggcacagcagcttcagaagacacctgccccggcagatgcaggtgtcctctgtggacttctccatgggcacagagcctgtgctgcagagaggagagaccaccaccagcatcggccgcatcaagccagagctgtacaagcagaagtctgtggacagcgagggcaaccagaatgaagatgtgaagatctgtgggaagctgaacttcaccctgcagtatgactatgaaaatgagctgctggtggtgaagatcatcaaggccctggacctgcctgccaaggacttcaccggcaccagtgacccctacgtgaagatgtacctgctgcctgacaggaagaagaagttccagaccagggtgcacaggaagaccctgaaccccctgtttgatgagaccttccagtttcctgtggcctatgaccagctgagcaacaggaagctgcacttctctgtgtatgactttgaccgcttcagcagacatgacatgattggagaggtgatcctggacaacctgtttgaggtgtctgacctgagccgggaggccaccgtgtggaaggacatccactgtgccaccacagagagcattgacctgggggagatcatgttcagcctgtgctacctgcccacagctggccgcatgaccctgaccgtcatcaagtgcaggaacctgaaggccatggacatcaccggcagcagtgacccctacgtgaaggtgtccctgatgtgtgagggccggcggctgaagaagaggaagaccaccaccaagaagaacaccctgaaccctgtgtacaatgaggccatcatctttgacatccccccagaaaatgtggaccaggtgtccctgagcattgctgtgatggactatgacagagtgggccacaatgaagtcatcggcgtgtgcaggacaggcctggatgctgagggcctgggccgggaccactggaatgagatgctggcctaccacaggaagcccatcacccactggcaccccctgctggagctgcccggccgggccaccagctttgacagccagggcagctgccccagccccaagccacccagcaccccctag

SEQ ID NO: 149103 - DNA, 1512 bp, Artificial Sequence
  Description of Artificial Sequence: Synthetic coding sequence
atggccctgatcccagacctggccatggagacctggctgctgctggccgtgtccctggtgctgctgtacctgtatggcacccacagccacggcctcttcaagaagctgggcatccctggccccacccccctgcccttcctgggcaacatcctgagctaccacaagggcttctgcatgtttgacatggagtgccacaagaagtatggcaaggtgtggggcttctatgatggccagcagcctgtgctggccatcacagatcctgacatgatcaagacagtgctggtgaaggagtgctacagcgtcttcaccaacagaagacccttcggccctgtgggcttcatgaagagcgccatcagcattgctgaagatgaggagtggaagaggctgcggagcctgctgagccccaccttcaccagcggcaagctgaaggagatggtgcccatcatcgcccagtatggagatgtgctggtgaggaacctgcggcgggaggccgagaccgggaagcctgtgaccctgaaggatgtgtttggagcctacagcatggatgtgatcaccagcaccagctttggagtgaacatcgacagcctgaacaacccccaggacccctttgtggagaacaccaagaagctgctgcgctttgacttcctggaccccttcttcctgagcatcaccgtcttccccttcctgatccccatcctggaggtgctgaacatctgtgtgttcccccgggaggtgaccaacttcctgaggaagtctgtgaagaggatgaaggagagccggctggaggacacccagaagcaccgggtggacttcctgcagctgatgattgacagccagaacagcaaggagacagagagccacaaggccctgagtgacctggagctggtggcccagagcatcatcttcatctttgctggctatgagaccaccagctctgtgctgtccttcatcatgtatgagctggccacccacccagatgtgcagcagaagctgcaggaggagattgatgctgtgctgcccaacaaggccccacccacctatgacacagtgctgcagatggagtacctggacatggtggtgaatgagaccctgcggctcttccccatcgccatgaggctggagcgggtgtgcaagaaggatgtggagatcaatggcatgttcatccccaagggcgtggtggtgatgatccccagctatgccctgcaccgggaccccaagtactggacagagcctgagaagttcctgcctgagcgcttcagcaagaagaacaaggacaacatcgacccctacatctacaccccatttggaagtggccccaggaactgcatcggcatgagatttgccctgatgaacatgaagctggccctgatccgggtgctgcagaacttctccttcaagccctgcaaggagacccagatccccctgaagctgagcctgggcggcctgctgcagcctgagaagcctgtggtgctgaaggtggagagcagagatggcaccgtgtctggggcctag

SEQ ID NO: 149104 - DNA, 1062 bp, Artificial Sequence
  Description of Artificial Sequence: Synthetic coding sequence
atggccctgatcccagacctggccatggagacctggctgctgctggccgtgtccctggtgctgctgtacctggtgtttggagcctacagcatggatgtgatcaccagcaccagctttggagtgaacatcgacagcctgaacaacccccaggacccctttgtggagaacaccaagaagctgctgcgctttgacttcctggaccccttcttcctgagcatcaccgtcttccccttcctgatccccatcctggaggtgctgaacatctgtgtgttcccccgggaggtgaccaacttcctgaggaagtctgtgaagaggatgaaggagagccggctggaggacacccagaagcaccgggtggacttcctgcagctgatgattgacagccagaacagcaaggagacagagagccacaaggccctgagtgacctggagctggtggcccagagcatcatcttcatctttgctggctatgagaccaccagctctgtgctgtccttcatcatgtatgagctggccacccacccagatgtgcagcagaagctgcaggaggagattgatgctgtgctgcccaacaaggccccacccacctatgacacagtgctgcagatggagtacctggacatggtggtgaatgagaccctgcggctcttccccatcgccatgaggctggagcgggtgtgcaagaaggatgtggagatcaatggcatgttcatccccaagggcgtggtggtgatgatccccagctatgccctgcaccgggaccccaagtactggacagagcctgagaagttcctgcctgagcgcttcagcaagaagaacaaggacaacatcgacccctacatctacaccccatttggaagtggccccaggaactgcatcggcatgagatttgccctgatgaacatgaagctggccctgatccgggtgctgcagaacttctccttcaagccctgcaaggagacccagatccccctgaagctgagcctgggcggcctgctgcagcctgagaagcctgtggtgctgaaggtggagagcagagatggcaccgtgtctggggcctag

SEQ ID NO: 149105 - DNA, 240 bp, Artificial Sequence
  Description of Artificial Sequence: Synthetic coding sequence
atggtgcccatcatcgcccagtatggagatgtgctggtgaggaacctgcggcgggaggccgagaccgggaagcctgtgaccctgaaggatgtgtttggagcctacagcatggatgtgatcaccagcaccagctttggagtgaacatcgacagcctgaacaacccccaggacccctttgtggagaacaccaagaagctgctgcgctttgacttcctggaccccttcttcctgagcatctag

SEQ ID NO: 149106 - DNA, 1068 bp, Artificial Sequence
  Description of Artificial Sequence: Synthetic coding sequence
atggccaagctgattgccctgaccctgctgggcatgggcctggccctcttcaggaaccaccagagcagctaccagacccggctgaatgccctgcgggaggtgcagcctgtggagctgcccaactgcaacctggtgaagggcatcgagaccggcagcgaggacctggagatcctgcccaacggcctggccttcatcagcagcggcctgaagtacccaggcatcaagagcttcaaccccaacagccctgggaagatcctgctgatggacctgaatgaggaggaccccaccgtgctggagctgggcatcaccggcagcaagtttgatgtgtcctccttcaacccccacggcatcagcaccttcacagatgaagataatgccatgtacctgctggtggtgaaccacccagatgccaagagcacagtggagctgttcaagttccaggaggaggagaagagcctgctgcacctgaagaccatccgccacaagctgctgcccaacctgaatgacatcgtggccgtgggccctgagcacttctacggcaccaatgaccactacttcctggacccctacctgcagagctgggagatgtacctgggcctggcctggagctatgtggtgtactacagccccagcgaggtgcgggtggtggccgagggctttgattttgccaacggcatcaacatcagcccagatggcaagtatgtgtacatcgccgagctgctggcccacaagatccacgtgtatgagaagcacgccaactggaccctgacccccctgaagagcctggacttcaacaccctggtggacaacatctctgtggaccctgagactggagacctgtgggtgggctgccaccccaacggcatgaagatcttcttctatgacagtgaaaatcctccagccagcgaggtgctgcgcatccagaacatcctgacagaggagcccaaggtgacccaggtgtatgcagaaaatggcaccgtgctgcagggcagcacagtggcctctgtgtacaagggcaagctgctgattggaacagtgttccacaaggccctgtactgtgagctgtag

SEQ ID NO: 149107 - DNA, 1263 bp, Artificial Sequence
  Description of Artificial Sequence: Synthetic coding sequence
atggacctgatccccaactttgccatggagacctgggtgctggtggccaccagcctggtgctgctgtacatctacggcacccacagccacaagctgttcaagaagctgggcatccctggccccacccccctgcccttcctgggcaccatcctcttctacctgcggggcctgtggaactttgacagagaatgtaatgagaagtacggggagatgtggggcctgtatgagggccagcagcccatgctggtgatcatggaccctgacatgatcaagacagtgctggtgaaggagtgctacagcgtcttcaccaaccagatgcccctgggccccatgggcttcctgaagagcgccctgagctttgctgaagatgaggagtggaagaggatccgcaccctgctgagccctgccttcacctctgtgaagttcaaggagatggtgcccatcatcagccagtgtggggacatgctggtgcgcagcctgcggcaggaggccgagaacagcaagagcatcaacctgaaggacttcttcggggcctacaccatggatgtgatcaccggcaccctgtttggagtgaacctggacagcctgaacaacccccaggaccccttcctgaagaacatgaagaagctgctgaagctggacttcctggaccccttcctgctgctgatcagcctcttccccttcctgacccctgtgtttgaggccctgaacatcggcctcttccccaaggatgtgacccacttcctgaagaacagcattgaaagaatgaaggagagccggctgaaggacaagcagaagcaccgggtggacttcttccagcagatgattgacagccagaacagcaaggagaccaagagccacaaggccctgagtgacctggagctggtggcccagagcatcatcatcatctttgctgcctatgacaccaccagcaccaccctgcccttcatcatgtatgagctggccacccacccagatgtgcagcagaagctgcaggaggagattgatgctgtgctgcccaacaaggcccctgtgacctatgatgccctggtgcagatggagtacctggacatggtggtgaatgagaccctgcggctcttccctgtggtgtcccgggtgaccagggtgtgcaagaaggacatcgagatcaacggggtcttcatccccaagggcctggccgtgatggtgcccatctatgccctgcaccacgaccccaagtactggacagagcctgagaagttctgcccagagaggagccactag

SEQ ID NO: 149108 - DNA, 843 bp, Artificial Sequence
  Description of Artificial Sequence: Synthetic coding sequence
atgaacctggagactggaaatggcccccaccacttccccatgtggaggtatgtgggggagaagccagaggccggcagccgggagcagcaggtgcaccagctggagcgcttcctgtggggcctgcaccacggctgcaaccactggcacatcatctggagcgagctgggcttcagccagcagagcaccaggagcctgtctgagaagtatgaggaggccttcaagattggcttcttcggcagcctcttcaccctgaacatccagagcctggccgtgctgcccaggcctgagtgcatggtgcgcagcggcctgacagagaccagcacctcctgggtgcgggtcatcctgctgccccagcccccagaggagctgggcctgcagcaccgggtggacttcttccagcagatgattgacagccagaacagcaaggagaccaagagccacaaggccctgagtgacctggagctggtggcccagagcatcatcatcatctttgctgcctatgacaccaccagcaccaccctgcccttcatcatgtatgagctggccacccacccagatgtgcagcagaagctgcaggaggagattgatgctgtgctgcccaacaaggcccctgtgacctatgatgccctggtgcagatggagtacctggacatggtggtgaatgagaccctgcggctcttccctgtggtgtcccgggtgaccagggtgtgcaagaaggacatcgagatcaacggggtcttcatccccaagggcctggccgtgatggtgcccatctatgccctgcaccacgaccccaagtactggacagagcctgagaagttctgcccagagaggagccactag

SEQ ID NO: 149109 - DNA, 1512 bp, Artificial Sequence
  Description of Artificial Sequence: Synthetic coding sequence
atggacctgatccccaactttgccatggagacctgggtgctggtggccaccagcctggtgctgctgtacatctacggcacccacagccacaagctgttcaagaagctgggcatccctggccccacccccctgcccttcctgggcaccatcctcttctacctgcggggcctgtggaactttgacagagaatgtaatgagaagtacggggagatgtggggcctgtatgagggccagcagcccatgctggtgatcatggaccctgacatgatcaagacagtgctggtgaaggagtgctacagcgtcttcaccaaccagatgcccctgggccccatgggcttcctgaagagcgccctgagctttgctgaagatgaggagtggaagaggatccgcaccctgctgagccctgccttcacctctgtgaagttcaaggagatggtgcccatcatcagccagtgtggggacatgctggtgcgcagcctgcggcaggaggccgagaacagcaagagcatcaacctgaaggacttcttcggggcctacaccatggatgtgatcaccggcaccctgtttggagtgaacctggacagcctgaacaacccccaggaccccttcctgaagaacatgaagaagctgctgaagctggacttcctggaccccttcctgctgctgatcagcctcttccccttcctgacccctgtgtttgaggccctgaacatcggcctcttccccaaggatgtgacccacttcctgaagaacagcattgaaagaatgaaggagagccggctgaaggacaagcagaagcaccgggtggacttcttccagcagatgattgacagccagaacagcaaggagaccaagagccacaaggccctgagtgacctggagctggtggcccagagcatcatcatcatctttgctgcctatgacaccaccagcaccaccctgcccttcatcatgtatgagctggccacccacccagatgtgcagcagaagctgcaggaggagattgatgctgtgctgcccaacaaggcccctgtgacctatgatgccctggtgcagatggagtacctggacatggtggtgaatgagaccctgcggctcttccctgtggtgtcccgggtgaccagggtgtgcaagaaggacatcgagatcaacggggtcttcatccccaagggcctggccgtgatggtgcccatctatgccctgcaccacgaccccaagtactggacagagcctgagaagttctgcccagagcgcttcagcaagaagaacaaggacagcattgacctgtaccgctacatcccctttggagctggccccaggaactgcatcggcatgagatttgccctgaccaacatcaagctggccgtcatccgggccctgcagaacttctccttcaagccctgcaaggagacccagatccccctgaagctggacaacctgcccatcctgcagcctgagaagcccatcgtgctgaaggtgcacctgagagatggcatcaccagcggcccctag

SEQ ID NO: 149110 - DNA, 381 bp, Artificial Sequence
  Description of Artificial Sequence: Synthetic coding sequence
atggacctgatccccaactttgccatggagacctgggtgctggtggccaccagcctggtgctgctgtacatctacggcacccacagccacaagctgttcaagaagctgggcatccctggccccacccccctgcccttcctgggcaccatcctcttctacctgcggggcctgtggaactttgacagagaatgtaatgagaagttcctgtggggcctgcaccacggctgcaaccactggcacatcatctggagcgagctgggcttcagccagcagagcaccaggagcctgtctgagaagtatgaggaggccttcaagattggcttcttcggcagcctcttcaccctgaacatcaccctgagcatctcctaccccagcttctag

SEQ ID NO: 149111 - DNA, 225 bp, Artificial Sequence
  Description of Artificial Sequence: Synthetic coding sequence
atggacctgatccccaactttgccatggagacctgggtgctggtggccaccagcctggtgctgctgtacatctacggcacccacagccacaagctgttcaagaagctgggcatccctggccccacccccctgcccttcctgggcaccatcctcttctacctgcggggcctgtggaactttgacagagaatgtaatgagaagtacggggagatgtggggcccctag

SEQ ID NO: 149112 - DNA, 435 bp, Artificial Sequence
  Description of Artificial Sequence: Synthetic coding sequence
atgcccaaggtgaagaggagcaggaaggcccccccagatggctgggagctgattgagcccaccctggatgagctggaccagaagatgagggaggccgagacagagccccatgagggcaagaggaaggtggagagcctgtggcccatcttccgcatccaccaccagaagacccgctacatctttgacctcttctacaagaggaaggccatcagccgggagctgtatgagtactgcatcaaggagggctacgccgacaagaacctgattgccaagtggaagaagcagggctatgagaacctgtgctgcctgcgctgcatccagacccgggacaccaactttggcaccaactgcatctgccgggtgcccaagagcaagctggaggtgggccgcatcattgaatgtacccactgcggctgccggggctgcagcggctag

SEQ ID NO: 149113 - DNA, 120 bp, Artificial Sequence
  Description of Artificial Sequence: Synthetic coding sequence
atggacctgatccccaacctggccgtggagacctggctgctgctggccgtgtccctggtgctgctgtacctgatgagggtgcccaagagcgccaagagccccctgaccaagcagacctag

SEQ ID NO: 149114 - DNA, 1479 bp, Artificial Sequence
  Description of Artificial Sequence: Synthetic coding sequence
atgcagctgctgatgctggagctgctgctgctcttcatcgtgtatggcaccaggacccacggcctcttcaagaggctgggcatccctggccccacccccctgcccctgctgggcaatgtgctgagctaccggcagggcctgtggaagtttgacacagagtgctacaagaagtatggcaagatgtggggcacctatgagggccagctgcctgtgctggccatcacagatcctgatgtgatcagaacagtgctggtgaaggagtgctacagcgtcttcaccaacagaagaagcctgggccctgtgggcttcatgaagagcgccatcagcctggccgaggatgaggagtggaagaggatccgcagcctgctgagccccaccttcaccagcggcaagctgaaggagatgttccccatcatcgcccagtatggagatgtgctggtgaggaacctgcggcgggaggccgagaagggcaagcctgtgaccctgaaggacatctttggagcctacagcatggatgtgatcaccggcaccagctttggagtgaacatcgacagcctgaacaacccccaggacccctttgtggagagcaccaagaagttcctgaagtttggcttcctggaccccctcttcctgagcatcatcctcttccccttcctgacccctgtgtttgaggccctgaatgtgtccctcttccccaaggacaccatcaacttcctgagcaagtctgtgaacaggatgaagaagagccggctgaatgacaagcagaagcaccggctggacttcctgcagctgatgattgacagccagaacagcaaggagacagagagccacaaggccctgagtgacctggagctggccgcccagagcatcatcttcatctttgctggctatgagaccaccagctctgtgctgtccttcaccctgtatgagctggccacccacccagatgtgcagcagaagctgcagaaggagattgatgctgtgctgcccaacaaggccccacccacctatgatgctgtggtgcagatggagtacctggacatggtggtgaatgagaccctgcggctcttccctgtggccatccggctggagaggacctgcaagaaggatgtggagatcaacggggtcttcatccccaagggctccatggtggtgatccccacctacgccctgcaccacgaccccaagtactggacagagcctgaggagttccggcctgagcgcttcagcaagaagaaggacagcattgacccctacatctacacccccttcggcaccggccccaggaactgcatcggcatgagatttgccctgatgaacatgaagctggccctgatccgggtgctgcagaacttctccttcaagccctgcaaggagacccagatccccctgaagctggacacccagggcctgctgcagcctgagaagcccatcgtgctgaaggtggacagcagagatggcaccctgagcggggagtag

SEQ ID NO: 149115 - DNA, 1602 bp, Artificial Sequence
  Description of Artificial Sequence: Synthetic coding sequence
atggacctgatccccaacctggccgtggagacctggctgctgctggccgtgtccctcatcctgctgtacctgtatggcaccaggacccacggcctcttcaagaagctgggcatccctggccccacccccctgcccttcctgggcaatgccctgtccttcaggaagggctactggacctttgacatggagtgctacaagaagtacaggaaggtgtggggcatctatgactgccagcagcccatgctggccatcacagatcctgacatgatcaagacagtgctggtgaaggagtgctacagcgtcttcaccaacagaagacccttcggccctgtgggcttcatgaagaatgccatcagcattgctgaagatgaggagtggaagaggatccgcagcctgctgagccccaccttcaccagcggcaagctgaaggagatggtgcccatcatcgcccagtatggagatgtgctggtgaggaacctgcggcgggaggccgagaccgggaagcctgtgaccctgaagcacgtgtttggagcctacagcatggatgtgatcaccagcaccagctttggagtgtccattgacagcctgaacaacccccaggacccctttgtggagaacaccaagaagctgctgcgcttcaaccccctggacccctttgtgctgagcatcaaggtgttccccttcctgacccccatcctggaggccctgaacatcaccgtcttccccaggaaggtgatctccttcctgaccaagtctgtgaagcagatcaaggagggccgcctgaaggagacccagaagcaccgggtggacttcctgcagctgatgattgacagccagaacagcaaggacagcgagacccacaaggccctgagtgacctggagctgatggcccagagcatcatcttcatctttgctggctatgagaccaccagctctgtgctgtccttcatcatctatgagctggccacccacccagatgtgcagcagaaggtgcagaaggagattgacacagtgctgcccaacaaggccccacccacctatgacacagtgctgcagctggagtacctggacatggtggtgaatgagaccctgcggctcttccctgtggccatgaggctggagcgggtgtgcaagaaggatgtggagatcaatggcatgttcatccccaagggcgtggtggtgatgatccccagctatgtgctgcaccacgaccccaagtactggagggagcctgagaagttcctgcctgagcgcttcagcaagaagaacaaggacaacatcgacccctacatctacaccccatttggaagtggccccaggaactgcatcggcatgagatttgccctggtgaacatgaagctggccctggtgcgggtgctgcagaacttctccttcaagccctgcaaggagacccagatccccctgaagctgcgctttggaggcctgctgctgacagagaagcccatcgtgctgaaggccgagagcagagatgagacctttgtggacatggagcccatccacatggacttcctgcggagcctggccttccagggcccccacctgtgcttcttctgggagctgctgtgccccaccatcagatag

SEQ ID NO: 149116 - DNA, 1512 bp, Artificial Sequence
  Description of Artificial Sequence: Synthetic coding sequence
atggacctgatccccaacctggccgtggagacctggctgctgctggccgtgtccctcatcctgctgtacctgtatggcaccaggacccacggcctcttcaagaagctgggcatccctggccccacccccctgcccttcctgggcaatgccctgtccttcaggaagggctactggacctttgacatggagtgctacaagaagtacaggaaggtgtggggcatctatgactgccagcagcccatgctggccatcacagatcctgacatgatcaagacagtgctggtgaaggagtgctacagcgtcttcaccaacagaagacccttcggccctgtgggcttcatgaagaatgccatcagcattgctgaagatgaggagtggaagaggatccgcagcctgctgagccccaccttcaccagcggcaagctgaaggagatggtgcccatcatcgcccagtatggagatgtgctggtgaggaacctgcggcgggaggccgagaccgggaagcctgtgaccctgaagcacgtgtttggagcctacagcatggatgtgatcaccagcaccagctttggagtgtccattgacagcctgaacaacccccaggacccctttgtggagaacaccaagaagctgctgcgcttcaaccccctggacccctttgtgctgagcatcaaggtgttccccttcctgacccccatcctggaggccctgaacatcaccgtcttccccaggaaggtgatctccttcctgaccaagtctgtgaagcagatcaaggagggccgcctgaaggagacccagaagcaccgggtggacttcctgcagctgatgattgacagccagaacagcaaggacagcgagacccacaaggccctgagtgacctggagctgatggcccagagcatcatcttcatctttgctggctatgagaccaccagctctgtgctgtccttcatcatctatgagctggccacccacccagatgtgcagcagaaggtgcagaaggagattgacacagtgctgcccaacaaggccccacccacctatgacacagtgctgcagctggagtacctggacatggtggtgaatgagaccctgcggctcttccctgtggccatgaggctggagcgggtgtgcaagaaggatgtggagatcaatggcatgttcatccccaagggcgtggtggtgatgatccccagctatgtgctgcaccacgaccccaagtactggagggagcctgagaagttcctgcctgagcgcttcagcaagaagaacaaggacaacatcgacccctacatctacaccccatttggaagtggccccaggaactgcatcggcatgagatttgccctggtgaacatgaagctggccctggtgcgggtgctgcagaacttctccttcaagccctgcaaggagacccagatccccctgaagctgcgctttggaggcctgctgctgacagagaagcccatcgtgctgaaggccgagagcagagatgaaacagtgtctggggcctag

SEQ ID NO: 149117 - DNA, 1410 bp, Artificial Sequence
  Description of Artificial Sequence: Synthetic coding sequence
atggagctgatcagccccaccgtcatcatcatcctgggctgcctggccctcttcctgctgctgcagaggaagaacctgcggcggcccccctgcatcaagggctggatcccctggattggagtgggctttgaatttgggaaggcccccctggagttcatcgagaaggcccgcatcaagtatggccccatcttcaccgtgtttgccatgggcaacaggatgacctttgtgacagaggaggagggcatcaacgtgttcctgaagagcaagaaggtggactttgagctggccgtgcagaacatcgtgtacagaacagccagcatccccaagaatgtgttcctggccctgcacgagaagctgtacatcatgctgaagggcaagatgggcaccgtgaacctgcaccagttcaccggccagctgacagaggagctgcacgagcagctggagaacctgggcacccacggcaccatggacctgaacaacctggtgcgccacctgctgtaccctgtgacagtgaacatgctgttcaacaagagcctcttcagcaccaacaagaagaagatcaaggagttccaccagtacttccaggtgtatgatgaagattttgaatatggcagccagctgcctgaatgtctgctgaggaactggagcaagagcaagaagtggttcctggagctgtttgagaagaacatcccagacatcaaggcctgcaagagcgccaaggacaacagcatgaccctgctgcaggccaccctggacatcgtggagacagagaccagcaaagaaaacagccccaactacggcctgctgctgctgtgggccagcctgagcaatgctgtgcctgtggccttctggaccctggcctacgtgctgagccacccagacatccacaaggccatcatggagggcatcagctctgtgtttgggaaggccggcaaggacaagatcaaggtgtctgaagatgacctggagaacctgctgctgatcaagtggtgtgtgctggagaccatccggctgaaggcccctggggtcatcaccaggaaggtggtgaagcctgtggagatcctgaactacatcatccccagcggggacctgctgatgctgagccccttctggctgcacaggaaccccaagtacttccctgagcctgagctgttcaagccagagcgctggaagaaggccaacctggagaagcacagcttcctggactgcttcatggcctttggaagtggcaagttccagtgcccagcccgctggtttgccctgctggaggtgcagatgtgcatcatcctgatcctgtacaagtatgactgcagcctgctggaccccctgcccaagcagagctacctgcacctggtgggcgtgccccagcctgagggccagtgcagaattgagtacaagcagaggatctag

SEQ ID NO: 149118 - DNA, 1560 bp, Artificial Sequence
  Description of Artificial Sequence: Synthetic coding sequence
atgtctgtgtctgtgctgagccccagccggctgctgggagatgtgtctggcatcctgcaggccgccagcctgctgatcctgctgctgctgctgatcaaggctgtgcagctgtacctgcaccggcagtggctgctgaaggccctgcagcagttcccctgcccccccagccactggctgtttggccacatccaggagctgcagcaggaccaggagctgcagaggatccagaagtgggtggagaccttccccagcgcctgcccccactggctgtggggcggcaaggtgcgggtgcagctgtatgaccctgactacatgaaggtgatcctgggccgcagtgaccccaagagccacggcagctaccgcttcctggccccctggattggctacggcctgctgctgctgaatggccagacctggttccagcacaggaggatgctgaccccagccttccactatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagtgtgccttcagccaccagggcagcatccaggtggacaggaacagccagagctacatccaggccatcagtgacctgaacaacctggtgttcagccgggtgagaaatgccttccaccagaatgacaccatctacagcctgaccagcgctggccgctggacccaccgggcctgccagctggcccaccagcacacagaccaggtgatccagctgaggaaggcccagctgcagaaggagggggagctggagaagatcaagaggaagaggcacctggacttcctggacatcctgctgctggccaagatggagaatggcagcatcctgagtgacaaggacctgcgggcagaggtggacaccttcatgtttgagggccatgacaccacagccagcggcatctcctggatcctgtatgccctggccacccaccccaagcaccaggagcgctgccgggaggagatccacagcctgctgggagatggagccagcatcacctggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaaccctgaggtgtttgaccccttccgctttgcccctggcagcgcccagcacagccacgccttcctgcccttcagcggcggcagcaggaactgcatcggcaagcagtttgccatgaatgagctgaaggtggccacagccctgaccctgctgcgctttgagctgctgcctgaccccacccgcatccccatccccatcgcccggctggtgctgaagagcaagaatggcatccacctgcggctgcggcggctgcccaacccctgtgaggacaaggaccagctgtag

SEQ ID NO: 149119 - DNA, 1563 bp, Artificial Sequence
  Description of Artificial Sequence: Synthetic coding sequence
atgtctgtgtctgtgctgagccccagccggctgctgggagatgtgtctggcatcctgcaggccgccagcctgctgatcctgctgctgctgctgatcaaggctgtgcagctgtacctgcaccggcagtggctgctgaaggccctgcagcagttcccctgcccccccagccactggctgtttggccacatccaggagctgcagcaggaccaggagctgcagaggatccagaagtgggtggagaccttccccagcgcctgcccccactggctgtggggcggcaaggtgcgggtgcagctgtatgaccctgactacatgaaggtgatcctgggccgcagtgaccccaagagccacggcagctaccgcttcctggccccctggattggctacggcctgctgctgctgaatggccagacctggttccagcacaggaggatgctgaccccagccttccactatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagtgtgccttcagccaccagggcagcatccaggtggacaggaacagccagagctacatccaggccatcagtgacctgaacaacctggtgttcagccgggtgagaaatgccttccaccagaatgacaccatctacagcctgaccagcgctggccgctggacccaccgggcctgccagctggcccaccagcacactggagaccaggtgatccagctgaggaaggcccagctgcagaaggagggggagctggagaagatcaagaggaagaggcacctggacttcctggacatcctgctgctggccaagatggagaatggcagcatcctgagtgacaaggacctgcgggcagaggtggacaccttcatgtttgagggccatgacaccacagccagcggcatctcctggatcctgtatgccctggccacccaccccaagcaccaggagcgctgccgggaggagatccacagcctgctgggagatggagccagcatcacctggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaaccctgaggtgtttgaccccttccgctttgcccctggcagcgcccagcacagccacgccttcctgcccttcagcggcggcagcaggaactgcatcggcaagcagtttgccatgaatgagctgaaggtggccacagccctgaccctgctgcgctttgagctgctgcctgaccccacccgcatccccatccccatcgcccggctggtgctgaagagcaagaatggcatccacctgcggctgcggcggctgcccaacccctgtgaggacaaggaccagctgtag

SEQ ID NO: 149120 - DNA, 1368 bp, Artificial Sequence
  Description of Artificial Sequence: Synthetic coding sequence
atgtctgtgtctgtgctgagccccagccggctgctgggagatgtgtctggcatcctgcaggccgccagcctgctgatcctgctgctgctgctgatcaaggctgtgcagctgtacctgcaccggcagtggctgctgaaggccctgcagcagttcccctgcccccccagccactggctgtttggccacatccaggagctgcagcaggaccaggagctgcagaggatccagaagtgggtggagaccttccccagcgcctgcccccactggctgtggggcggcaaggtgcgggtgcagctgtatgaccctgactacatgaaggtgatcctgggccgcagtgaccccaagagccacggcagctaccgcttcctggccccctggattggctacggcctgctgctgctgaatggccagacctggttccagcacaggaggatgctgaccccagccttccactatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagtgtgccttcagccaccagggcagcatccaggtggacaggaacagccagagctacatccaggccatcagtgacctgaacaacctggtgttcagccgggtgagaaatgccttccaccagaatgacaccatctacagcctgaccagcgctggccgctggacccaccgggcctgccagctggcccaccagcacacagaccaggtgatccagctgaggaaggcccagctgcagaaggagggggagctggagaagatcaagaggaagaggcacctggacttcctggacatcctgctgctggccaagatggagaatggcagcatcctgagtgacaaggacctgcgggcagaggtggacaccttcatgtttgagggccatgacaccacagccagcggcatctcctggatcctgtatgccctggccacccaccccaagcaccaggagcgctgccgggaggagatccacagcctgctgggagatggagccagcatcacctggaaccacctggaccagatgccctacaccaccatgtgcatcaaggaggccctgcggctgtacccacctgtgcccggcatcggccgggagctgagcacccctgtgaccttcccagatggccgcagcctgcccaagggcatcatggtgctgctgagcatctacggcctgcaccacaaccccaaggtgtggcccaaccctgaggtgtttgaccccttccgctttgcccctggcagcgcccagcacagccacgccttcctgcccttcagcggcggcagcaggtag

SEQ ID NO: 149121 - DNA, 474 bp, Artificial Sequence
  Description of Artificial Sequence: Synthetic coding sequence
atgaaggtgatcctgggccgcagtgaccccaagagccacggcagctaccgcttcctggccccctggattggctacggcctgctgctgctgaatggccagacctggttccagcacaggaggatgctgaccccagccttccactatgacatcctgaagccctacgtgggcctgatggctgacagcgtgcgggtgatgctggacaagtgggaggagctgctgggccaggacagccccctggaggtgttccagcacgtgtccctgatgaccctggacaccatcatgaagtgtgccttcagccaccagggcagcatccaggtggaccggcccagcgaccccacagaggagggcagcaccacagaaggaggaggagctggggaggaccaggaggaggaggccttcggcttcagcggctacccacccctgggccagaatggagagtgggagcacctggtgcggcagggccccccctgctag

SEQ ID NO: 149122 - DNA, 1575 bp, Artificial Sequence
  Description of Artificial Sequence: Synthetic coding sequence
atgccccagctgagcctgtcctggctgggcctgggccctgtggccgccagcccctggctgctgctgctgctggtgggcggctcctggctgctggcccgggtgctggcctggacctacaccttctatgacaactgccggcggctgcagtgcttcccccagccccccaagcagaactggttctggggccaccagggcctggtgacccccacagaggagggcatgaagaccctgacccagctggtgaccacctacccccagggcttcaagctgtggctgggccccaccttccccctgctgatcctgtgccacccagacatcatccggcccatcaccagcgccagcgctgctgtggcccccaaggacatgatcttctacggcttcctgaagccctggctgggagatggcctgctgctgtctggaggagacaagtggagccgccacaggaggatgctgaccccagccttccacttcaacatcctgaagccctacatgaagatcttcaacaagtctgtgaacatcatgcatgacaagtggcagaggctggccagcgagggcagcgcccggctggacatgtttgagcacatcagcctgatgaccctggacagcctgcagaagtgtgtgttctcctttgagagcaactgccaggagaagcccagcgagtacatcgccgccatcctggagctgagcgcctttgtggagaagaggaaccagcagatcctgctgcacacagacttcctgtactacctgaccccagatggccagcgcttcagaagagcctgccacctggtgcatgacttcacagatgctgtgatccaggagcggcgctgcaccctgcccacccagggcattgatgacttcctgaagaacaaggccaagagcaagaccctggacttcattgatgtgctgctgctgagcaaggatgaagatggcaaggagctgagtgatgaggacatccgggcagaggccgacaccttcatgtttgagggccatgacaccacagccagcggcctgtcctgggtgctgtaccacctggccaagcaccctgagtaccaggagcagtgccggcaggaggtgcaggagctgctgaaggaccgggagcccatcgagattgagtgggatgacctggcccagctgcccttcctgaccatgtgcatcaaggagagcctgcggctgcacccccctgtgcctgtgatcagccgctgctgcacccaggactttgtgctgcctgatggccgggtcatccccaagggcatcgtgtgcctgatcaacatcatcggcatccactacaaccccaccgtgtggccagaccctgaggtgtatgaccccttccgctttgaccaggagaacatcaaggagaggagccccctggccttcatccccttctctgctggccccaggaactgcatcggccaggcctttgccatggccgagatgaaggtggtgctggccctgaccctgctgcacttccgcatcctgcccacccacacagagcccaggaggaagccagagctgatcctgcgggcagagggcggcctgtggctgcgggtggagcccctgggcgccaacagccagtag

SEQ ID NO: 149123 - DNA, 1365 bp, Artificial Sequence
  Description of Artificial Sequence: Synthetic coding sequence
atgccccagctgagcctgtcctggctgggcctgggccctgtggccgccagcccctggctgctgctgctgctggtgggcggctcctggctgctggcccgggtgctggcctggacctacaccttctatgacaactgccggcggctgcagtgcttcccccagccccccaagcagaactggttctggggccaccagggcctggtgacccccacagaggagggcatgaagaccctgacccagctggtgaccacctacccccagggcttcaagctgtggctgggccccaccttccccctgctgatcctgtgccacccagacatcatccggcccatcaccagcgccagcgctgctgtggcccccaaggacatgatcttctacggcttcctgaagccctggctgggagatggcctgctgctgtctggaggagacaagtggagccgccacaggaggatgctgaccccagccttccacttcaacatcctgaagccctacatgaagatcttcaacaagtctgtgaacatcatgcatgacaagtggcagaggctggccagcgagggcagcgcccggctggacatgtttgagcacatcagcctgatgaccctggacagcctgcagaagtgtgtgttctcctttgagagcaactgccaggagaagcccagcgagtacatcgccgccatcctggagctgagcgcctttgtggagaagaggaaccagcagatcctgctgcacacagacttcctgtactacctgaccccagatggccagcgcttcagaagagcctgccacctggtgcatgacttcacagatgctgtgatccaggagcggcgctgcaccctgcccacccagggcattgatgacttcctgaagaacaaggccaagagcaagaccctggacttcattgatgtgctgctgctgagcaaggatgaagatggcaaggagctgagtgatgaggacatccgggcagaggccgacaccttcatgtttgagggccatgacaccacagccagcggcctgtcctgggtgctgtaccacctggccaagcaccctgagtaccaggagcagtgccggcaggaggtgcaggagctgctgaaggaccgggagcccatcgagattgagtgggatgacctggcccagctgcccttcctgaccatgtgcatcaaggagagcctgcggctgcacccccctgtgcctgtgatcagccgctgctgcacccaggactttgtgctgcctgatggccgggtcatccccaagggcctgcggcccctgcccttccggccccgggagcaccagggcgaggtgaccagcggcttctacagcctgctgggccgggcccagaagctgcacagagctggggtgagacatggatag

SEQ ID NO: 149124 - DNA, 1575 bp, Artificial Sequence; identical to SEQ ID NO: 149122
  Description of Artificial Sequence: Synthetic coding sequence

SEQ ID NO: 149125 - DNA, 1575 bp, Artificial Sequence
  Description of Artificial Sequence: Synthetic coding sequence
atgagcctgctgagcctgccctggctgggcctgcggcctgtggccaccagcccctggctgctgctgctgctggtggtgggctcctggctgctggcccgcatcctggcctggacctacgccttctacaacaactgccggcggctgcagtgcttcccccagccccccaagaggaactggttctggggccacctgggcctcatcacccccacagaggagggcctgaagaacagcacccagatgtctgccacctacagccagggcttcaccatctggctgggccccatcatccccttcatcgtgctgtgccacccagacaccatccgcagcatcaccaatgccagcgctgccatcgcccccaaggacaacctcttcatccgcttcctgaagccctggctgggggagggcatcctgctgtctggaggagacaagtggagccgccacaggaggatgctgaccccagccttccacttcaacatcctgaagagctacatcaccatcttcaacaagagcgccaacatcatgctggacaagtggcagcacctggccagcgagggcagcagctgcctggacatgtttgagcacatcagcctgatgaccctggacagcctgcagaagtgcatcttctcctttgacagccactgccaggagcggcccagcgagtacatcgccaccatcctggagctgagcgccctggtggagaagaggagccagcacatcctgcagcacatggacttcctgtactacctgagccatgatggccgccgcttccaccgggcctgccgcctggtgcatgacttcacagatgctgtgatccgggagaggaggaggaccctgcccacccagggcattgatgacttcttcaaggacaaggccaagagcaagaccctggacttcattgatgtgctgctgctgagcaaggatgaagatggcaaggccctgagtgatgaggacatccgggcagaggccgacaccttcatgtttggaggccatgacaccacagccagcggcctgtcctgggtgctgtacaacctggcccggcaccctgagtaccaggagcgctgccggcaggaggtgcaggagctgctgaaggaccgggaccccaaggagattgagtgggatgacctggcccagctgcccttcctgaccatgtgtgtgaaggagagcctgcggctgcaccccccagcccccttcatcagccgctgctgcacccaggacatcgtgctgcctgatggccgggtcatccccaagggcatcacctgcctgattgacatcattggagtgcaccacaaccccaccgtgtggccagaccctgaggtgtatgaccccttccgctttgatcctgagaacagcaagggccgcagccccctggccttcatccccttctctgctggccccaggaactgcatcggccaggcctttgccatggccgagatgaaggtggtgctggccctgatgctgctgcacttccgcttcctgcctgaccacacagagcccaggaggaagctggagctgatcatgagagctgagggcggcctgtggctgcgggtggagcccctgaatgtgtccctgcagtag

SEQ ID NO: 149126 - DNA, 1575 bp, Artificial Sequence; identical to SEQ ID NO: 149125
  Description of Artificial Sequence: Synthetic coding sequence

SEQ ID NO: 149127 - DNA, 1596 bp, Artificial Sequence
  Description of Artificial Sequence: Synthetic coding sequence
atgctgcccatcacagaccggctgctgcacctgctgggcctggagaagacagccttccgcatctatgctgtgtccaccctgctgctcttcctgctcttcttcctgttccggctgctgctgcgcttcctgcggctgtgccgctccttctacatcacctgccggcggctgcgctgcttcccccagccccccaggaggaactggctgctgggccacctgggcatgtacctgcccaatgaggccggcctgcaggatgagaagaaggtgctggacaacatgcaccacgtgctgctggtgtggatgggccctgtgctgcccctgctggtgctggtgcacccagactacatcaagcccctgctgggcgccagcgctgccatcgcccccaaggatgacctcttctacggcttcctgaagccctggctgggagatggcctgctgctgagcaagggggacaagtggagccgccaccggcggctgctgaccccagccttccactttgacatcctgaagccctacatgaagatcttcaaccagagcgctgacatcatgcacgccaagtggaggcacctggccgagggcagcgctgtgtccctggacatgtttgagcacatcagcctgatgaccctggacagcctgcagaagtgtgtgttctcctacaacagcaactgccaggagaagatgtctgactacatcagcgccatcatcgagctgagcgccctgtctgtgcggcggcagtaccgcctgcaccactacctggacttcatctactacagatctgcagatggccgccgcttccggcaggcctgtgacatggtgcaccacttcaccacagaggtgatccaggagaggagaagagccctgcggcagcagggcgctgaggcctggctgaaggccaagcagggcaagaccctggacttcattgatgtgctgctgctggccagagatgaagatggcaaggagctgagtgatgaggacatccgggcagaggccgacaccttcatgtttgagggccatgacaccaccagcagcggcatctcctggatgctgttcaacctggccaagtacccagagtaccaggagaagtgccgggaggagatccaggaggtgatgaagggccgggagctggaggagctggagtgggatgacctgacccagctgcccttcaccaccatgtgcatcaaggagagcctgcggcagtacccacctgtgaccctggtgtcccggcagtgcacagaggacatcaagctgcctgatggccgcatcatccccaagggcatcatctgcctggtgtccatctacggcacccaccacaaccccaccgtgtggccagacagcaaggtgtacaacccctacagatttgatcctgacaacccccagcagaggagccccctggcctacgtgcccttctctgctggccccaggaactgcatcggccagagctttgccatggccgagctgcgggtggtggtggccctgaccctgctgcgcttccggctgtctgtggacaggaccaggaaggtgcggaggaagccagagctgatcctgaggacagaaaatggcctgtggctgaaggtggagcccctgcccccccgggcctag

SEQ ID NO: 149128 - DNA, 1782 bp, Artificial Sequence
  Description of Artificial Sequence: Synthetic coding sequence
atggcccccagcggcctgaaggctgtggtgggggagaagatcctgagcggggtcatccgctctgtgaagaaggatggagagtggaaggtgctgatcatggaccaccccagcatgaggatcctgagcagctgctgcaagatgtctgacatcctggccgagggcatcaccatcgtggaggacatcaacaagaggcgggagcccatccccagcctggaggccatctacctgctgagccccacagagaagtctgtgcaggccctgatcaaggacttccagggcacccccaccttcacctacaaggccgcccacatcttcttcacagacacctgcccagagcccctcttcagcgagctgggccgcagccggctggccaaggtggtgaagaccctgaaggagatccacctggccttcctgccctatgaggcccaggtgttcagcctggatgccccccacagcacctacaacctgtactgccccttccgggcagaggagaggacccggcagctggaggtgctggcccagcagatcgccaccctgtgtgccaccctgcaggagtacccagccatccgctacagaaaaggacctgaggacacagcccagctggcccatgctgtgctggccaagctgaatgccttcaaggctgacacccccagcctgggggagggccctgagaagaccaggagccagctgctgatcatggacagagctgctgaccctgtgagccccctgctgcacgagctgaccttccaggccatggcctatgacctgctggacatcgagcaggacacctaccgctatgagaccaccggcctgtctgaggcccgggagaaggctgtgctgctggatgaagatgatgacctgtgggtggagctgcggcacatgcacatcgcagatgtgtccaagaaggtgacagagctgctgcggaccttctgtgagagcaagaggctgaccacagacaaggccaacatcaaggacctgagccagatcctgaagaagatgccccagtaccagaaggagctgaacaagtacagcacccacctgcacctggctgatgactgcatgaagcacttcaagggctctgtggagaagctgtgcagcgtggagcaggacctggccatgggcagtgatgctgagggggagaagatcaaggacagcatgaagctgattgtgcctgtgctgctggatgctgctgtgcctgcctatgacaagatccgggtgctgctgctgtacatcctgctgagaaatggagtgtctgaggagaacctggccaagctgatccagcacgccaacgtgcaggcccacagcagcctcatccggaacctggagcagctgggcggcaccgtgaccaaccctgggggcagcggcaccagcagccggctggagccccgggagaggatggagcccacctaccagctgagccgctggacccctgtgatcaaggatgtgatggaggatgctgtggaggaccggctggacaggaacctgtggccctttgtgtctgaccctgcccccacagccagcagccaggccgctgtgtctgcccgcttcggccactggcacaagaacaaggccggcatcgaggcccgggccggcccccggctgattgtgtatgtgatgggcggcgtggccatgtctgagatgagagctgcctatgaggtgacccgggccacagagggcaagtgggaggtgctgattggcagcagccacatcctgacccccacccgcttcctggatgacctgaaggccctggacaagaagctggaggacatcgccctgccctag

SEQ ID NO: 149129 - DNA, 1344 bp, Artificial Sequence
  Description of Artificial Sequence: Synthetic coding sequence
atgagggtgctgacccagctggtggccacctacccccagggcttcaaggtgtggatgggccccatcttccctgtgatccgcttctgccaccccaacatcatccgcagcgtcatcaatgccagcgctgccatcgtgcccaaggacaaggtgttctacagcttcctgaagccctggctgggagatggcctgctgctgtctgctggggagaagtggagccgccacaggaggatgctgaccccagccttccacttcaacatcctgaagccctacatgaagatcttcaatgaatctgtgaacatcatgcacgccaagtggcagctgctggccagcgagggcagcgcccggctggacatgtttgagcacatcagcctgatgaccctggacagcctgcagaagtgtgtgttctcctttgacagccactgccaggagaagcccagcgagtacatcgccgccatcctggagctgagcgccctggtgaccaagaggcaccagcagatcctgctgtacatcgacttcctgtactacctgaccccagatggccagcgcttccggcgggcctgccgcctggtgcatgacttcacagatgctgtgatccaggagaggaggaggaccctgcccagccagggcgtggatgacttcctgcaggccaaggccaagagcaagaccctggacttcattgatgtgctgctgctgagcaaggatgaagatggcaagaagctgagtgatgaggacatccgggcagaggccgacaccttcatgtttgagggccatgacaccacagccagcggcctgtcctgggtgctgtaccacctggccaagcaccctgagtaccaggagcgctgccggcaggaggtgcaggagctgctgaaggaccgggagcccaaggagattgagtgggatgacctggcccagctgcccttcctgaccatgtgcatcaaggagagcctgcggctgcacccccctgtgcctgctgtgagccgctgctgcacccaggacatcgtgctgcctgatggccgggtcatccccaagggcatcatctgcctgatctctgtgtttggcacccaccacaacccagctgtgtggccagaccctgaggtgtatgaccccttccgctttgaccccaagaacatcaaggagaggagccccctggccttcatccccttctctgctggccccaggaactgcatcggccaggcctttgccatggccgagatgaaggtggtgctgggcctgaccctgctgcgcttccgggtgctgcctgaccacacagagcccaggaggaagccagagctggtgctgcgggcagagggcggcctgtggctgcgggtggagcccctgtcctag

SEQ ID NO: 149130 - DNA, 999 bp, Artificial Sequence
  Description of Artificial Sequence: Synthetic coding sequence
atgcccagcatcaccacagctgctgccagcggcgtgagccgcagccctggcaacagaacaggctcctgggtgacctgggcctggaagcccagcgagtacatcacagccatcatggagctgagcgccctggtggtgaagaggaacaaccagttcttccgctacaaggacttcctgtacttcctgaccccctgtggccgccgcttccaccgggcctgccgcctggtgcatgacttcacagatgctgtgatccaggagaggaggaggaccctgaccagccagggcgtggatgacttcctgcaggccaaggccaagagcaagaccctggacttcattgatgtgctgctgctgtctgaggacaagaatggcaaggagctgagtgatgaggacatccgggcagaggccgacaccttcatgtttggaggccatgacaccacagccagcggcctgtcctgggtgctgtacaacctggcccggcaccctgagtaccaggagcgctgccggcaggaggtgcaggagctgctgaaggaccgggagcccaaggagattgagtgggatgacctggcccagctgcccttcctgaccatgtgcctgaaggagagcctgcggctgcacccccccatccccacctttgcccggggctgcacccaggatgtggtgctgcctgacagcagggtcatccccaagggaaatgtgtgcaacatcaacatctttgccatccaccacaaccccagcgtgtggccagaccctgaggtgtatgaccccttccgctttgatcctgaaaatgcccagaagaggagccccatggccttcatccccttctctgctggccccaggaactgcatcggccagaagtttgccatggccgagatgaaggtggtgctggccctgaccctgctgcgcttccgcatcctgcctgaccaccgggagcccaggaggaccccagagatcgtgctgcgggcagaagatggcctgtggctgcgggtggagcccctgggctag

SEQ ID NO: 149131 - DNA, 1560 bp, Artificial Sequence
  Description of Artificial Sequence: Synthetic coding sequence
atgagcctgctgagcctgtcctggctgggcctgcggcctgtggccgccagcccctggctgctgctgctggtggtgggcgcctcctggctgctggcccgcatcctggcctggacctacgccttctaccacaacggccggcggctgcgctgcttcccccagcccaggaagcagaactggttcctgggccacctgggcctggtgacccccacagaggagggcctgcgggtgctgacccagctggtggccacctacccccagggctttgtgcgctggctgggccccatcacccccatcatcaacctgtgccacccagacatcgtgcgcagcgtcatcaacaccagtgatgccatcacagacaaggacatcgtgttctacaagaccctgaagccctggctgggagatggcctgctgctgtctgtgggggacaagtggaggcaccaccggcggctgaccccagccttccacttcaacatcctgaagccctacatcaagatcttcagcaagagcgccaacatcatgcacgccaagtggcagaggctggccatggagggcagcacctgcctggatgtgtttgagcacatcagcctgatgaccctggacagcctgcagaagtgcatcttctcctttgacagcaactgccaggagaagcccagcgagtacatcacagccatcatggagctgagcgccctggtggtgaagaggaacaaccagttcttccgctacaaggacttcctgtacttcctgaccccctgtggccgccgcttccaccgggcctgccgcctggtgcatgacttcacagatgctgtgatccaggagaggaggaggaccctgaccagccagggcgtggatgacttcctgcaggccaaggccaagagcaagaccctggacttcattgatgtgctgctgctgtctgaggacaagaatggcaaggagctgagtgatgaggacatccgggcagaggccgacaccttcatgtttggaggccatgacaccacagccagcggcctgtcctgggtgctgtacaacctggcccggcaccctgagtaccaggagcgctgccggcaggaggtgcaggagctgctgaaggaccgggagcccaaggagattgagtgggatgacctggcccagctgcccttcctgaccatgtgcctgaaggagagcctgcggctgcacccccccatccccacctttgcccggggctgcacccaggatgtggtgctgcctgacagcagggtcatccccaagggaaatgtgtgcaacatcaacatctttgccatccaccacaaccccagcgtgtggccagaccctgaggtgtatgaccccttccgctttgatcctgaaaatgcccagaagaggagccccatggccttcatccccttctctgctggccccaggaactgcatcggccagaagtttgccatggccgagatgaaggtggtgctggccctgaccctgctgcgcttccgcatcctgcctgaccaccgggagcccaggaggaccccagaaattgtgctgcgggcagaagatggcctgtggctgcgggtggagcccctgggctag

SEQ ID NO: 149132 - DNA, 804 bp, Artificial Sequence
  Description of Artificial Sequence: Synthetic coding sequence
accccagccttccacttcaacatcctgaagccctacatcaagatcttcagcaagagcgccaacatcatgcacgccaagtggcagaggctggccatggagggcagcacctgcctggatgtgtttgagcacatcagcctgatgaccctggacagcctgcagaagtgcatcttctcctttgacagcaactgccaggagaagcccagcgagtacatcacagccatcatggagctgagcgccctggtggtgaagaggaacaaccagttcttccgctacaaggacttcctgtacttcctgaccccctgtggccgccgcttccaccgggcctgccgcctggtgcatgacttcacagatgctgtgatccaggagaggaggaggaccctgaccagccagggcgtggatgacttcctgcaggccaaggccaagagcaagaccctggacttcattgatgtgctgctgctgtctgaggacaagaatggcaaggagctgagtgatgaggacatccgggcagaggccgacaccttcatgtttggaggccatgacaccacagccagcggcctgtcctgggtgctgtacaacctggcccggcaccctgagtaccaggagcgctgccggcaggaggtgcaggagctgctgaaggaccgggagcccaaggagattgagtgggatgacctggcccagctgcccttcctgaccatgtgcctgaaggagagcctgcggctgcacccccccatccccacctttgcccggggctgcacccaggatgtggtgctgcctgacagcagggtcatccccaagggcctgtag

SEQ ID NO: 149133 - DNA, 1512 bp, Artificial Sequence
  Description of Artificial Sequence: Synthetic coding sequence
atggccggcctgtggctgggcctggtgtggcagaagctgctgctgtggggcgccgccagcgccctgagcctggccggggccagcctggtgctgagcctgctgcagagggtggccagctatgccctgctgatgaagccagatggccgggagttcttccagcagatcatcgagtacacagaggagtaccgccacatgcccctgctgaagctgtgggtgggccctgtgcccatggtggccctgtacaatgcagaaaatgtggaggtgatcctgaccagcagcaagcagattgacaagagctccatgtacaagttcctggagccctggctgggcctgggcctgctgaccagcactggaaacaagtggaggagcaggaggaagatgctgacccccaccttccacttcaccatcctggaggacttcctggacatcatgaatgagcaggccaacatcctggtgaagaagctggagaagcacatcaaccaggaggccttcaactgcttcttctacatcaccctgtgtgccctggacatcatctgtgaaacagccatgggcaagaacattggagcccagagcaatgatgattctgaatatgtgcgggctgtgtacaggatgtctgagatgatcttccgccgcatcaagatgccctggctgtggctggacctgtggtacctgatgttcaaggagggctgggagcacaagaagagcctgcagatcctgcacaccttcaccaacagcgtgattgctgagcgggccaatgagatgaatgccaatgaagactgcagaggagatggccggggcagcgcccccagcaagaacaagaggcgggccttcctggacctgctgctgtctgtgacagatgatgagggcaaccggctgagccatgaggacatccgggaggaggtggacaccttcatgtttgagggccatgacaccacagctgctgccatcaactggagcctgtacctgctgggcagcaaccctgaggtgcagaagaaggtggaccacgagctggatgatgtgtttgggaagagtgacaggcctgccaccgtggaggacctgaagaagctgcgctacctggagtgtgtgatcaaggagaccctgcggctcttccccagcgtgcccctgtttgcccggtctgtgtctgaggactgtgaggtggccggctacagagtgctgaagggcacagaagctgtgatcatcccctatgccctgcaccgggacccccgctacttccccaaccctgaggagttccagcctgagcgcttcttcccagaaaatgcccagggccgccacccctatgcctacgtgcccttctctgctggccccaggaactgcatcggccagaagtttgctgtgatggaggagaagaccatcctgagctgcatcctgcggcacttctggattgagagcaaccagaagcgggaggagctgggcctggagggccagctgatcctgcggcccagcaatggcatctggatcaagctgaagagaagaaatgctgatgaaagatag

SEQ ID NO: 149134 - DNA, 1578 bp, Artificial Sequence
  Description of Artificial Sequence: Synthetic coding sequence
atggccggcctgtggctgggcctggtgtggcagaagctgctgctgtggggcgccgccagcgccctgagcctggccggggccagcctggtgctgagcctgctgcagagggtggccagctatgccaggaagtggcagcagatgaggcccatccccaccgtggcccgggcctaccccctggtgggccacgccctgctgatgaagccagatggccgggagttcttccagcagatcatcgagtacacagaggagtaccgccacatgcccctgctgaagctgtgggtgggccctgtgcccatggtggccctgtacaatgcagaaaatgtggaggtgatcctgaccagcagcaagcagattgacaagagctccatgtacaagttcctggagccctggctgggcctgggcctgctgaccagcactggaaacaagtggaggagcaggaggaagatgctgacccccaccttccacttcaccatcctggaggacttcctggacatcatgaatgagcaggccaacatcctggtgaagaagctggagaagcacatcaaccaggaggccttcaactgcttcttctacatcaccctgtgtgccctggacatcatctgtgaaacagccatgggcaagaacattggagcccagagcaatgatgattctgaatatgtgcgggctgtgtacaggatgtctgagatgatcttccgccgcatcaagatgccctggctgtggctggacctgtggtacctgatgttcaaggagggctgggagcacaagaagagcctgcagatcctgcacaccttcaccaacagcgtgattgctgagcgggccaatgagatgaatgccaatgaagactgcagaggagatggccggggcagcgcccccagcaagaacaagaggcgggccttcctggacctgctgctgtctgtgacagatgatgagggcaaccggctgagccatgaggacatccgggaggaggtggacaccttcatgtttgagggccatgacaccacagctgctgccatcaactggagcctgtacctgctgggcagcaaccctgaggtgcagaagaaggtggaccacgagctggatgatgtgtttgggaagagtgacaggcctgccaccgtggaggacctgaagaagctgcgctacctggagtgtgtgatcaaggagaccctgcggctcttccccagcgtgcccctgtttgcccggtctgtgtctgaggactgtgaggtggccggctacagagtgctgaagggcacagaagctgtgatcatcccctatgccctgcaccgggacccccgctacttccccaaccctgaggagttccagcctgagcgcttcttcccagaaaatgcccagggccgccacccctatgcctacgtgcccttctctgctggccccaggaactgcatcggccagaagtttgctgtgatggaggagaagaccatcctgagctgcatcctgcggcacttctggattgagagcaaccagaagcgggaggagctgggcctggagggccagctgatcctgcggcccagcaatggcatctggatcaagctgaagagaagaaatgctgatgaaagatag

SEQ ID NO: 149135 - DNA, 1503 bp, Artificial Sequence
  Description of Artificial Sequence: Synthetic coding sequence
atgagccctggcctgctgctgctgggcagcgctgtgctgctggccttcggcctgtgctgcacctttgtgcaccgggcccggagccgctatgagcacatccctggccccccccggcccagcttcctgctgggccacctgccctgcttctggaagaaggatgaggtgggcggccgggtgctgcaggatgtgttcctggactgggccaagaagtatggccctgtggtgcgggtgaatgtgttccacaagaccagcgtcatcgtgaccagccctgagagcgtgaagaagttcctgatgagcaccaagtacaacaaggacagcaagatgtaccgggccctgcagacagtgtttggagagcggctgtttggccagggcctggtgtctgagtgcaactatgagcgctggcacaagcagaggagagtgattgacctggccttcagccgcagcagcctggtgtccctgatggagaccttcaatgagaaggccgagcagctggtggagatcctggaggccaaggcagatggccagacccctgtgtccatgcaggacatgctgacctacacagccatggacatcctggccaaggccgccttcggcatggagacctccatgctgctgggcgcccagaagcccctgagccaggccgtgaagctgatgctggagggcatcacagccagcaggaacaccctggccaagttcctgcccgggaagaggaagcagctgcgggaggtgcgggagagcatccgcttcctgcggcaggtgggccgggactgggtgcagaggagaagagaggccctgaagagaggagaggaggtgcctgctgacatcctgacccagatcctgaaggccgaggagggcgcccaggatgatgagggcctgctggacaactttgtgaccttcttcatcgccggccacgagaccagcgccaaccacctggccttcaccgtgatggagctgagccggcagcctgagatcgtggcccggctgcaggccgaggtggatgaagtcatcggcagcaagcgctacctggactttgaggacctgggccgcctgcagtacctgagccaggtgctgaaggagagcctgcggctgtaccccccagcctggggcaccttccggctgctggaggaggagaccctgattgatggagtgcgggtgcccggcaacacccccctgctcttcagcacctacgtgatgggccgcatggacacctactttgaggaccccctgaccttcaacccagaccgcttcggccctggggcccccaagccccgcttcacctacttccccttcagcctgggccacaggagctgcatcggccagcagtttgcccagatggaggtgaaggtggtgatggccaagctgctgcagaggctggagttccggctggtgcccggccagcgcttcggcctgcaggagcaggccaccctgaagcccctggaccctgtgctgtgcaccctgcggccccggggctggcagcctgcccctcctcctccaccctgctag

SEQ ID NO: 149136 - DNA, 1212 bp, Artificial Sequence
  Description of Artificial Sequence: Synthetic coding sequence
atgagcaccaagtacaacaaggacagcaagatgtaccgggccctgcagacagtgtttggagagcggctgtttggccagggcctggtgtctgagtgcaactatgagcgctggcacaagcagaggagggtcatcgacctggccttcagccgcagcagcctggtgtccctgatggagaccttcaatgagaaggccgagcagctggtggagatcctggaggccaaggcagatggccagacccctgtgtccatgcaggacatgctgacctacacagccatggacatcctggccaaggccgccttcggcatggagacctccatgctgctgggcgcccagaagcccctgagccaggccgtgaagctgatgctggagggcatcacagccagcaggaacaccctggccaagttcctgcccgggaagaggaagcagctgcgggaggtgcgggagagcatccgcttcctgcggcaggtgggccgggactgggtgcagaggcggcgggaggccctgaagagaggagaggaggtgcctgctgacatcctgacccagatcctgaaggccgaggagggcgcccaggatgatgagggcctgctggacaactttgtgaccttcttcatcgccggccacgagaccagcgccaaccacctggccttcaccgtgatggagctgagccggcagcctgagatcgtggcccggctgcaggccgaggtggatgaggtgattggcagcaagcgctacctggactttgaggacctgggccgcctgcagtacctgagccaggtgctgaaggagagcctgcggctgtaccccccagcctggggcaccttccggctgctggaggaggagaccctgattgatggagtgcgggtgcccggcaacacccccctgctcttcagcacctacgtgatgggccgcatggacacctactttgaggaccccctgaccttcaacccagacagatttggacctggggcccccaagccccgcttcacctacttccccttcagcctgggccacaggagctgcatcggccagcagtttgcccagatggaggtgaaggtggtgatggccaagctgctgcagaggctggagttccggctggtgcccggccagagatttggcctgcaggagcaggccaccctgaagcccctggaccctgtgctgtgcaccctgcggccccggggctggcagcctgcccctcctcctccaccctgctag

SEQ ID NO: 149137 - DNA, 1530 bp, Artificial Sequence
  Description of Artificial Sequence: Synthetic coding sequence
atggctgctgctgctggcatgctgctgctgggcctgctgcaggccggcggctctgtgctgggccaggccatggagaaggtgactggaggcaacctgctgtccatgctgctgattgcctgtgccttcaccctgagcctggtgtacctgatccggctggccgccggccacctggtgcagctgcctgctggggtgaagagccccccctacatcttcagccccatccccttcctgggccacgccatcgccttcggcaagagccccatcgagttcctggagaatgcctatgagaagtatggccctgtgttctccttcaccatggtgggcaagaccttcacctacctgctgggcagtgatgctgctgccctgctcttcaacagcaagaatgaagacctgaatgcagaagatgtgtacagccggctgaccacccctgtgtttggaaaaggagtggcctatgatgtgcccaaccctgtgttcctggagcagaagaagatgctgaagagcggcctgaacatcgcccacttcaagcagcacgtgtccatcatcgagaaggagaccaaggagtactttgagagctggggcgagagcggggagaagaatgtgtttgaggccctgtctgagctgatcatcctgacagccagccactgcctgcacggcaaggagatccgcagccagctgaatgagaaggtggcccagctgtatgctgacctggatggcggcttcagccatgctgcctggctgctgcccggctggctgcccctgcccagcttcagaagaagagaccgggcccaccgggagatcaaggacatcttctacaaggccatccagaagaggcggcagagccaggagaagattgatgacatcctgcagaccctgctggatgccacctacaaggatggccggcccctgacagatgatgaggtggccggcatgctgattggcctgctgctggccggccagcacaccagcagcaccaccagcgcctggatgggcttcttcctggcccgggacaagaccctgcagaagaagtgctacctggagcagaagacagtgtgtggggagaacctgccccccctgacctatgaccagctgaaggacctgaacctgctggaccgctgcatcaaggagaccctgcggctgcggccccccatcatgatcatgatgaggatggcccggaccccccagacagtggccggctacaccatccccccaggccaccaggtgtgtgtgagccccaccgtgaaccagaggctgaaggacagctgggtggagcggctggacttcaacccagaccgctacctgcaggacaacccagccagcggggagaagtttgcctacgtgccctttggagctggccgccaccgctgcatcggggagaactttgcctacgtgcagatcaagaccatctggagcaccatgctgcggctgtatgaatttgacctgattgatggctacttccccaccgtgaactacaccaccatgatccacaccccagagaaccctgtgatccgctacaagaggaggagcaagtag

SEQ ID NO: 149138 - DNA, 1215 bp, Artificial Sequence
  Description of Artificial Sequence: Synthetic coding sequence
atggtgggcaagaccttcacctacctgctgggcagtgatgctgctgccctgctcttcaacagcaagaatgaagacctgaatgcagaagatgtgtacagccggctgaccacccctgtgtttgggaagggcgtggcctatgatgtgcccaaccctgtgttcctggagcagaagaagatgctgaagagcggcctgaacatcgcccacttcaagcagcacgtgtccatcatcgagaaggagaccaaggagtactttgagagctggggcgagagcggggagaagaatgtgtttgaggccctgtctgagctgatcatcctgacagccagccactgcctgcacggcaaggagatccgcagccagctgaatgagaaggtggcccagctgtatgctgacctggatggcggcttcagccacgccgcctggctgctgcccggctggctgcccctgcccagcttcagaagaagagaccgggcccaccgggagatcaaggacatcttctacaaggccatccagaagaggcggcagagccaggagaagattgatgacatcctgcagaccctgctggatgccacctacaaggatggccggcccctgacagatgatgaggtggccggcatgctgattggcctgctgctggccggccagcacaccagcagcaccaccagcgcctggatgggcttcttcctggcccgggacaagaccctgcagaagaagtgctacctggagcagaagacagtgtgtggggagaacctgccccccctgacctatgaccagctgaaggacctgaacctgctggaccgctgcatcaaggagaccctgcggctgcggccccccatcatgatcatgatgaggatggcccggaccccccagacagtggccggctacaccatccccccaggccaccaggtgtgtgtgagccccaccgtgaaccagaggctgaaggacagctgggtggagcggctggacttcaacccagaccgctacctgcaggacaacccagccagcggggagaagtttgcctacgtgccctttggagctggccgccaccgctgcattggagaaaattttgcctacgtgcagatcaagaccatctggagcaccatgctgcggctgtatgaatttgacctgattgatggctacttccccaccgtgaactacaccaccatgatccacaccccagaaaatcctgtgatccgctacaagagaagaagcaagtag

SEQ ID NO: 149139 - DNA, 1350 bp, Artificial Sequence
  Description of Artificial Sequence: Synthetic coding sequence
atgaagcatgagaagagccccccctacatcttcagccccatccccttcctgggccacgccatcgccttcggcaagagccccatcgagttcctggagaatgcctatgagaagtatggccctgtgttctccttcaccatggtgggcaagaccttcacctacctgctgggcagtgatgctgctgccctgctcttcaacagcaagaatgaagacctgaatgcagaagatgtgtacagccggctgaccacccctgtgtttggaaaaggagtggcctatgatgtgcccaaccctgtgttcctggagcagaagaagatgctgaagagcggcctgaacatcgcccacttcaagcagcacgtgtccatcatcgagaaggagaccaaggagtactttgagagctggggcgagagcggggagaagaatgtgtttgaggccctgtctgagctgatcatcctgacagccagccactgcctgcacggcaaggagatccgcagccagctgaatgagaaggtggcccagctgtatgctgacctggatggcggcttcagccatgctgcctggctgctgcccggctggctgcccctgcccagcttcagaagaagagaccgggcccaccgggagatcaaggacatcttctacaaggccatccagaagaggcggcagagccaggagaagattgatgacatcctgcagaccctgctggatgccacctacaaggatggccggcccctgacagatgatgaggtggccggcatgctgattggcctgctgctggccggccagcacaccagcagcaccaccagcgcctggatgggcttcttcctggcccgggacaagaccctgcagaagaagtgctacctggagcagaagacagtgtgtggggagaacctgccccccctgacctatgaccagctgaaggacctgaacctgctggaccgctgcatcaaggagaccctgcggctgcggccccccatcatgatcatgatgaggatggcccggaccccccagacagtggccggctacaccatccccccaggccaccaggtgtgtgtgagccccaccgtgaaccagaggctgaaggacagctgggtggagcggctggacttcaacccagaccgctacctgcaggacaacccagccagcggggagaagtttgcctacgtgccctttggagctggccgccaccgctgcatcggggagaactttgcctacgtgcagatcaagaccatctggagcaccatgctgcggctgtatgaatttgacctgattgatggctacttccccaccgtgaactacaccaccatgatccacaccccagagaaccctgtgatccgctacaagaggaggagcaagtag

SEQ ID NO: 149140 - DNA, 1515 bp, Artificial Sequence
  Description of Artificial Sequence: Synthetic coding sequence
atgatgaccaccagcctcatctggggcatcgccatcgccgcctgctgctgcctgtggctgatcctgggcatcagaagacggcagacaggagagccccccctggagaatggcctcatcccctacctgggctgtgccctgcagtttggagccaaccccctggagttcctgcgggccaaccagaggaagcacggccacgtgttcacctgcaagctgatgggcaagtatgtgcacttcatcaccaaccccctgagctaccacaaggtgctgtgccacggcaagtactttgactggaagaagttccactttgccaccagcgccaaggccttcggccacaggagcattgaccccatggatggcaacaccacagagaacatcaatgacaccttcatcaagaccctgcagggccacgccctgaacagcctgacagagagcatgatggagaacctgcagaggatcatgaggcctcctgtgagcagcaacagcaagacagctgcctgggtgacagagggcatgtacagcttctgctacagagtgatgtttgaggccggctacctgaccatcttcggccgggacctgacccggcgggacacccagaaggcccacatcctgaacaacctggacaacttcaagcagtttgacaaggtgtttcctgccctggtggccggcctgcccatccacatgttcagaacagcccacaatgcccgggagaagctggccgagagcctgcggcatgagaacctgcagaagcgggagagcatcagcgagctgatcagcctgaggatgttcctgaatgacaccctgagcacctttgatgacctggagaaggccaagacccacctggtggtgctgtgggccagccaggccaacaccatcccagccaccttctggagcctcttccagatgatcagaaatcctgaggccatgaaggccgccacagaggaggtgaagaggaccctggagaatgccggccagaaggtgtccctggagggcaaccccatctgcctgagccaggccgagctgaatgacctgcctgtgctggacagcatcatcaaggagagcctgcggctgagcagcgccagcctgaacatcagaacagccaaggaggacttcaccctgcacctggaggatggcagctacaacatcaggaaggatgacatcatcgccctgtacccccagctgatgcacctggaccctgagatctacccagaccccctgaccttcaagtatgaccgctacctggatgaaaatggcaagaccaagaccaccttctactgcaatggcctgaagctgaagtactactacatgccctttggaagtggggccaccatctgccccggccgcctgtttgccatccacgagatcaagcagttcctgatcctgatgctgagctactttgagctggagctgattgagggccaggccaagtgcccccccctggaccagagccgggccggcctgggcatcctgccccccctgaatgacatcgagttcaagtacaagttcaagcacctgtag

SEQ ID NO: 149141 - DNA, 1521 bp, Artificial Sequence
  Description of Artificial Sequence: Synthetic coding sequence
atggccggggaggtgtctgctgccaccggccgcttcagcctggagcggctgggcctgcccggcctggccctggccgccgccctgctgctgctggccctgtgcctgctggtgcggaggaccaggaggcctggagagcccccactcatcaagggctggctgccctacctgggcgtggtgctgaacctgaggaaggaccccctgcgcttcatgaagaccctgcagaagcagcacggggacaccttcaccgtgctgctgggcggcaagtacatcaccttcatcctggaccccttccagtaccagctggtgatcaagaaccacaagcagctgtccttccgggtcttcagcaacaagctgctggagaaggccttcagcatcagccagctgcagaagaaccacgacatgaatgatgagctgcacctgtgctaccagttcctgcagggcaagagcctggacatcctgctggagagcatgatgcagaacctgaagcaggtgtttgagccccagctgctgaagaccacctcctgggacacagctgagctgtaccccttctgcagcagcatcatctttgagatcaccttcaccaccatctacggcaaggtgattgtgtgtgacaacaacaagttcatcagcgagctgagagatgacttcctgaagtttgatgacaagtttgcctacctggtgagcaacatccccatcgagctgctgggcaatgtgaagagcatccgggagaagatcatcaagtgcttcagcagcgagaagctggccaagatgcagggctggagcgaggtgttccagagccggcaggatgtgctggagaagtactacgtgcatgaggacctggagatcggggcccaccacctgggcttcctgtgggcctctgtggccaacaccatccccaccatgttctgggccatgtactacctgctgcggcaccctgaggccatggctgctgtgagagatgaaattgaccggctgctgcagagcacaggccagaagaagggcagcggcttccccatccacctgacccgggagcagctggacagcctcatctgcctggagagcagcatctttgaggccctgcggctgagcagctacagcaccaccatccgctttgtggaggaggacctgaccctgagcagcgagaccggggactactgtgtgaggaaaggagacctggtggccatcttcccccctgtgctgcatggagaccctgagatctttgaggcccctgaggagttccgctatgaccgcttcattgaagatggcaagaagaagaccaccttcttcaagaggggcaagaagctgaagtgctacctgatgcccttcggcaccggcaccagcaagtgccccggccgcttctttgccctgatggagatcaagcagctgctggtgatcctgctgacctactttgacctggagatcattgatgacaagcccatcggcctgaactacagccggctgctgtttggcatccagtacccagacagtgatgtgctcttccgctacaaggtgaagagctag

SEQ ID NO: 149142 - DNA, 1506 bp, Artificial Sequence
  Description of Artificial Sequence: Synthetic coding sequence
atggtgctgtggggccctgtgctgggcgccctgctggtggtgattgctggctacctgtgcctgcccggcatgctgcggcagaggcggccctgggagccccccctggacaagggcaccgtgccctggctgggccacgccatggccttcaggaagaacatgtttgagttcctgaagaggatgaggaccaagcatggagatgtgttcaccgtgcagctgggcggccagtacttcacctttgtgatggaccccctgagctttggcagcatcctgaaggacacccagaggaagctggactttggccagtatgccaagaagctggtgctgaaggtgtttggctacagatctgtgcagggcgaccacgagatgatccacagcgccagcaccaagcacctgcggggagatggcctgaaggacctgaatgagaccatgctggacagcctgagctttgtgatgctgaccagcaagggctggagcctggatgccagctgctggcatgaggacagcctcttccgcttctgctactacatcctcttcaccgctggctacctgagcctgtttggctacaccaaggacaaggagcaggacctgctgcaggccggggagctgttcatggagttcaggaagtttgacctgctcttccccaggtttgtgtacagcctgctgtggccccgggagtggctggaggtgggccgcctgcagaggctcttccacaagatgctgtctgtgagccacagccaggagaaggagggcatcagcaactggctgggcaacatgctgcagttcctgcgggagcagggcgtgcccagcgccatgcaggacaagttcaacttcatgatgctgtgggccagccagggcaacacaggccccaccagcttctgggccctgctgtacctgctgaagcaccctgaggccatccgggctgtgcgggaggaggccacccaggtgctgggggaggcccggctggagaccaagcagagctttgccttcaagctgggcgccctgcagcacacccctgtgctggacagcgtggtggaggagaccctgcggctgcgggccgcccccaccctgctgcggctggtgcatgaggactacaccctgaagatgagcagcggccaggagtacctgttccgccacggggacatcctggccctcttcccctacctgtctgtgcacatggaccctgacatccaccctgagcccaccgtcttcaagtatgaccgcttcctgaaccccaacggcagcaggaaggtggacttcttcaagacaggcaagaagatccaccactacaccatgccctggggcagcggcgtgtccatctgccccggccgcttctttgccctgtctgaggtgaagctgttcatcctgctgatggtgacccactttgacctggagctggtggaccctgacacccccctgccccacgtggacccccagcgctggggcttcggcaccatgcagcccagccatgatgtgcgcttccgctaccgcctgcaccccacagaatag

SEQ ID NO: 149143 - DNA, 573 bp, Artificial Sequence
  Description of Artificial Sequence: Synthetic coding sequence
atggagaaggtgcctggagagatggagattgaaagaagagagaggtctgaggagctgtctgaggccgagaggaaggctgtgcaggccatgtgggcccggctgtatgccaactgtgaagatgtgggcgtggccatcctggtgcgcttctttgtgaacttccccagcgccaagcagtacttcagccagttcaagcacatggaggaccccctggagatggagaggagcccccagctgaggaagcacgcctgccgggtgatgggcgccctgaacacagtggtggagaacctgcatgaccctgacaaggtgtcctctgtgctggccctggtgggcaaggcccacgccctgaagcacaaggtggagcctgtgtacttcaagatcctgagcggggtcatcctggaggtggtggccgaggagtttgccagtgacttccccccagagacccagagggcctgggccaagctgcggggcctcatctacagccacgtgacagctgcctacaaggaggtgggctgggtgcagcaggtgcccaatgccaccaccccaccagccaccctgcccagcagcggcccctag

SEQ ID NO: 149144 - DNA, 1194 bp, Artificial Sequence
  Description of Artificial Sequence: Synthetic coding sequence
atggaggaggatgacagctatgtgcccagcgacctgacagctgaggagcggcaggagctggagaacatcagaagaaggaagcaggagctgctggccgacatccagaggctgaaggatgaaattgctgaggtggccaatgaaattgagaacctgggcagcacagaggagaggaagaacatgcagaggaacaagcaggtggccatgggcaggaagaagttcaacatggaccccaagaagggcatccagttcctgattgaaaatgacctgctgaagaacacctgtgaagatattgcccagttcctgtacaagggggagggcctgaacaagacagccatcggggactacctgggggagagagatgagttcaacatccaggtgctgcacgcctttgtggagctgcacgagttcacagacctgaacctggtgcaggccctgcggcagttcctgtggagcttccggctgcctggagaggcccagaagattgacaggatgatggaggcctttgcccagcgctactgccagtgcaacaatggagtcttccagagcacagacacctgctacgtgctgagctttgccatcatcatgctgaacaccagcctgcacaaccccaacgtgaaggacaagcccaccgtggagcgcttcatcgccatgaacagaggcatcaatgatggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggccgggtgaagacctggaagaggcgctggttcatcctgacagacaactgcctgtactactttgagtacaccacagacaaggagccccggggcatcatccccctggagaacctgagcatccgggaggtggaggacagcaagaagcccaactgctttgagctgtacatcccagacaacaaggaccaggtgatcaaggcctgcaagacagaagcagatggccgggtggtggagggcaaccacacagtgtaccgcatcagcgcccccaccccagaggagaaggaggagtggatcaagtgcatcaaggccgccatcagccgggaccccttctatgagatgctggccgccaggaagaagaaggtgagcagcaccaagaggcactag

SEQ ID NO: 149145 - DNA, 1197 bp, Artificial Sequence
  Description of Artificial Sequence: Synthetic coding sequence
atggaggaggatgacagctatgtgcccagcgacctgacagctgaggagcggcaggagctggagaacatcagaagaaggaagcaggagctgctggccgacatccagaggctgaaggatgaaattgctgaggtggccaatgaaattgagaacctgggcagcacagaggagaggaagaacatgcagaggaacaagcaggtggccatgggcaggaagaagttcaacatggaccccaagaagggcatccagttcctgattgaaaatgacctgctgaagaacacctgtgaagatattgcccagttcctgtacaagggggagggcctgaacaagacagccatcggggactacctgggggagagagatgagttcaacatccaggtgctgcacgcctttgtggagctgcacgagttcacagacctgaacctggtgcaggccctgcggcagttcctgtggagcttccggctgcctggagaggcccagaagattgacaggatgatggaggcctttgcccagcgctactgccagtgcaacaatggagtcttccagagcacagacacctgctacgtgctgagctttgccatcatcatgctgaacaccagcctgcacaaccccaacgtgaaggacaagcccaccgtggagcgcttcatcgccatgaacagaggcatcaatgatggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggcggccgggtgaagacctggaagaggcgctggttcatcctgacagacaactgcctgtactactttgagtacaccacagacaaggagccccggggcatcatccccctggagaacctgagcatccgggaggtggaggacagcaagaagcccaactgctttgagctgtacatcccagacaacaaggaccaggtgatcaaggcctgcaagacagaagcagatggccgggtggtggagggcaaccacacagtgtaccgcatcagcgcccccaccccagaggagaaggaggagtggatcaagtgcatcaaggccgccatcagccgggaccccttctatgagatgctggccgccaggaagaagaaggtgagcagcaccaagaggcactag

SEQ ID NO: 149146 - DNA, 657 bp, Artificial Sequence
  Description of Artificial Sequence: Synthetic coding sequence
atgatggaggcctttgcccagcgctactgccagtgcaacaacggggtcttccagagcacagacacctgctacgtgctgagctttgccatcatcatgctgaacaccagcctgcacaaccccaacgtgaaggacaagcccaccgtggagcgcttcatcgccatgaacagaggcatcaatgatggaggagacctgcctgaggagctgctgaggaacctgtatgagagcatcaagaatgagcccttcaagatcccagaagatgatggaaatgacctgacccacaccttcttcaacccagaccgggagggctggctgctgaagctggccggcggccgggtgaagacctggaagaggcgctggttcatcctgacagacaactgcctgtactactttgagtacaccacagacaaggagccccggggcatcatccccctggagaacctgagcatccgggaggtggaggacagcaagaagcccaactgctttgagctgtacatcccagacaacaaggaccaggtgatcaaggcctgcaagacagaagcagatggccgggtggtggagggcaaccacacagtgtaccgcatcagcgcccccaccccagaggagaaggaggagtggatcaagtgcatcaagttccaggtgtccccaggagagccctag

SEQ ID NO: 149147 - DNA, 1197 bp, Artificial Sequence; identical to SEQ ID NO: 149145
  Description of Artificial Sequence: Synthetic coding sequence

SEQ ID NO: 149148 - DNA, 1020 bp, Artificial Sequence
  Description of Artificial Sequence: Synthetic coding sequence
atgcagaggaacaagcaggtggccatgggcaggaagaagttcaacatggaccccaagaagggcatccagttcctgattgaaaatgacctgctgaagaacacctgtgaggacatcgcccagttcctgtacaagggggagggcctgaacaagacagccatcggggactacctgggggagagagatgagttcaacatccaggtgctgcacgcctttgtggagctgcacgagttcacagacctgaacctggtgcaggccctgcggcagttcctgtggagcttccggctgcccggggaggcccagaagattgacaggatgatggaggcctttgcccagcgctactgccagtgcaacaacggggtcttccagagcacagacacctgctacgtgctgagctttgccatcatcatgctgaacaccagcctgcacaaccccaacgtgaaggacaagcccaccgtggagcgcttcatcgccatgaacagaggcatcaatgatggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggcggccgggtgaagacctggaagaggcgctggttcatcctgacagacaactgcctgtactactttgagtacaccacagacaaggagccccggggcatcatccccctggagaacctgagcatccgggaggtggaggacagcaagaagcccaactgctttgagctgtacatcccagacaacaaggaccaggtgatcaaggcctgcaagacagaagcagatggccgggtggtggagggcaaccacacagtgtaccgcatcagcgcccccaccccagaggagaaggaggagtggatcaagtgcatcaaggccgccatcagccgggaccccttctatgagatgctggccgccaggaagaagaaggtgagcagcaccaagaggcactag

SEQ ID NO: 149149 - DNA, 1020 bp, Artificial Sequence; identical to SEQ ID NO: 149148
  Description of Artificial Sequence: Synthetic coding sequence

SEQ ID NO: 149150 - DNA, 1080 bp, Artificial Sequence
  Description of Artificial Sequence: Synthetic coding sequence
atgagcctgcagaggctgctgcagcacagcagcaatggaaacctggccgacttctgtgccggccctgcctacagcagctacagcaccctgaccggcagcctgaccatggatgacaacagacgcatccagatgctggccgacacagtggccaccctgccccggggcaggaagcagctggccctgaccaggagcagcagcctgagtgacttctcctggagccagaggaagctggtgacagtggagaagcaggacaatgagaccttcggctttgagatccagagctaccggccccagaaccagaatgcctgcagcagcgagatgttcaccctcatctgcaagatccaggaggacagccctgcccactgtgccggcctgcaggccggagatgtgctggccaacatcaatggagtgtccacagagggcttcacctacaagcaggtggtggacctgatccgcagcagcggcaacctgctgaccatcgagaccctgaatggcaccatgatcctgaagaggacagagctggaggccaagctgcaggtgctgaagcagaccctgaagcagaagtgggtggagtaccgcagcctgcagctgcaggagcaccggctgctgcatggagatgctgccaactgccccagcctggagaacatggacctggatgagctgagcctgtttggccccctgcccggccctggccctgccctggtggacaggaaccggctgagcagcgagagcagctgcaagtcctggctgagctccatgaccatggattctgaagatggctaccagacctgtgtgtctgaggacagcagcagaggagccttcagccggcagaccagcacagatgatgagtgcttcatccccaaggagggagatgacttcctgcggcgcagcagcagcagaagaaacagaagcatcagcaacaccagcagcggctccatgagccccctgtgggagggcaacctgagctccatgtttggcaccctgcccaggaagagcaggaagggctctgtgaggaagcagctgctgaagttcatccctggcctgcacagagctgtggaggaggaggagagccgcttctag

SEQ ID NO: 149151 - DNA, 762 bp, Artificial Sequence
  Description of Artificial Sequence: Synthetic coding sequence
atgttcaccctcatctgcaagatccaggaggacagccctgcccactgtgccggcctgcaggccggagatgtgctggccaacatcaatggagtgtccacagagggcttcacctacaagcaggtggtggacctgatccgcagcagcggcaacctgctgaccatcgagaccctgaatggcaccatgatcctgaagaggacagagctggaggccaagctgcaggtgctgaagcagaccctgaagcagaagtgggtggagtaccgcagcctgcagctgcaggagcaccggctgctgcatggagatgctgccaactgccccagcctggagaacatggacctggatgagctgagcctgtttggccccctgcccggccctggccctgccctggtggacaggaaccggctgagcagcgagagcagctgcaagtcctggctgagctccatgaccatggattctgaagatggctaccagacctgtgtgtctgaggacagcagcagaggagccttcagccggcagaccagcacagatgatgagtgcttcatccccaaggagggagatgacttcctgcggcgcagcagcagcagaagaaacagaagcatcagcaacaccagcagcggctccatgagccccctgtgggagggcaacctgagctccatgtttggcaccctgcccaggaagagcaggaagggctctgtgaggaagcagctgctgaagttcatccctggcctgcacagagctgtggaggaggaggagagccgcttctag

SEQ ID NO: 149152 - DNA, 1203 bp, Artificial Sequence
  Description of Artificial Sequence: Synthetic coding sequence
atggaggatggagtgtatgagcccccagacctgaccccagaggagaggatggagctggagaacatcagaagaaggaagcaggagctgctggtggagatccagaggctgcgggaggagctgtctgaggccatgtctgaggtggagggcctggaggccaatgaaggcagcaagaccctgcagaggaacaggaagatggccatgggcaggaagaagttcaacatggaccccaagaagggcatccagttcctggtggagaatgagctgctgcagaacaccccagaggagatcgcccgcttcctgtacaagggggagggcctgaacaagacagccatcggggactacctgggggagcgggaggagctgaacctggccgtgctgcacgcctttgtggacctgcacgagttcacagacctgaacctggtgcaggccctgcggcagttcctgtggagcttccggctgcccggggaggcccagaagattgacaggatgatggaggcctttgcccagcgctactgcctgtgcaaccctggggtcttccagagcacagacacctgctacgtgctgagctttgctgtgatcatgctgaacaccagcctgcacaaccccaacgtgcgggacaagccaggcctggagagatttgtggccatgaacagaggcatcaatgaaggaggagacctgcctgaggagctgctgaggaacctgtatgacagcatcagaaatgagcccttcaagatcccagaagatgatggaaatgacctgacccacaccttcttcaacccagaccgggagggctggctgctgaagctggccggcggccgggtgaagacctggaagaggcgctggttcatcctgacagacaactgcctgtactactttgagtacaccacagacaaggagccccggggcatcatccccctggagaacctgagcatccgggaggtggatgaccccaggaagcccaactgctttgagctgtacatccccaacaacaagggccagctgatcaaggcctgcaagacagaagcagatggccgggtggtggagggcaaccacatggtgtaccgcatcagcgcccccacccaggaggagaaggatgagtggatcaagagcatccaggccgctgtgtctgtggaccccttctatgagatgctggccgccaggaagaagaggatctctgtgaagaagaagcaggagcagccctag

SEQ ID NO: 149153 - DNA, 1200 bp, Artificial Sequence
  Description of Artificial Sequence: Synthetic coding sequence
atggaggatggagtgtatgagcccccagacctgaccccagaggagaggatggagctggagaacatcagaagaaggaagcaggagctgctggtggagatccagaggctgcgggaggagctgtctgaggccatgtctgaggtggagggcctggaggccaatgaaggcagcaagaccctgcagaggaacaggaagatggccatgggcaggaagaagttcaacatggaccccaagaagggcatccagttcctggtggagaatgagctgctgcagaacaccccagaggagatcgcccgcttcctgtacaagggggagggcctgaacaagacagccatcggggactacctgggggagcgggaggagctgaacctggccgtgctgcacgcctttgtggacctgcacgagttcacagacctgaacctggtgcaggccctgcggcagttcctgtggagcttccggctgcccggggaggcccagaagattgacaggatgatggaggcctttgcccagcgctactgcctgtgcaaccctggggtcttccagagcacagacacctgctacgtgctgagctttgctgtgatcatgctgaacaccagcctgcacaaccccaacgtgcgggacaagccaggcctggagagatttgtggccatgaacagaggcatcaatgaaggaggagacctgcctgaggagctgctgaggaacctgtatgacagcatcagaaatgagcccttcaagatcccagaagatgatggaaatgacctgacccacaccttcttcaacccagaccgggagggctggctgctgaagctgggcggccgggtgaagacctggaagaggcgctggttcatcctgacagacaactgcctgtactactttgagtacaccacagacaaggagccccggggcatcatccccctggagaacctgagcatccgggaggtggatgaccccaggaagcccaactgctttgagctgtacatccccaacaacaagggccagctgatcaaggcctgcaagacagaagcagatggccgggtggtggagggcaaccacatggtgtaccgcatcagcgcccccacccaggaggagaaggatgagtggatcaagagcatccaggccgctgtgtctgtggaccccttctatgagatgctggccgccaggaagaagaggatctctgtgaagaagaagcaggagcagccctag

SEQ ID NO: 149154 - DNA, 1200 bp, Artificial Sequence
  Description of Artificial Sequence: Synthetic coding sequence
atggatgaagatggcggcggggagggcggcggcgtgcctgaggacctgagcctggaggagcgggaggagctgctggacatcagaagaaggaagaaggagctgattgatgacatcgagcggctgaagtatgaaattgctgaggtgatgacagaaattgacaacctgacctctgtggaggagagcaagaccacccagaggaacaagcagatcgccatgggcaggaagaagttcaacatggaccccaagaagggcatccagttcctgattgaaaatgacctgctgcagagcagcccagaagatgtggcccagttcctgtacaagggggagggcctgaacaagacagtcatcggggactacctgggggagagagatgagttcaacatcaaggtgctgcaggcctttgtggagctgcacgagtttgctgacctgaacctggtgcaggccctgcggcagttcctgtggagcttccggctgcctggagaggcccagaagattgacaggatgatggaggcctttgccagccgctactgcctgtgcaaccctggggtcttccagagcacagacacctgctacgtgctgagctttgccatcatcatgctgaacaccagcctgcacaaccacaacgtgcgggacaagcccacagctgagcgcttcatcgccatgaacagaggcatcaatgaaggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggccgggtgaagacctggaagaggcgctggttcatcctgacagacaactgcctgtactactttgagtacaccacagacaaggagccccggggcatcatccccctggagaacctgagcatccgggaggtggaggaccccaggaagcccaactgctttgagctgtacaaccccagccacaagggccaggtgatcaaggcctgcaagacagaagcagatggccgggtggtggagggcaaccacgtggtgtaccgcatcagcgcccccagccctgaggagaaggaggagtggatgaagagcatcaaggccagcatcagccgggaccccttctatgacatgctggccaccaggaagagaagaattgccaacaagaagtag

SEQ ID NO: 149155 - DNA, 945 bp, Artificial Sequence
  Description of Artificial Sequence: Synthetic coding sequence
atggccctgccccagctgcagacagccatgctggccgccttcctgtgggaccccagagatgtggtgctgacagcccagcctggagctgagcagtgtgccgagagcagccagcacatccgcatcctgcagccccagttccgcctcatccggctgcgcttctggaagctgtacatccagaggagagtgcaggcctggcagttcctgtggagcttccggctgcccggggaggcccagaagattgacaggatgatggaggcctttgccagccgctactgcctgtgcaaccctggggtcttccagagcacagacacctgctacgtgctgagctttgccatcatcatgctgaacaccagcctgcacaaccacaacgtgcgggacaagcccacagctgagcgcttcatcgccatgaacagaggcatcaatgaaggaggagacctgcctgaggagctgctgaggaacctgtatgagagcatcaagaatgagcccttcaagatcccagaagatgatggaaatgacctgacccacaccttcttcaacccagaccgggagggctggctgctgaagctgggcggccgggtgaagacctggaagaggcgctggttcatcctgacagacaactgcctgtactactttgagtacaccacagacaaggagccccggggcatcatccccctggagaacctgagcatccgggaggtggaggaccccaggaagcccaactgctttgagctgtacaaccccagccacaagggccaggtgatcaaggcctgcaagacagaagcagatggccgggtggtggagggcaaccacgtggtgtaccgcatcagcgcccccagccctgaggagaaggaggagtggatgaagagcatcaaggccagcatcagccgggaccccttctatgacatgctggccaccaggaagaggcgcatcgccaacaagaagtag

SEQ ID NO: 149156 - DNA, 1185 bp, Artificial Sequence
  Description of Artificial Sequence: Synthetic coding sequence
atggacctgtgccaccctgagcctgctgagctgagcagtggagaaacagaggagctgcagaggatcaagtggcacaggaagcagctgctggaggacatccagaagctgaaggatgaaattgctgatgtgtttgcccagattgactgctttgagagcgctgaggagagcaggatggcccagaaggagaaggagctgtgcattggaaggaagaagttcaacatggaccctgccaagggcatccagtacttcatcgagcacaagctgctgaccccagatgtgcaggacatcgcccgcttcctgtacaagggggagggcctgaacaagacagccatcggcacctacctgggggagcgggaccccatcaacctgcaggtgctgcaggcctttgtggactgccatgaatttgccaacctgaacctggtgcaggccctgcggcagttcctgtggagcttccggctgcccggggaggcccagaagattgacaggatgatggaggcctttgccacccgctactgcctgtgcaaccctggggtcttccagagcacagacacctgctacgtgctgtccttcagcatcatcatgctgaacaccagcctgcacaaccccaacgtgcgggaccggcccccatttgaaagatttgtgtccatgaacagaggcatcaacaacggcagtgacctgcctgaggaccagctgaggaacctgtttgacagcatcaagtctgagcccttcagcatcccagaagatgatggaaatgacctgacccacaccttcttcaacccagaccgggagggctggctgctgaagctgggcggccgggtgaagacctggaagaggcgctggttcatcctgacagacaactgcctgtactactttgagttcaccacagacaaggagccccggggcatcatccccctggagaacctgtctgtgcagaaggtggatgaccccaagaagcccttctgcctggagctgtacaaccccagctgccggggccagaagatcaaggcctgcaagacagatggagatggccgggtggtggagggcaagcatgagagctaccgcatcagcgccaccagcgctgaggagcgggaccagtggattgagagcatccgggccagcatcaccagggtgcccttctatgacctggtgtccaccaggaagaagaagatcgccagcaagcagtag

SEQ ID NO: 149157 - DNA, 474 bp, Artificial Sequence
  Description of Artificial Sequence: Synthetic coding sequence
atggacctgtgccaccctgagcctgctgagctgagcagtggagaaacagaggagctgcagaggatcaagtggcacaggaagcagctgctggaggacatccagaagctgaaggatgaaattgctgatgtgtttgcccagattgactgctttgagagcgctgaggagagcaggatggcccagaaggagaaggagctgtgcattggaaggaagaagttcaacatggaccctgccaagggcatccagtacttcatcgagcacaagctgctgaccccagatgtgcaggacatcgcccgcttcctgtacaagggggagggcctgaacaagacagccatcggcacctacctgggggagcgggaccccatcaacctgcaggtgctgcaggcctttgtggactgccatgaatttgccaacctgaacctggtgcaggccctgcgcttccgggagggcgccagtgacctgggctttggaggatag

SEQ ID NO: 149158 - DNA, 876 bp, Artificial Sequence
  Description of Artificial Sequence: Synthetic coding sequence
gacaggagcacaggccacctgttcccccggggcgtgggcatggacctgtgccaccctgagcctgctgagctgagcagcggggagacagaggagctgcagaggatcaagtggcacaggaagcagctgctggaggacatccagaagctgaaggatgaaattgctgatgtgtttgcccagattgactgctttgaatctgctgaggagagcaggatggcccagaaggagaaggagctgtgcatcggcaggaagaagttcaacatggaccctgccaagggcatccagtacttcatcgagcacaagctgctgaccccagatgtgcaggacatcgcccgcttcctgtacaagggggagggcctgaacaagacagccatcggcacctacctgggggagcgggaccccatcaacctgcaggtgctgcaggcctttgtggactgccacgagtttgccaacctgaacctggtgcaggccctgcggcagttcctgtggagcttccggctgcctggagaggcccagaagattgacaggatgatggaggcctttgccacccgctactgcctgtgcaaccctggggtcttccagagcacagacacctgctacgtgctgtccttcagcatcatcatgctgaacaccagcctgcacaaccccaacgtgcgggaccggcccccatttgaaagatttgtgtccatgaacagaggcatcaacaatggaagtgacctgcctgaggaccagctgcgggtgacctgggagtgcagccagaggaggagccgggagaggaccttccagaaggaggaggtggccaggacagaggcctgcccagactgggagcggcggggcgtgcagtgtggccgggagcccctgcggcagcaccaggagtag

SEQ ID NO: 149159 - DNA, 444 bp, Artificial Sequence
  Description of Artificial Sequence: Synthetic coding sequence
tgaacccacaccagcggcagcctgagcagccgggacagccaggccggggacagcgccagccgggccggcggccgggtgaagacctggaagaggcgctggttcatcctgacagacaactgcctgtactactttgagttcaccacagacaaggagccccggggcatcatccccctggagaacctgtctgtgcagaaggtggatgaccccaagaagcccttctgcctggagctgtacaaccccagctgccggggccagaagatcaaggcctgcaagacagatggagatggccgggtggtggagggcaagcatgagagctaccgcatcagcgccaccagcgctgaggagcgggaccagtggattgagagcatccgggccagcatcaccagggtgcccttctatgacctggtgtccaccaggaagaagaagatcgccagcaagcagtag

SEQ ID NO: 149160 - DNA, 354 bp, Artificial Sequence
  Description of Artificial Sequence: Synthetic coding sequence
atggacctgtgccaccctgagcctgctgagctgagcagtggagaaacagaggagctgcagaggatcaagtggcacaggaagcagctgctggaggacatccagaagctgaaggatgaaattgctgatgtgtttgcccagattgactgctttgagagcgctgaggagagcaggatggcccagaaggagaaggagctgtgcattggaaggaagaagttcaacatggaccctgccaagggcatccagtacttcatcgagcacaagctgctgaccccagatgtgcaggacatcgcccgcttcctgtacaagggggagggcctgaacaagacagccatcggcacctacctgggggagtag

SEQ ID NO: 149161 - DNA, 777 bp, Artificial Sequence
  Description of Artificial Sequence: Synthetic coding sequence
atggtgctgtgtgtgcagggcccccggcccctgctggccgtggagaggacaggccagaggcccctgtgggcccccagcctggagctgcccaagcctgtgatgcagcccctgcctgctggggccttcctggaggaggtggccgagggcaccccagcccagacagagagcgagcccaaggtgctggaccctgaggaggacctgctgtgcatcgccaagaccttctcctacctgcgggagagcggctggtactggggcagcatcacagccagcgaggcccggcagcacctgcagaagatgcctgagggcaccttcctggtgcgggacagcacccaccccagctacctgttcaccctgtctgtgaagaccacccggggccccaccaacgtgagaattgaatatgctgacagcagcttccggctggacagcaactgcctgagccggccccgcatcctggccttcccagatgtggtgtccctggtgcagcactacgtggccagctgcacagctgacaccaggagtgacagcccagaccctgcccccaccccagccctgcccatgcccaaggaggatgcccccagcgaccctgccctgcctgcccctcctccagccacagctgtgcacctgaagctggtgcagccctttgtgcggcgcagcagcgcccggagcctgcagcacctgtgccgcctggtgatcaaccggctggtggctgatgtggactgcctgcccctgcccaggaggatggctgactacctgcggcagtaccccttccagctgtag

SEQ ID NO: 149162 - DNA, 828 bp, Artificial Sequence
  Description of Artificial Sequence: Synthetic coding sequence
atgtacctggagcacaccagccactgcccccaccatgatgatgacacagccatggacacccccctgccccggccccggcccctgctggccgtggagaggacaggccagaggcccctgtgggcccccagcctggagctgcccaagcctgtgatgcagcccctgcctgctggggccttcctggaggaggtggccgagggcaccccagcccagacagaaagtgagcccaaggtgctggaccctgaggaggacctgctgtgcatcgccaagaccttctcctacctgcgggagagcggctggtactggggcagcatcacagccagcgaggcccggcagcacctgcagaagatgcctgagggcaccttcctggtgcgggacagcacccaccccagctacctgttcaccctgtctgtgaagaccacccggggccccaccaacgtgcgcatcgagtatgctgacagcagcttccggctggacagcaactgcctgagccggccccgcatcctggccttcccagatgtggtgtccctggtgcagcactacgtggccagctgcacagctgacaccaggagtgacagcccagaccctgcccccaccccagccctgcccatgcccaaggaggatgcccccagcgaccctgccctgcctgcccctcctccagccacagctgtgcacctgaagctggtgcagccctttgtgagaagaagcagcgcccggagcctgcagcacctgtgccgcctggtgatcaaccggctggtggctgatgtggactgcctgcccctgcccaggaggatggctgactacctgcggcagtaccccttccagctgtag

SEQ ID NO: 149163 - DNA, 1269 bp, Artificial Sequence
  Description of Artificial Sequence: Synthetic coding sequence
atgcctgctggaagaagaggccctgctgcccagagcgcccggcggcccccacccctgctgcccctgctgctgctgctgtgtgtgctgggcgccccccgggccggcagcggggcccacacagctgtgatcagcccccaggaccccaccctgctgattggcagcagcctgctggccacctgcagcgtgcatggagaccccccaggggccacagctgagggcctgtactggaccctgaatggaagaaggctgcccccagagctgagccgggtgctgaatgccagcaccctggccctggccctggccaacctgaatggcagccggcagaggtctggggacaacctggtgtgccacgccagagatggcagcatcctggccggcagctgcctgtatgtgggcctgcccccagagaagcctgtgaacatcagctgctggagcaagaacatgaaggacctgacctgccgctggacccctggggcccacggggagaccttcctgcacaccaactacagcctgaagtacaagctgcgctggtacggccaggacaacacctgtgaggagtaccacacagtgggcccccacagctgccacatccccaaggacctggccctcttcaccccctatgagatctgggtggaggccaccaaccggctgggcagcgcccggagtgatgtgctgaccctggacatcctggatgtggtgaccacagatcctcctccagatgtgcacgtgtcccgggtgggcggcctggaggaccagctgtctgtgcgctgggtgagccccccagccctgaaggacttcctgttccaggccaagtaccagatccgctacagagtggaggacagcgtggactggaaggtggtggatgatgtgagcaaccagaccagctgccgcctggccggcctgaagccaggcaccgtgtactttgtgcaggtgcgctgcaaccccttcggcatctacggcagcaagaaggccggcatctggagcgagtggagccaccccacagctgccagcacccccaggtctgagcggcccggccctgggggcggggcctgtgagccccggggcggggagcccagcagcggccctgtgcggcgggagctgaagcagttcctgggctggctgaagaagcacgcctactgcagcaacctgtccttccggctgtatgaccagtggagggcctggatgcagaagagccacaagaccaggaaccaggatgagggcatcctgcccagcggcagaagaggaacagcccggggccctgccaggtag

SEQ ID NO: 149164 - DNA, 702 bp, Artificial Sequence
  Description of Artificial Sequence: Synthetic coding sequence
atgggccgcctggtgctgctgtggggcgctgctgtgttcctgctgggcggctggatggccctgggccagggcggcgctgctgagggcgtgcagatccagatcatctacttcaacctggagaccgtgcaggtgacctggaatgccagcaagtacagcaggaccaacctgaccttccactaccgcttcaatggagatgaggcctatgaccagtgcaccaactacctgctgcaggagggccacaccagcggctgcctgctggatgctgagcagagagatgacatcctgtacttcagcatcagaaatggcacccaccctgtgttcaccgccagccgctggatggtgtactacctgaagcccagcagccccaagcacgtgcgcttctcctggcaccaggatgctgtgacagtgacctgcagcgacctgtcctatggagacctgctgtatgaggtgcagtaccgcagcccctttgacacagagtggcagacccagagccgctctgtgacccaggccggcgtgcagtggtgtgacctgtgcctgctgcagcccagccccccacgcttcaagcgcttcagctgcctgagcctgcccagctcctgggactaccgccaccccccaccccggctggccaacttctgcatcatcagcagagatggagtgagcccctgctggccaggctggagcaggacctgtgacctgaggtag

SEQ ID NO: 149165 - DNA, 771 bp, Artificial Sequence
  Description of Artificial Sequence: Synthetic coding sequence
atgggccgcctggtgctgctgtggggcgctgctgtgttcctgctgggcggctggatggccctgggccagggcggcgctgctgagggcgtgcagatccagatcatctacttcaacctggagaccgtgcaggtgacctggaatgccagcaagtacagcaggaccaacctgaccttccactaccgcttcaatggagatgaggcctatgaccagtgcaccaactacctgctgcaggagggccacaccagcggctgcctgctggatgctgagcagagagatgacatcctgtacttcagcatcagaaatggcacccaccctgtgttcaccgccagccgctggatggtgtactacctgaagcccagcagccccaagcacgtgcgcttctcctggcaccaggatgctgtgacagtgacctgcagcgacctgtcctatggagacctgctgtatgaggtgcagtaccgcagcccctttgacacagagtggcagagcaagcaggagaacacctgcaatgtgaccatcgagggcctggatgctgagaagtgctacagcttctgggtgcgggtgaaggccatggaggatgtgtatggccctgacacctaccccagcgactggagcgaggtgacctgctggcagagaggagagatcagagatgcctgtgccgagacccccaccccacccaagcccaagctgagcaagttcatcctgatcagcagcctggccatcctgctgatggtgtccctgctgctgctgagcctgtggaagctgtggaggtag

SEQ ID NO: 149166 - DNA, 768 bp, Artificial Sequence
  Description of Artificial Sequence: Synthetic coding sequence
atgggccgcctggtgctgctgtggggcgctgctgtgttcctgctgggcggctggatggccctgggccagggcggcgctgctgagggcgtgcagatccagatcatctacttcaacctggagaccgtgcaggtgacctggaatgccagcaagtacagcaggaccaacctgaccttccactaccgcttcaatggagatgaggcctatgaccagtgcaccaactacctgctgcaggagggccacaccagcggctgcctgctggatgctgagcagagagatgacatcctgtacttcagcatcagaaatggcacccaccctgtgttcaccgccagccgctggatggtgtactacctgaagcccagcagccccaagcacgtgcgcttctcctggcaccaggatgctgtgacagtgacctgcagcgacctgtcctatggagacctgctgtatgaggtgcagtaccgcagcccctttgacacagagtggcagagcaagcaggagaacacctgcaatgtgaccatcgagggcctggatgctgagaagtgctacagcttctgggtgcgggtgaaggccatggaggatgtgtatggccctgacacctaccccagcgactggagcgaggtgacctgctggcagagaggagagatcagagatgcctgtgccgagacccccaccccacccaagcccaagctgagcaagttcatcctgatcagcagcctggccatcctgctgatggtgtccctgctgctgctgagcctgtggaagctgtggtag

SEQ ID NO: 149167 - DNA, 411 bp, Artificial Sequence
  Description of Artificial Sequence: Synthetic coding sequence
atgaggaccccaggccccctgcctgtgctgctgctgctgctggccggggccccagctgcccggcccaccccacccacctgctacagcaggatgagggccctgagccaggagatcacccgggacttcaacctgctgcaggtgtctgagcccagcgagccctgtgtgcgctacctgccccggctgtacctggacatccacaactactgtgtgctggacaagctgcgggactttgtggccagccccccctgctggaaggtggcccaggtggacagcctgaaggacaaggccaggaagctgtacaccatcatgaacagcttctgccggcgggacctggtgttcctgctggatgactgcaatgccctggagtaccccatccctgtgaccaccgtgctgcctgaccggcagaggtag

SEQ ID NO: 149168 - DNA, 3762 bp, Artificial Sequence
  Description of Artificial Sequence: Synthetic coding sequence
atggccgcccaggtgaccctggaggatgccctgagcaatgtggacctgctggaggagctgcccctgcctgaccagcagccctgcatcgagcccccacccagcagcctgctgtaccagcccaacttcaacaccaactttgaagatagaaatgcctttgtgacaggcatcgcccgctacatcgagcaggccaccgtgcacagctccatgaatgagatgctggaggagggccaggagtatgctgtgatgctgtacacctggaggagctgcagccgggccatcccccaggtgaagtgcaatgagcagcccaacagagtggagatctatgagaagacagtggaggtgctggagcctgaggtgaccaagctgatgaacttcatgtacttccagagaaatgccatcgagcgcttctgtggggaggtgcggcggctgtgccacgccgagaggaggaaggactttgtgtctgaggcctacctgatcaccctgggcaagttcatcaacatgtttgctgtgctggatgagctgaagaacatgaagtgcagcgtgaagaatgaccacagcgcctacaagagagctgcccagttcctgaggaagatggctgacccccagagcatccaggagagccagaacctgtccatgttcctggccaaccacaacaagatcacccagagcctgcagcagcagctggaggtgatcagcggctatgaggagctgctggccgacatcgtgaacctgtgtgtggactactatgagaacaggatgtacctgacccccagcgagaagcacatgctgctgaaggtgatgggcttcggcctgtacctgatggatggctctgtgagcaacatctacaagctggatgccaagaagaggatcaacctgagcaagattgacaagtacttcaagcagctgcaggtggtgcccctgtttggagacatgcagatcgagctggcccgctacatcaagaccagcgcccactatgaggagaacaagagccgctggacctgcaccagcagcggcagcagcccccagtacaacatctgtgagcagatgatccagatccgggaggaccacatgaggttcatcagcgagctggcccgctacagcaacagcgaggtggtgactggaagtggccggcaggaggcccagaagacagatgctgagtacaggaagctgtttgacctggccctgcagggcctgcagctgctgagccagtggagcgcccacgtgatggaggtgtacagctggaagctggtgcaccccacagacaagtacagcaacaaggactgcccagattctgctgaggagtatgagcgggccacccgctacaactacaccagcgaggagaagtttgccctggtggaggtgattgccatgatcaagggcctgcaggtgctgatgggccgcatggagagcgtcttcaaccacgccatccgccacacagtgtatgctgccctgcaggacttcagccaggtgaccctgcgggagcccctgcggcaggccatcaagaagaagaagaatgtcatccagagcgtgctgcaggccatcaggaagacagtgtgtgactgggagactggacatgagcccttcaatgaccctgccctgcggggggagaaggaccccaagagcggctttgacatcaaggtgcccaggagagctgtgggccccagcagcacccagctgtacatggtgaggaccatgctggagagcctgattgctgacaagagcggcagcaagaagaccctgcggagcagcctggagggccccaccatcctggacatcgagaagttccaccgggagagcttcttctacacccacctgatcaacttcagcgagaccctgcagcagtgctgtgacctgagccagctgtggttccgggagttcttcctggagctgaccatgggccgccgcatccagttccccatcgagatgtccatgccctggatcctgacagaccacatcctggagaccaaggaggcctccatgatggagtatgtgctgtacagcctggacctgtacaatgacagcgcccactacgccctgacccgcttcaacaagcagttcctgtatgatgaaattgaagctgaggtgaacctgtgctttgaccagtttgtgtacaagctggccgaccagatctttgcctactacaaggtgatggccggcagcctgctgctggacaagaggctgcggtctgagtgcaagaaccagggcgccaccatccacctgccccccagcaacagatatgagaccctgctgaagcagagacatgtgcagctgctgggccgcagcattgacctgaacagactcatcacccagagggtgtctgctgccatgtacaagagcctggagctggccatcggccgctttgaaagtgaggacctgaccagcatcgtggagctggatggcctgctggagatcaacaggatgacccacaagctgctgagccgctacctgaccctggatggctttgatgccatgttccgggaggccaaccacaacgtgtctgccccctacggccgcatcaccctgcacgtgttctgggagctgaactatgacttcctgcccaactactgctacaacggcagcaccaacagatttgtgaggacagtgctgcccttcagccaggagttccagagggacaagcagcccaatgcccagccccagtacctgcacggcagcaaggccctgaacctggcctacagcagcatctacggcagctacagaaactttgtgggccccccccacttccaggtgatctgccgcctgctgggctaccagggcattgctgtggtgatggaggagctgctgaaggtggtgaagagcctgctgcagggcaccatcctgcagtatgtgaagaccctgatggaggtgatgcccaagatctgccgcctgcccaggcatgaatatggcagccctggcatcctggagttcttccaccaccagctgaaggacatcgtggagtatgcagagctgaagacagtgtgcttccagaacctgcgggaggtgggcaatgccatcctcttctgcctgctgattgagcagagcctgagcctggaggaggtgtgtgacctgctgcatgctgcccccttccagaacatcctgccccgggtgcacgtgaaggagggggagcggctggatgccaagatgaagaggctggagagcaaatatgcccccctgcacctggtgcccctgattgagcggctgggcaccccccagcagatcgccatcgcccgggagggggacctgctgaccaaggagcggctgtgctgcggcctgtccatgtttgaagtcatcctgacccgcatccgctccttcctggatgaccccatctggaggggccccctgcccagcaatggagtgatgcacgtggatgaatgtgtggagttccaccggctgtggagcgccatgcagtttgtgtactgcatccctgtgggcacccatgagttcaccgtggagcagtgctttggagatggcctgcactgggccggctgcatgatcatcgtgctgctgggccagcagaggagatttgctgtgctggacttctgctaccacctgctgaaggtgcagaagcatgatggcaaggatgagatcatcaagaatgtgcccctgaagaagatggtggagcgcatcaggaagttccagatcctgaatgatgagatcatcaccatcctggacaagtacctgaagtctggagatggagagggcacccctgtggagcacgtgcgctgcttccagccccccatccaccagagcctggccagcagctag

SEQ ID NO: 149169 - DNA, 3768 bp, Artificial Sequence
  Description of Artificial Sequence: Synthetic coding sequence
atgggccccaagcacgtgctgcggcagcccggccccagcgagcggcaccaccctgaggtgcctgcctggacccccagggctggccccccctgctggctgtgccggcagcgctggggctggaccctgcaccccccaggccggggctgcccagccctgctgctgtctgagcccaggatggccgcccaggtgaccctggaggatgccctgagcaatgtggacctgctggaggagctgcccctgcctgaccagcagccctgcatcgagcccccacccagcagcctgctgtaccagaatgagatgctggaggagggccaggagtatgctgtgatgctgtacacctggaggagctgcagccgggccatcccccaggtgaagtgcaatgagcagcccaacagagtggagatctatgagaagacagtggaggtgctggagcctgaggtgaccaagctgatgaacttcatgtacttccagagaaatgccatcgagcgcttctgtggggaggtgcggcggctgtgccacgccgagaggaggaaggactttgtgtctgaggcctacctgatcaccctgggcaagttcatcaacatgtttgctgtgctggatgagctgaagaacatgaagtgcagcgtgaagaatgaccacagcgcctacaagagagctgcccagttcctgaggaagatggctgacccccagagcatccaggagagccagaacctgtccatgttcctggccaaccacaacaagatcacccagagcctgcagcagcagctggaggtgatcagcggctatgaggagctgctggccgacatcgtgaacctgtgtgtggactactatgagaacaggatgtacctgacccccagcgagaagcacatgctgctgaaggtgatgggcttcggcctgtacctgatggatggctctgtgagcaacatctacaagctggatgccaagaagaggatcaacctgagcaagattgacaagtacttcaagcagctgcaggtggtgcccctgtttggagacatgcagatcgagctggcccgctacatcaagaccagcgcccactatgaggagaacaagagccgctggacctgcaccagcagcggcagcagcccccagtacaacatctgtgagcagatgatccagatccgggaggaccacatgaggttcatcagcgagctggcccgctacagcaacagcgaggtggtgactggaagtggccggcaggaggcccagaagacagatgctgagtacaggaagctgtttgacctggccctgcagggcctgcagctgctgagccagtggagcgcccacgtgatggaggtgtacagctggaagctggtgcaccccacagacaagtacagcaacaaggactgcccagattctgctgaggagtatgagcgggccacccgctacaactacaccagcgaggagaagtttgccctggtggaggtgattgccatgatcaagggcctgcaggtgctgatgggccgcatggagagcgtcttcaaccacgccatccgccacacagtgtatgctgccctgcaggacttcagccaggtgaccctgcgggagcccctgcggcaggccatcaagaagaagaagaatgtcatccagagcgtgctgcaggccatcaggaagacagtgtgtgactgggagactggacatgagcccttcaatgaccctgccctgcggggggagaaggaccccaagagcggctttgacatcaaggtgcccaggagagctgtgggccccagcagcacccagctgtacatggtgaggaccatgctggagagcctgattgctgacaagagcggcagcaagaagaccctgcggagcagcctggagggccccaccatcctggacatcgagaagttccaccgggagagcttcttctacacccacctgatcaacttcagcgagaccctgcagcagtgctgtgacctgagccagctgtggttccgggagttcttcctggagctgaccatgggccgccgcatccagttccccatcgagatgtccatgccctggatcctgacagaccacatcctggagaccaaggaggcctccatgatggagtatgtgctgtacagcctggacctgtacaatgacagcgcccactacgccctgacccgcttcaacaagcagttcctgtatgatgaaattgaagctgaggtgaacctgtgctttgaccagtttgtgtacaagctggccgaccagatctttgcctactacaaggtgatggccggcagcctgctgctggacaagaggctgcggtctgagtgcaagaaccagggcgccaccatccacctgccccccagcaacagatatgagaccctgctgaagcagagacatgtgcagctgctgggccgcagcattgacctgaacagactcatcacccagagggtgtctgctgccatgtacaagagcctggagctggccatcggccgctttgaaagtgaggacctgaccagcatcgtggagctggatggcctgctggagatcaacaggatgacccacaagctgctgagccgctacctgaccctggatggctttgatgccatgttccgggaggccaaccacaacgtgtctgccccctacggccgcatcaccctgcacgtgttctgggagctgaactatgacttcctgcccaactactgctacaacggcagcaccaacagatttgtgaggacagtgctgcccttcagccaggagttccagagggacaagcagcccaatgcccagccccagtacctgcacggcagcaaggccctgaacctggcctacagcagcatctacggcagctacagaaactttgtgggccccccccacttccaggtgatctgccgcctgctgggctaccagggcattgctgtggtgatggaggagctgctgaaggtggtgaagagcctgctgcagggcaccatcctgcagtatgtgaagaccctgatggaggtgatgcccaagatctgccgcctgcccaggcatgaatatggcagccctggcatcctggagttcttccaccaccagctgaaggacatcgtggagtatgcagagctgaagacagtgtgcttccagaacctgcatgctgcccccttccagaacatcctgccccgggtgcacgtgaaggagggggagcggctggatgccaagatgaagaggctggagagcaaatatgcccccctgcacctggtgcccctgattgagcggctgggcaccccccagcagatcgccatcgcccgggagggggacctgctgaccaaggagcggctgtgctgcggcctgtccatgtttgaagtcatcctgacccgcatccgctccttcctggatgaccccatctggaggggccccctgcccagcaatggagtgatgcacgtggatgaatgtgtggagttccaccggctgtggagcgccatgcagtttgtgtactgcatccctgtgggcacccatgagttcaccgtggagcagtgctttggagatggcctgcactgggccggctgcatgatcatcgtgctgctgggccagcagaggagatttgctgtgctggacttctgctaccacctgctgaaggtgcagaagcatgatggcaaggatgagatcatcaagaatgtgcccctgaagaagatggtggagcgcatcaggaagttccagatcctgaatgatgagatcatcaccatcctggacaagtacctgaagtctggagatggagagggcacccctgtggagcacgtgcgctgcttccagccccccatccaccagagcctggccagcagctag

SEQ ID NO: 149170 - DNA, 2469 bp, Artificial Sequence
  Description of Artificial Sequence: Synthetic coding sequence
atggccgagagcctgggcagcgctgagctgctgcggcagctgaagagcctgggcatggagcggctgctgcatgctgtgaacaccttcctgcggcagagctgcacctacctgcccctgctgaccttcggcggcaagaccagctttgtgtccctggatgtgtatggaacagaggccaactgcagcgccaccagctgcagcttccccaaggctgctgccacctggccccggcggcaggcccctggccccctgggggagctggtgcggggccccccagaccagggcgtggccgagcagagcttcagccacggcctgtttgaatttggcatcaccaacgtgccctgcatcttcagccccccccagatgttcccctggatcatccagctgtacatggtgaggaccatgctggagagcctgattgctgacaagagcggcagcaagaagaccctgcggagcagcctggagggccccaccatcctggacatcgagaagttccaccgggagagcttcttctacacccacctgatcaacttcagcgagaccctgcagcagtgctgtgacctgagccagctgtggttccgggagttcttcctggagctgaccatgggccgccgcatccagttccccatcgagatgtccatgccctggatcctgacagaccacatcctggagaccaaggaggcctccatgatggagtatgtgctgtacagcctggacctgtacaatgattctgcccactacgccctgacccgcttcaacaagcagttcctgtatgatgaaattgaggccgaggtgaacctgtgctttgaccagtttgtgtacaagctggccgaccagatctttgcctactacaaggtgatggccggcagcctgctgctggacaagaggctgcggtctgagtgcaagaaccagggcgccaccatccacctgccccccagcaacagatatgagaccctgctgaagcagagacatgtgcagctgctgggccgcagcattgacctgaacagactcatcacccagagggtgtctgctgccatgtacaagagcctggagctggccatcggccgctttgaaagtgaggacctgaccagcatcgtggagctggatggcctgctggagatcaacaggatgacccacaagctgctgagccgctacctgaccctggatggctttgatgccatgttccgggaggccaaccacaacgtgtctgccccctacggccgcatcaccctgcacgtgttctgggagctgaactatgacttcctgcccaactactgctacaacggcagcaccaacagatttgtgaggacagtgctgcccttcagccaggagttccagagggacaagcagcccaatgcccagccccagtacctgcacggcagcaaggccctgaacctggcctacagcagcatctacggcagctacagaaactttgtgggccccccccacttccaggtgatctgccgcctgctgggctaccagggcattgctgtggtgatggaggagctgctgaaggtggtgaagagcctgctgcagggcaccatcctgcagtatgtgaagaccctgatggaggtgatgcccaagatctgccgcctgcccaggcatgaatatggcagccctggcatcctggagttcttccaccaccagctgaaggacatcgtggagtatgcagagctgaagacagtgtgcttccagaacctgcgggaggtgggcaatgccatcctcttctgcctgctgattgagcagagcctgagcctggaggaggtgtgtgacctgctgcacgccgcccccttccagaacatcctgccccgggtgcacgtgaaggagggggagcggctggatgccaagatgaagaggctggagagcaaatatgcccccctgcacctggtgcccctcatcgagcggctgggcaccccccagcagatcgccatcgcccgggagggggacctgctgaccaaggagcggctgtgctgcggcctgtccatgtttgaggtgatcctgacccgcatccgctccttcctggatgaccccatctggaggggccccctgcccagcaatggagtgatgcacgtggatgaatgtgtggagttccaccggctgtggagcgccatgcagtttgtgtactgcatccctgtgggcacccatgagttcaccgtggagcagtgctttggagatggcctgcactgggccggctgcatgatcatcgtgctgctgggccagcagaggagatttgctgtgctggacttctgctaccacctgctgaaggtgcagaagcatgatggcaaggatgagatcatcaagaatgtgcccctgaagaagatggtggagcgcatcaggaagttccagatcctgaatgatgagatcatcaccatcctggacaagtacctgaagtctggagatggagagggcacccctgtggagcacgtgcgctgcttccagccccccatccaccagagcctggccagcagctag

SEQ ID NO: 149171 - DNA, 3762 bp, Artificial Sequence; identical to SEQ ID NO: 149168
  Description of Artificial Sequence: Synthetic coding sequence

SEQ ID NO: 149172 - DNA, 486 bp, Artificial Sequence
  Description of Artificial Sequence: Synthetic coding sequence
atggccgcccaggtgaccctggaggatgccctgagcaatgtggacctgctggaggagctgcccctgcctgaccagcagccctgcatcgagcccccacccagcagcctgctgtaccagcccaacttcaacaccaactttgaagatagaaatgcctttgtgacaggcatcgcccgctacatcgagcaggccaccgtgcacagctccatgaatgagatgctggaggagggccaggagtatgctgtgatgctgtacacctggaggagctgcagccgggccatcccccaggtgaagtgcaatgagcagcccaacagagtggagatctatgagaagacagtggaggtgctggagcctgaggtgaccaagctgatgaacttcatgtacttccagagaaatgccatcgagcgcttctgtggggaggtgcggcggctgtgccacgccgagaggaggaaggactttgtgtctgaggcctacctgatcaccctgtag

SEQ ID NO: 149173 - DNA, 456 bp, Artificial Sequence
  Description of Artificial Sequence: Synthetic coding sequence
atggccgcccaggtgaccctggaggatgccctgagcaatgtggacctgctggaggagctgcccctgcctgaccagcagccctgcatcgagcccccacccagcagcctgctgtaccagcccaacttcaacaccaactttgaagatagaaatgcctttgtgacaggcatcgcccgctacatcgagcaggccaccgtgcacagctccatgaatgagatgctggaggagggccaggagtatgctgtgatgctgtacacctggaggagctgcagccgggccatcccccaggtgaagtgcaatgagcagcccaacagagtggagatctatgagaagacagtggaggtgctggagcctgaggtgaccaagctgatgaacttcatgtacttccagagaaatgccatcgagcgcttctgtggggaggtgcggcggctgtgccacgccgagaggaggaaggactag

SEQ ID NO: 149174 - DNA, 3837 bp, Artificial Sequence
  Description of Artificial Sequence: Synthetic coding sequence
atgaccacccacgtgaccctggaggatgccctgagcaatgtggacctgctggaggagctgcccctgcctgaccagcagccctgcatcgagcccccacccagcagcatcatgtaccaggccaactttgacaccaactttgaagatagaaatgcctttgtgacaggcatcgcccgctacatcgagcaggccaccgtgcacagctccatgaatgagatgctggaggagggccatgaatatgctgtgatgctgtacacctggaggagctgcagccgggccatcccccgggtgaagtgcaatgagcagcccaacagagtggagatctatgagaagacagtggaggtgctggagcctgaggtgaccaagctgatgaagttcatgtacttccagaggaaggccatcgagcgcttctgcagcgaggtgaagaggctgtgccacgccgagaggaggaaggactttgtgtctgaggcctacctgctgaccctgggcaagttcatcaacatgtttgctgtgctggatgagctgaagaacatgaagtgcagcgtgaagaatgaccacagcgcctacaagagagctgcccagttcctgaggaagatggctgacccccagagcatccaggagagccagaacctgtccatgttcctggccaaccacaaccgcatcacccagtgcctgcaccagcagctggaggtgattcctggctatgaggagctgctggccgacatcgtgaacatctgtgtggactactatgagaacaagatgtacctgacccccagcgagaagcacatgctgctgaaggtgatgggcttcggcctgtacctgatggatggaaatgtgagcaacatctacaagctggatgccaagaagaggatcaacctgagcaagattgacaagttcttcaagcagctgcaggtggtgcccctgtttggagacatgcagatcgagctggcccgctacatcaagaccagcgcccactatgaggagaacaagagcaagtggacctgcacccagagcagcatcagcccccagtacaacatctgtgagcagatggtgcagatcagagatgaccacatccgcttcatcagcgagctggcccgctacagcaacagcgaggtggtgactggaagtggcctggacagccagaagagtgatgaggagtaccgggagctgtttgacctggccctgcggggcctgcagctgctgagcaagtggagcgcccacgtgatggaggtgtacagctggaagctggtgcaccccacagacaagttctgcaacaaggactgccccggcacagctgaggagtatgaaagagccacccgctacaactacaccagcgaggagaagtttgcctttgtggaggtgattgccatgatcaagggcctgcaggtgctgatgggccgcatggagagcgtcttcaaccaggccatccggaacaccatctatgctgccctgcaggactttgcccaggtgaccctgcgggagcccctgcggcaggccgtgaggaagaagaagaatgtgctgatctctgtgctgcaggccatcaggaagaccatctgtgactgggagggcggccgggagcccccaaatgacccctgcctgcggggggagaaggaccccaagggcggctttgacatcaaggtgccccggcgggctgtgggccccagcagcacccaggcctgccagtggagcccccgggccctcttccaccccaccggcggcacccagggccggcggggctgccgcagcctgctgtacatggtgaggaccatgctggagagcctgattgctgacaagagcggcagcaagaagaccctgcggagcagcctggatggccccatcgtgctggccatcgaggacttccacaagcagagcttcttcttcacccacctgctgaacatcagcgaggccctgcagcagtgctgtgacctgagccagctgtggttccgggagttcttcctggagctgaccatgggccgccgcatccagttccccatcgagatgtccatgccctggatcctgacagaccacatcctggagaccaaggagcccagcatgatggagtatgtgctgtaccccctggacctgtacaatgacagcgcctactatgccctgaccaagttcaagaagcagttcctgtatgatgaaattgaagctgaggtgaacctgtgctttgaccagtttgtgtacaagctggccgaccagatctttgcctactacaaggccatggccggctctgtgctgctggacaagcgcttccgggcagagtgcaagaactacggcgtcatcatcccctacccacccagcaacagatatgagaccctgctgaagcagagacatgtgcagctgctgggccgcagcattgacctgaacagactcatcacccagaggatctctgctgccatgtacaagagcctggaccaggccatcagcagatttgaaagtgaggacctgaccagcatcgtggagctggagtggctgctggagatcaaccggctgacccaccggctgctgtgcaagcacatgaccctggacagctttgatgccatgttccgggaggccaaccacaacgtgtctgccccctacggccgcatcaccctgcacgtgttctgggagctgaactttgacttcctgcccaactactgctacaacggcagcaccaacagatttgtgaggacagccatccccttcacccaggagccccagagggacaagccagccaacgtgcagccctactacctgtatggcagcaagcccctgaacatcgcctacagccacatctacagcagctacagaaactttgtgggccccccccacttcaagaccatctgccgcctgctgggctaccagggcattgctgtggtgatggaggagctgctgaagatcgtgaagagcctgctgcagggcaccatcctgcagtatgtgaagaccctgattgaggtgatgcccaagatctgccgcctgcccaggcatgaatatggcagccctggcatcctggagttcttccaccaccagctgaaggacatcatcgagtatgcagagctgaagacagatgtgttccagagcctgcgggaggtgggcaatgccatcctcttctgcctgctgattgagcaggccctgagccaggaggaggtgtgtgacctgctgcatgctgcccccttccagaacatcctgccccgggtgtacatcaaggagggggagcggctggaggtgaggatgaagaggctggaggccaagtatgcccccctgcacctggtgcccctgattgagcggctgggcaccccccagcagatcgccatcgcccgggagggggacctgctgaccaaggagcggctgtgctgcggcctgtccatgtttgaagtcatcctgacccgcatccgcagctacctgcaggaccccatctggaggggccccccacccaccaacggggtgatgcacgtggatgaatgtgtggagttccaccggctgtggagcgccatgcagtttgtgtactgcatccctgtgggcaccaatgagttcaccgctgagcagtgctttggagatggcctgaactgggccggctgcagcatcatcgtgctgctgggccagcagaggagatttgacctgtttgacttctgctaccacctgctgaaggtgcagaggcaggacggcaaggatgagatcatcaagaatgtgcccctgaagaagatggctgaccgcatcaggaagtaccagatcctgaacaatgaggtgtttgccatcctgaacaagtacatgaagtctgtggagacagacagcagcacagtggagcacgtgcgctgcttccagccccccatccaccagagcctggccaccacctgctag

SEQ ID NO: 149175 - DNA, 3762 bp, Artificial Sequence
  Description of Artificial Sequence: Synthetic coding sequence
atgaccacccacgtgaccctggaggatgccctgagcaatgtggacctgctggaggagctgcccctgcctgaccagcagccctgcatcgagcccccacccagcagcatcatgtaccaggccaactttgacaccaactttgaagatagaaatgcctttgtgacaggcatcgcccgctacatcgagcaggccaccgtgcacagctccatgaatgagatgctggaggagggccatgaatatgctgtgatgctgtacacctggaggagctgcagccgggccatccccaaggtgaagtgcaatgagcagcccaacagagtggagatctatgagaagacagtggaggtgctggagcctgaggtgaccaagctgatgaagttcatgtacttccagaggaaggccatcgagcgcttctgcagcgaggtgaagaggctgtgccacgccgagaggaggaaggactttgtgtctgaggcctacctgctgaccctgggcaagttcatcaacatgtttgctgtgctggatgagctgaagaacatgaagtgcagcgtgaagaatgaccacagcgcctacaagagagctgcccagttcctgaggaagatggctgacccccagagcatccaggagagccagaacctgtccatgttcctggccaaccacaaccgcatcacccagtgcctgcaccagcagctggaggtgattcctggctatgaggagctgctggccgacatcgtgaacatctgtgtggactactatgagaacaagatgtacctgacccccagcgagaagcacatgctgctgaaggtgatgggcttcggcctgtacctgatggatggaaatgtgagcaacatctacaagctggatgccaagaagaggatcaacctgagcaagattgacaagttcttcaagcagctgcaggtggtgcccctgtttggagacatgcagatcgagctggcccgctacatcaagaccagcgcccactatgaggagaacaagagcaagtggacctgcacccagagcagcatcagcccccagtacaacatctgtgagcagatggtgcagatcagagatgaccacatccgcttcatcagcgagctggcccgctacagcaacagcgaggtggtgactggaagtggcctggacagccagaagagtgatgaggagtaccgggagctgtttgacctggccctgcggggcctgcagctgctgagcaagtggagcgcccacgtgatggaggtgtacagctggaagctggtgcaccccacagacaagttctgcaacaaggactgccccggcacagctgaggagtatgaaagagccacccgctacaactacaccagcgaggagaagtttgcctttgtggaggtgattgccatgatcaagggcctgcaggtgctgatgggccgcatggagagcgtcttcaaccaggccatccggaacaccatctatgctgccctgcaggactttgcccaggtgaccctgcgggagcccctgcggcaggccgtgaggaagaagaagaatgtgctgatctctgtgctgcaggccatcaggaagaccatctgtgactgggagggcggccgggagcccccaaatgacccctgcctgcggggggagaaggaccccaagggcggctttgacatcaaggtgccccggcgggctgtgggccccagcagcacccagctgtacatggtgaggaccatgctggagagcctgattgctgacaagagcggcagcaagaagaccctgcggagcagcctggatggccccatcgtgctggccatcgaggacttccacaagcagagcttcttcttcacccacctgctgaacatcagcgaggccctgcagcagtgctgtgacctgagccagctgtggttccgggagttcttcctggagctgaccatgggccgccgcatccagttccccatcgagatgtccatgccctggatcctgacagaccacatcctggagaccaaggagcccagcatgatggagtatgtgctgtaccccctggacctgtacaatgattctgcctactatgccctgaccaagttcaagaagcagttcctgtatgatgaaattgaggccgaggtgaacctgtgctttgaccagtttgtgtacaagctggccgaccagatctttgcctactacaaggccatggccggctctgtgctgctggacaagcgcttccgggcagagtgcaagaactatggagtcatcatcccctacccacccagcaacagatatgagaccctgctgaagcagagacatgtgcagctgctgggccgcagcattgacctgaacagactcatcacccagaggatctctgctgccatgtacaagagcctggaccaggccatcagcagatttgaaagtgaggacctgaccagcatcgtggagctggagtggctgctggagatcaaccggctgacccaccggctgctgtgcaagcacatgaccctggacagctttgatgccatgttccgggaggccaaccacaacgtgtctgccccctacggccgcatcaccctgcacgtgttctgggagctgaactttgacttcctgcccaactactgctacaacggcagcaccaacagatttgtgaggacagccatccccttcacccaggagccccagagggacaagccagccaacgtgcagccctactacctgtatggcagcaagcccctgaacatcgcctacagccacatctacagcagctacagaaactttgtgggccccccccacttcaagaccatctgccgcctgctgggctaccagggcattgctgtggtgatggaggagctgctgaagatcgtgaagagcctgctgcagggcaccatcctgcagtatgtgaagaccctcatcgaggtgatgcccaagatctgccgcctgcccaggcatgaatatggcagccctggcatcctggagttcttccaccaccagctgaaggacatcattgaatatgcagagctgaagacagatgtgttccagagcctgcgggaggtgggcaatgccatcctcttctgcctgctgattgagcaggccctgagccaggaggaggtgtgtgacctgctgcacgccgcccccttccagaacatcctgccccgggtgtacatcaaggagggggagcggctggaggtgaggatgaagaggctggaggccaagtatgcccccctgcacctggtgcccctcatcgagcggctgggcaccccccagcagatcgccatcgcccgggagggggacctgctgaccaaggagcggctgtgctgcggcctgtccatgtttgaggtgatcctgacccgcatccgcagctacctgcaggaccccatctggaggggccccccacccaccaatggagtgatgcacgtggatgaatgtgtggagttccaccggctgtggagcgccatgcagtttgtgtactgcatccctgtgggcaccaatgagttcaccgctgagcagtgctttggagatggcctgaactgggccggctgcagcatcatcgtgctgctgggccagcagaggagatttgacctgtttgacttctgctaccacctgctgaaggtgcagaggcaggacggcaaggatgagatcatcaagaatgtgcccctgaagaagatggctgaccgcatcaggaagtaccagatcctgaacaatgaggtgtttgccatcctgaacaagtacatgaagtctgtggagacagacagcagcacagtggagcacgtgcgctgcttccagccccccatccaccagagcctggccaccacctgctag

SEQ ID NO: 149176 - DNA, 3762 bp, Artificial Sequence; identical to SEQ ID NO: 149175
  Description of Artificial Sequence: Synthetic coding sequence

SEQ ID NO: 149177 - DNA, 2859 bp, Artificial Sequence
  Description of Artificial Sequence: Synthetic coding sequence
gagaagagaagacgctggacctgcacccagagcagcatcagcccccagtacaacatctgtgagcagatggtgcagatcagagatgaccacatccgcttcatcagcgagctggcccgctacagcaacagcgaggtggtgactggaagtggcctggacagccagaagagtgatgaggagtaccgggagctgtttgacctggccctgcggggcctgcagctgctgagcaagtggagcgcccacgtgatggaggtgtacagctggaagctggtgcaccccacagacaagttctgcaacaaggactgccccggcacagctgaggagtatgaaagagccacccgctacaactacaccagcgaggagaagtttgcctttgtggaggtgattgccatgatcaagggcctgcaggtgctgatgggccgcatggagagcgtcttcaaccaggccatccggaacaccatctatgctgccctgcaggactttgcccaggtgaccctgcgggagcccctgcggcaggccgtgaggaagaagaagaatgtgctgatctctgtgctgcaggccatcaggaagaccatctgtgactgggagggcggccgggagcccccaaatgacccctgcctgcggggggagaaggaccccaagggcggctttgacatcaaggtgccccggcgggctgtgggccccagcagcacccaggcctgccagtggagcccccgggccctcttccaccccaccggcggcacccagggccggcggggctgccgcagcctgctgtacatggtgaggaccatgctggagagcctgattgctgacaagagcggcagcaagaagaccctgcggagcagcctggatggccccatcgtgctggccatcgaggacttccacaagcagagcttcttcttcacccacctgctgaacatcagcgaggccctgcagcagtgctgtgacctgagccagctgtggttccgggagttcttcctggagctgaccatgggccgccgcatccagttccccatcgagatgtccatgccctggatcctgacagaccacatcctggagaccaaggagcccagcatgatggagtatgtgctgtaccccctggacctgtacaatgacagcgcctactatgccctgaccaagttcaagaagcagttcctgtatgatgaaattgaagctgaggtgaacctgtgctttgaccagtttgtgtacaagctggccgaccagatctttgcctactacaaggccatggccggctctgtgctgctggacaagcgcttccgggcagagtgcaagaactacggcgtcatcatcccctacccacccagcaacagatatgagaccctgctgaagcagagacatgtgcagctgctgggccgcagcattgacctgaacagactcatcacccagaggatctctgctgccatgtacaagagcctggaccaggccatcagcagatttgaaagtgaggacctgaccagcatcgtggagctggagtggctgctggagatcaaccggctgacccaccggctgctgtgcaagcacatgaccctggacagctttgatgccatgttccgggaggccaaccacaacgtgtctgccccctacggccgcatcaccctgcacgtgttctgggagctgaactttgacttcctgcccaactactgctacaacggcagcaccaacagatttgtgaggacagccatccccttcacccaggagccccagagggacaagccagccaacgtgcagccctactacctgtatggcagcaagcccctgaacatcgcctacagccacatctacagcagctacagaaactttgtgggccccccccacttcaagaccatctgccgcctgctgggctaccagggcattgctgtggtgatggaggagctgctgaagatcgtgaagagcctgctgcagggcaccatcctgcagtatgtgaagaccctgattgaggtgatgcccaagatctgccgcctgcccaggcatgaatatggcagccctggcatcctggagttcttccaccaccagctgaaggacatcatcgagtatgcagagctgaagacagatgtgttccagagcctgcgggaggtgggcaatgccatcctcttctgcctgctgattgagcaggccctgagccaggaggaggtgtgtgacctgctgcatgctgcccccttccagaacatcctgccccgggtgtacatcaaggagggggagcggctggaggtgaggatgaagaggctggaggccaagtatgcccccctgcacctggtgcccctgattgagcggctgggcaccccccagcagatcgccatcgcccgggagggggacctgctgaccaaggagcggctgtgctgcggcctgtccatgtttgaagtcatcctgacccgcatccgcagctacctgcaggaccccatctggaggggccccccacccaccaacggggtgatgcacgtggatgaatgtgtggagttccaccggctgtggagcgccatgcagtttgtgtactgcatccctgtgggcaccaatgagttcaccgctgagcagtgctttggagatggcctgaactgggccggctgcagcatcatcgtgctgctgggccagcagaggagatttgacctgtttgacttctgctaccacctgctgaaggtgcagaggcaggacggcaaggatgagatcatcaagaatgtgcccctgaagaagatggctgaccgcatcaggaagtaccagatcctgaacaatgaggtgtttgccatcctgaacaagtacatgaagtctgtggagacagacagcagcacagtggagcacgtgcgctgcttccagccccccatccaccagagcctggccaccacctgctag

SEQ ID NO: 149178 - DNA, 651 bp, Artificial Sequence
  Description of Artificial Sequence: Synthetic coding sequence
atggccggctctgtgctgctggacaagcgcttccgggcagagtgcaagaactacggcgtcatcatcccctacccacccagcaacagatatgagaccctgctgaagcagagacatgtgcagctgctgggccgcagcattgacctgaacagactcatcacccagaggatctctgctgccatgtacaagagcctggaccaggccatcagcagatttgaaagtgaggacctgaccagcatcgtggagctggagtggctgctggagatcaaccggctgacccaccggctgctgtgcaagcacatgaccctggacagctttgatgccatgttccgggaggccaaccacaacgtgtctgccccctacggccgcatcaccctgcacgtgttctgggagctgaactttgacttcctgcccaactactgctacaacggcagcaccaacagatttgtgaggacagccagcttccaccccaggaccaccacccggcagacctgccagaggcctgccctgctgcccctgtggatccaggccagccagcactgcctgcagccccacctgcagctgctgcaggagttccggggggccaccagcttccaggactatgctgacagctgggtgatccgggccagcctgtggagctggaggaactgctag

SEQ ID NO: 149179 - DNA, 3537 bp, Artificial Sequence
  Description of Artificial Sequence: Synthetic coding sequence
atgaccacccacgtgaccctggaggatgccctgagcaatgtggacctgctggaggagctgcccctgcccaatgagcagcccaacagagtggagatctatgagaagacagtggaggtgctggagcctgaggtgaccaagctgatgaagttcatgtacttccagaggaaggccatcgagcgcttctgcagcgaggtgaagaggctgtgccacgccgagaggaggaaggactttgtgtctgaggcctacctgctgaccctgggcaagttcatcaacatgtttgctgtgctggatgagctgaagaacatgaagtgcagcgtgaagaatgaccacagcgcctacaagagagctgcccagttcctgaggaagatggctgacccccagagcatccaggagagccagaacctgtccatgttcctggccaaccacaaccgcatcacccagtgcctgcaccagcagctggaggtgattcctggctatgaggagctgctggccgacatcgtgaacatctgtgtggactactatgagaacaagatgtacctgaccccatctgagaagcacatgctgctgaaggtgatgggcttcggcctgtacctgatggatggaaatgtgagcaacatctacaagctggatgccaagaagaggatcaacctgagcaagattgacaagttcttcaagcagctgcaggtggtgcccctgtttggagacatgcagatcgagctggcccgctacatcaagaccagcgcccactatgaggagaacaagagcaagtggacctgcacccagagcagcatcagcccccagtacaacatctgtgagcagatggtgcagatcagagatgaccacatccgcttcatcagcgagctggcccgctacagcaacagcgaggtggtgacaggcagcggcctggacagccagaagagtgatgaggagtaccgggagctgtttgacctggccctgcggggcctgcagctgctgagcaagtggagcgcccacgtgatggaggtgtacagctggaagctggtgcaccccacagacaagttctgcaacaaggactgccctggaacagctgaggagtatgagcgggccacccgctacaactacaccagcgaggagaagtttgcctttgtggaggtgattgccatgatcaagggcctgcaggtgctgatgggccgcatggagagcgtcttcaaccaggccatccggaacaccatctatgctgccctgcaggactttgcccaggtgaccctgcgggagcccctgcggcaggccgtgaggaagaagaagaatgtgctgatctctgtgctgcaggccatcaggaagaccatctgtgactgggagggcggccgggagcccccaaatgacccctgcctgcggggggagaaggaccccaagggcggctttgacatcaaggtgcccaggagagctgtgggccccagcagcacccagctgtacatggtgaggaccatgctggagagcctgattgctgacaagagcggcagcaagaagaccctgcggagcagcctggatggccccatcgtgctggccatcgaggacttccacaagcagagcttcttcttcacccacctgctgaacatcagcgaggccctgcagcagtgctgtgacctgagccagctgtggttccgggagttcttcctggagctgaccatgggccgccgcatccagttccccatcgagatgtccatgccctggatcctgacagaccacatcctggagaccaaggagcccagcatgatggagtatgtgctgtaccccctggacctgtacaatgacagcgcctactatgccctgaccaagttcaagaagcagttcctgtatgatgaaattgaagctgaggtgaacctgtgctttgaccagtttgtgtacaagctggccgaccagatctttgcctactacaaggccatggccggctctgtgctgctggacaagcgcttccgggcagagtgcaagaactacggcgtcatcatcccctacccacccagcaacagatatgagaccctgctgaagcagagacatgtgcagctgctgggccgcagcattgacctgaacagactcatcacccagaggatctctgctgccatgtacaagagcctggaccaggccatcagcagatttgaaagtgaggacctgaccagcatcgtggagctggagtggctgctggagatcaaccggctgacccaccggctgctgtgcaagcacatgaccctggacagctttgatgccatgttccgggaggccaaccacaacgtgtctgccccctacggccgcatcaccctgcacgtgttctgggagctgaactttgacttcctgcccaactactgctacaacggcagcaccaacagatttgtgaggacagccatccccttcacccaggagccccagagggacaagccagccaacgtgcagccctactacctgtatggcagcaagcccctgaacatcgcctacagccacatctacagcagctacagaaactttgtgggccccccccacttcaagaccatctgccgcctgctgggctaccagggcattgctgtggtgatggaggagctgctgaagatcgtgaagagcctgctgcagggcaccatcctgcagtatgtgaagaccctgattgaggtgatgcccaagatctgccgcctgcccaggcatgaatatggcagccctggcatcctggagttcttccaccaccagctgaaggacatcatcgagtatgcagagctgaagacagatgtgttccagagcctgcgggaggtgggcaatgccatcctcttctgcctgctgattgagcaggccctgagccaggaggaggtgtgtgacctgctgcatgctgcccccttccagaacatcctgccccgggtgtacatcaaggagggggagcggctggaggtgaggatgaagaggctggaggccaagtatgcccccctgcacctggtgcccctgattgagcggctgggcaccccccagcagatcgccatcgcccgggagggggacctgctgaccaaggagcggctgtgctgcggcctgtccatgtttgaagtcatcctgacccgcatccgcagctacctgcaggaccccatctggaggggccccccacccaccaacggggtgatgcacgtggatgaatgtgtggagttccaccggctgtggagcgccatgcagtttgtgtactgcatccctgtgggcaccaatgagttcaccgctgagcagtgctttggagatggcctgaactgggccggctgcagcatcatcgtgctgctgggccagcagaggagatttgacctgtttgacttctgctaccacctgctgaaggtgcagaggcaggacggcaaggatgagatcatcaagaatgtgcccctgaagaagatggctgaccgcatcaggaagtaccagatcctgaacaatgaggtgtttgccatcctgaacaagtacatgaagtctgtggagacagacagcagcacagtggagcacgtgcgctgcttccagccccccatccaccagagcctggccaccacctgctag

SEQ ID NO: 149180 - DNA, 4617 bp, Artificial Sequence
  Description of Artificial Sequence: Synthetic coding sequence
atggagcccaggatggagagctgcctggcccaggtgctgcagaaggatgtgggcaagaggctgcaggtgggccaggagctgattgactacttcagtgacaagcagaagtctgctgacctggagcatgaccagaccatgctggacaagctggtggatggcctggccacctcctgggtgaacagcagcaactacaaggtggtgctgctgggcatggacatcctgagcgccctggtgacccggctgcaggaccgcttcaaggcccagattggaacagtgctgcccagcctgattgaccggctgggagatgccaaggacagcgtgcgggagcaggaccagaccctgctgctgaagatcatggaccaggccgccaacccccagtatgtgtgggacaggatgctgggcggcttcaagcacaagaacttccgcacccgggagggcatctgcctgtgcctgattgccaccctgaatgccagcggggcccagaccctgaccctgagcaagatcgtgccccacatctgcaacctgctgggggaccccaacagccaggtgagagatgctgccatcaacagcctggtggagatctacagacatgtgggggagcgggtgcgggctgacctgagcaagaagggcctgccccagagccggctgaatgtcatcttcaccaagtttgatgaggtgcagaagagcggcaacatgatccagagcgccaatgacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctgggccgcatccgcacccggcggcagagcagcggcagcgccaccaacgtggccagcaccccagacaacagaggccgcagccgggccaaggtggtgtcccagagccagaggagccgcagcgccaacccagctggggccggcagccgcagcagcagccctgggaagctgctgggcagcggctatggaggcctgactggaggcagcagccggggcccccctgtgacccccagcagcgagaagaggagcaagatccccaggagccagggctgcagccgggagaccagccccaacagaattggcctggcccggagcagccgcatcccccggcccagcatgagccagggctgcagccgggacaccagccgggagagcagccgggacaccagccctgcccggggcttcccccccctggaccgcttcggcctgggccagcccggccgcatccctggctctgtgaatgccatgagggtgctgagcaccagcacagacctggaggccgctgtggctgatgccctgaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagagggtcttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccatggaggcctgagccccagccggctgtggggctggagcgcagatggcctggccaagcaccccccacccttcagccagcccaacagcatccccacagcccccagccacaaggccctgcggcgcagctacagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaagggggccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagagaattgccaaggagagcctgctgcagctgctggtggacatcatccctggcctgctgcagggctatgacaacacagagagctctgtgaggaaggccagcgtcttctgcctggtggccatctacagcgtgattggagaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149181 - DNA, 4437 bp, Artificial Sequence
  Description of Artificial Sequence: Synthetic coding sequence
atggagcccaggatggagagctgcctggcccaggtgctgcagaaggatgtgggcaagaggctgcaggtgggccaggagctgattgactacttcagtgacaagcagaagtctgctgacctggagcatgaccagaccatgctggacaagctggtggatggcctggccacctcctgggtgaacagcagcaactacaaggtggtgctgctgggcatggacatcctgagcgccctggtgacccggctgcaggaccgcttcaaggcccagattggaacagtgctgcccagcctgattgaccggctgggagatgccaaggacagcgtgcgggagcaggaccagaccctgctgctgaagatcatggaccaggccgccaacccccagtatgtgtgggacaggatgctgggcggcttcaagcacaagaacttccgcacccgggagggcatctgcctgtgcctgattgccaccctgaatgccagcggggcccagaccctgaccctgagcaagatcgtgccccacatctgcaacctgctgggggaccccaacagccaggtgagagatgctgccatcaacagcctggtggagatctacagacatgtgggggagcgggtgcgggctgacctgagcaagaagggcctgccccagagccggctgaatgtcatcttcaccaagtttgatgaggtgcagaagagcggcaacatgatccagagcgccaatgacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctggatggcaccaccaccaaggccgagggccgcatccgcacccggcggcagagcagcggcagcgccaccaacgtggccagcaccccagacaacagaggccgcagccgggccaaggtggtgtcccagagccagaggagccgcagcgccaacccagctggggccggcagccgcagcagcagccctgggaagctgctgggcagcggctatggaggcctgactggaggcagcagccggggcccccctgtgacccccagcagcgagaagaggagcaagatccccaggagccagggctgcagccgggagaccagccccaacagaattggcctggaccgcttcggcctgggccagcccggccgcatccctggctctgtgaatgccatgagggtgctgagcaccagcacagacctggaggccgctgtggctgatgccctgctgctgggggacagccgcagcaagaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaaggtgttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccacggcggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaagggggccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagagaattgccaaggagagcctgctgcagctgctggtggacatcatccctggcctgctgcagggctatgacaacacagagagctctgtgaggaaggccagcgtcttctgcctggtggccatctacagcgtgattggagaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149182 - DNA, 4416 bp, Artificial Sequence
  Description of Artificial Sequence: Synthetic coding sequence
atggagcccaggatggagagctgcctggcccaggtgctgcagaaggatgtgggcaagaggctgcaggtgggccaggagctgattgactacttcagtgacaagcagaagtctgctgacctggagcatgaccagaccatgctggacaagctggtggatggcctggccacctcctgggtgaacagcagcaactacaaggtggtgctgctgggcatggacatcctgagcgccctggtgacccggctgcaggaccgcttcaaggcccagattggaacagtgctgcccagcctgattgaccggctgggagatgccaaggacagcgtgcgggagcaggaccagaccctgctgctgaagatcatggaccaggccgccaacccccagtatgtgtgggacaggatgctgggcggcttcaagcacaagaacttccgcacccgggagggcatctgcctgtgcctgattgccaccctgaatgccagcggggcccagaccctgaccctgagcaagatcgtgccccacatctgcaacctgctgggggaccccaacagccaggtgagagatgctgccatcaacagcctggtggagatctacagacatgtgggggagcgggtgcgggctgacctgagcaagaagggcctgccccagagccggctgaatgtcatcttcaccaagtttgatgaggtgcagaagagcggcaacatgatccagagcgccaatgacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctgggccgcatccgcacccggcggcagagcagcggcagcgccaccaacgtggccagcaccccagacaacagaggccgcagccgggccaaggtggtgtcccagagccagaggagccgcagcgccaacccagctggggccggcagccgcagcagcagccctgggaagctgctgggcagcggctatggaggcctgactggaggcagcagccggggcccccctgtgacccccagcagcgagaagaggagcaagatccccaggagccagggctgcagccgggagaccagccccaacagaattggcctggaccgcttcggcctgggccagcccggccgcatccctggctctgtgaatgccatgagggtgctgagcaccagcacagacctggaggccgctgtggctgatgccctgctgctgggggacagccgcagcaagaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagctggtgttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccatggaggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaaaggagccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagcgcatcgccaaggagagcctgctgcagctgctggtggacatcatccctggcctgctgcagggctatgacaacacagagagctctgtgaggaaggcctctgtgttctgcctggtggccatctacagcgtcatcggggaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149183 - DNA, 2115 bp, Artificial Sequence
  Description of Artificial Sequence: Synthetic coding sequence
tgaaccaagtttgatgaggtgcagaagagcggcaacatgatccagagcgccaatgacaagaactttgatgatgaagattctgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccacggggctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggccagaattgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctgggccgcatccgcacccggcggcagagcagcggcagcgccaccaacgtggccagcaccccagacaacagaggccgcagccgggccaaggtggtgtcccagagccagaggagccgcagcgccaacccagctggagctggcagccgcagcagcagccctgggaagctgctgggcagcggctacggcggcctgaccggcggcagcagccggggcccccctgtgacccccagcagcgagaagaggagcaagatccccaggagccagggctgcagccgggagaccagccccaaccgcatcggcctggacagatttggcctgggccagcccggccgcatccctggctctgtgaatgccatgagggtgctgagcaccagcacagacctggaggccgctgtggctgatgccctgctgctgggggacagccgcagcaagaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagattgctgacagcgaggctgaatgtgaggacaaggagggcaacctcttccccagcgaggtgtcctgcaccgtgtccttccagtatgtgtttggagacagctgtggcttctacaacaacagctag

SEQ ID NO: 149184 - DNA, 4485 bp, Artificial Sequence
  Description of Artificial Sequence: Synthetic coding sequence
atggagcccaggatggagagctgcctggcccaggtgctgcagaaggatgtgggcaagaggctgcaggtgggccaggagctgattgactacttcagtgacaagcagaagtctgctgacctggagcatgaccagaccatgctggacaagctggtggatggcctggccacctcctgggtgaacagcagcaactacaaggtggtgctgctgggcatggacatcctgagcgccctggtgacccggctgcaggaccgcttcaaggcccagattggaacagtgctgcccagcctgattgaccggctgggagatgccaaggacagcgtgcgggagcaggaccagaccctgctgctgaagatcatggaccaggccgccaacccccagtatgtgtgggacaggatgctgggcggcttcaagcacaagaacttccgcacccgggagggcatctgcctgtgcctgattgccaccctgaatgccagcggggcccagaccctgaccctgagcaagatcgtgccccacatctgcaacctgctgggggaccccaacagccaggtgagagatgctgccatcaacagcctggtggagatctacagacatgtgggggagcgggtgcgggctgacctgagcaagaagggcctgccccagagccggctgaatgtcatcttcaccaagtttgatgaggtgcagaagagcggcaacatgatccagagcgccaatgacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctgggccgcatccgcacccggcggcagagcagcggcagcgccaccaacgtggccagcaccccagacaacagaggccgcagccgggccaaggtggtgtcccagagccagaggagccgcagcgccaacccagctggggccggcagccgcagcagcagccctgggaagctgctgggcagcggctatggaggcctgactggaggcagcagccggggcccccctgtgacccccagcagcgagaagaggagcaagatccccaggagccagggctgcagccgggagaccagccccaacagaattggcctggaccgcttcggcctgggccagcccggccgcatccctggctctgtgaatgccatgagggtgctgagcaccagcacagacctggaggccgctgtggctgatgccctggtgcggggcaccagcacaggcaagaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagattgctgacagcgaggccgagtgtgaggacaaggagggcaacctcttccccagcgaggtgtcctgcaccagggtcttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccacggcggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaagggggccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagagaattgccaaggagagcctgctgcagctgctggtggacatcatccctggcctgctgcagggctatgacaacacagagagctctgtgaggaaggccagcgtcttctgcctggtggccatctacagcgtgattggagaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149185 - DNA, 4434 bp, Artificial Sequence
  Description of Artificial Sequence: Synthetic coding sequence
atggagcccaggatggagagctgcctggcccaggtgctgcagaaggatgtgggcaagaggctgcaggtgggccaggagctgattgactacttcagtgacaagcagaagtctgctgacctggagcatgaccagaccatgctggacaagctggtggatggcctggccacctcctgggtgaacagcagcaactacaaggtggtgctgctgggcatggacatcctgagcgccctggtgacccggctgcaggaccgcttcaaggcccagattggaacagtgctgcccagcctgattgaccggctgggagatgccaaggacagcgtgcgggagcaggaccagaccctgctgctgaagatcatggaccaggccgccaacccccagtatgtgtgggacaggatgctgggcggcttcaagcacaagaacttccgcacccgggagggcatctgcctgtgcctgattgccaccctgaatgccagcggggcccagaccctgaccctgagcaagatcgtgccccacatctgcaacctgctgggggaccccaacagccaggtgagagatgctgccatcaacagcctggtggagatctacagacatgtgggggagcgggtgcgggctgacctgagcaagaagggcctgccccagagccggctgaatgtcatcttcaccaagtttgatgaggtgcagaagagcggcaacatgatccagagcgccaatgacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctggagagccgccacatgagggaggacatggagtacatcggcctggacagcggccgcatccgcacccggcggcagagcagcggcagcgccaccaacgtggccagcaccccagacaacagaggccgcagccgggccaaggtggtgtcccagagccagcccggcagccgcagcagcagccctgggaagctgctgggcagcggctacggcggcctgaccggcggcagcagccggggcccccctgtgacccccagcagcgagaagaggagcaagatccccaggagccagggctgcagccgggagaccagccccaaccgcatcggcctggacagatttggcctgggccagcccggccgcatccctggctctgtgaatgccatgagggtgctgagcaccagcacagacctggaggccgctgtggctgatgccctgctgctgggggacagccgcagcaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagagggtcttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccatggaggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaaaggagccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagcgcatcgccaaggagagcctgctgcagctgctggtggacatcatccctggcctgctgcagggctatgacaacacagagagctctgtgaggaaggcctctgtgttctgcctggtggccatctacagcgtcatcggggaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149186 - DNA, 3768 bp, Artificial Sequence
  Description of Artificial Sequence: Synthetic coding sequence
atgctgcagaactgcagcgacaagaactttgatgatgaagattctgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccacggggctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggccagaattgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctgggccgcatccgcacccggcggcagagcagcggcagcgccaccaacgtggccagcaccccagacaacagaggccgcagccgggccaaggtggtgtcccagagccagaggagccgcagcgccaacccagctggagctggcagccgcagcagcagccctgggaagctgctgggcagcggctacggcggcctgaccggcggcagcagccggggcccccctgtgacccccagcagcgagaagaggagcaagatccccaggagccagggctgcagccgggagaccagccccaaccgcatcggcctggacagatttggcctgggccagcccggccgcatccctggctctgtgaatgccatgagggtgctgagcaccagcacagacctggaggccgctgtggctgatgccctgaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaagattgctgacagcgaggctgaatgtgaggacaaggagggcaacctcttccccagcgaggtgtcctgcaccagggtcttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccatggaggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaaaggagccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagcgcatcgccaaggagagcctgctgcagctgctggtggacatcatccctggcctgctgcagggctatgacaacacagagagctctgtgaggaaggcctctgtgttctgcctggtggccatctacagcgtcatcggggaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149187 - DNA, 3738 bp, Artificial Sequence
  Description of Artificial Sequence: Synthetic coding sequence
atgaccaccgggaaggacaagaactttgatgatgaggacagcgtggatggcaaccggcccagcagcgccagcagcaccagcagcaaggccccacccagcagcagaagaaatgtgggcatgggcaccacccggcggctgggcagcagcaccctgggcagcaagagcagcgctgccaaggagggcgctggagctgtggatgaggaggacttcatcaaggcctttgatgatgtgcctgtggtgcagatctacagcagccgggacctggaggagagcatcaacaagatccgggagatcctgagtgatgacaagcatgactgggagcagagggtgaatgccctgaagaagatccgcagcctgctgctggccggggctgctgaatatgacaacttcttccagcacctgcggctgctggatggagccttcaagctgagcgccaaggacctgcggagccaggtggtgcgggaggcctgcatcaccctgggccacctgagctctgtgctgggcaacaagtttgaccatggagctgaggccatcatgcccaccatcttcaacctgatccccaacagcgccaagatcatggccaccagcggcgtggtggccgtgcggctcatcatccgccacacccacatccccaggctcatccctgtgatcaccagcaactgcaccagcaagtctgtggccgtgagaagacgctgctttgagttcctggacctgctgctgcaggagtggcagacccacagcctggagcggcacatctctgtgctggccgagaccatcaagaagggcatccatgatgctgacagcgaggcccgcatcgaggccaggaagtgctactggggcttccacagccacttcagccgggaggccgagcacctgtaccacaccctggagagcagctaccagaaggccctgcagagccacctgaagaacagcgacagcatcgtgtccctgccccagagcgacaggagcagcagcagcagccaggagagcctgaaccggcccctgagcgccaagaggagccccaccggcagcaccaccagccgggccagcacagtgtccaccaagtctgtgtccaccaccggcagcctgcagaggagcagaagtgacattgatgtgaatgctgctgccagcgccaagagcaaggtgagcagcagcagcggcaccacccccttcagcagcgctgctgccctgcccccaggcagctatgccagcctggatggcaccaccaccaaggccgagggccgcatccgcacccggcggcagagcagcggcagcgccaccaacgtggccagcaccccagacaacagaggccgcagccgggccaaggtggtgtcccagagccagaggagccgcagcgccaacccagctggggccggcagccgcagcagcagccctgggaagctgctgggcagcggctatggaggcctgactggaggcagcagccggggcccccctgtgacccccagcagcgagaagaggagcaagatccccaggagccagggctgcagccgggagaccagccccaacagaattggcctggaccgcttcggcctgggccagcccggccgcatccctggctctgtgaatgccatgagggtgctgagcaccagcacagacctggaggccgctgtggctgatgccctgctgctgggggacagccgcagcaagaagcctgtgagaagaagatatgagccctacggcatgtacagtgatgatgatgccaacagtgatgccagctctgtgtgcagcgagaggagctatggcagcagaaatggaggcatcccccactacctgcggcagacagaagatgtggccgaggtgctgaaccactgtgccagcagcaactggagcgagaggaaggagggcctgctgggcctgcagaacctgctgaagagccagaggaccctgagccgggtggagctgaagaggctgtgtgagatcttcaccaggatgtttgctgacccccacagcaaggtgttctccatgttcctggagaccctggtggacttcatcatcatccacaaggatgacctgcaggactggctgtttgtgctgctgacccagctgctgaagaagatgggcgctgacctgctgggctctgtgcaggccaaggtgcagaaggccctggatgtgacccgggacagcttcccctttgaccagcagttcaacatcctgatgaggttcatcgtggaccagacccagacccccaacctgaaggtgaaggtggccatcctgaagtacatcgagagcctggcccggcagatggaccccacagactttgtgaacagcagcgagacccggctggccgtgagccgcatcatcacctggaccacagagcccaagagcagtgatgtgaggaaggccgcccagatcgtgctgatcagcctgtttgagctgaacaccccagagttcaccatgctgctgggcgccctgcccaagaccttccaggatggagccaccaagctgctgcacaaccacctgaagaacagcagcaacacctctgtgggcagccccagcaacaccatcggccgcacccccagccgccacaccagcagcaggaccagccccctgaccagccccaccaactgcagccatggaggcctgagccccagcatgctggactatgacacagagaacctgaacagcgaggagatctacagcagcctgcggggcgtgacagaggccatcgagaagttctccttccgcagccaggaggacctgaatgagcccatcaagagagatggcaagaaggaatgtgacatcgtgtccagagatggaggagctgccagccctgccacagagggccggggcggcagcgaggtggagggcggccgcacagccctggacaacaagaccagcctgctgaacacccagcccccccgggccttccctggcccccgggcccgggactacaacccctacccctacagtgatgccatcaacacctatgacaagacagccctgaaggaggccgtgtttgatgatgacatggagcagctgagagatgtgcccatcgaccacagcgacctggtggccgacctgctgaaggagctgagcaaccacaatgaaagagtggaggagaggaaaggagccctgctggagctgctgaagatcacccgggaggacagcctgggcgtgtgggaggagcacttcaagaccatcctgctgctgctgctggagaccctgggggacaaggaccacagcatccgggccctggccctgcgggtgctgcgggagatcctgaggaaccagcctgcccgcttcaagaactatgcagagctgaccatcatgaagaccctggaggcccacaaggacagccacaaggaggtggtgcgggctgctgaggaggccgccagcaccctggccagcagcatccaccctgagcagtgcatcaaggtgctgtgccccatcatccagacagctgactaccccatcaacctggccgccatcaagatgcagaccaaggtggtggagcgcatcgccaaggagagcctgctgcagctgctggtggacatcatccctggcctgctgcagggctatgacaacacagagagctctgtgaggaaggcctctgtgttctgcctggtggccatctacagcgtcatcggggaggacctgaagccccacctggcccagctgaccggcagcaagatgaagctgctgaacctgtacatcaagagggcccagaccaccaacagcaacagcagcagcagcagtgatgtgtccacccacagctag

SEQ ID NO: 149188 - DNA, 2988 bp, Artificial Sequence
  Description of Artificial Sequence: Synthetic coding sequence
atgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatggaacagcctctgaagatggccgggtgcgggccaagctgagcgcccccctggccggcatgggaaatgccaaggctgacagccggggccgcagcaggaccaagatggtgtcccagagccagcccggcagccgcagcggcagccctggccgggtgctgaccaccacagccctgagcacagtgagcagcggcgtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctgggccctggctacggcatcagccagagcagccggctgagcagctctgtgtctgccatgagggtgctgaacacaggcagtgatgtggaggaggccgtggctgatgccctgaagaagccagccaggagaagatatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaagagggtcttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgagaaatactggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtggaggagaggaagatcgccctgtatgagctgatgaagctgacccaggaggagagcttctctgtgtgggatgagcacttcaagaccatcctgctgctgctgctggagaccctgggggacaaggagcccaccatccgggccctggccctgaaggtgctgcgggagatcctgcggcaccagcctgcccgcttcaagaactatgcagagctgactgtgatgaagaccctggaggcccacaaggacccccacaaggaggtggtgcgctctgctgaggaggccgcctctgtgctggccaccagcatcagccctgagcagtgcatcaaggtgctgtgccccatcatccagacagctgactaccccatcaacctggccgccatcaagatgcagaccaaggtgattgagcgggtgtccaaggagaccctgaacctgctgctgcctgagatcatgcctggcctcatccagggctatgacaacagcgagagctctgtgaggaaggcctgtgtgttctgcctggtggccgtgcatgctgtgattggagatgagctgaagccccacctgagccagctgaccggcagcaagatgaagctgctgaacctgtacatcaagagggcccagacaggcagcggcggcgctgaccccaccacagatgtgtctggccagagctag

SEQ ID NO: 149189 - DNA, 1296 bp, Artificial Sequence
  Description of Artificial Sequence: Synthetic coding sequence
atgaggaggctcatctgcaagaggatctgtgactacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggcggggccagcaaggagggcggggccggggctgtggatgaagatgacttcatcaaggccttcacagatgtgcccagcatccagatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccatggagctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggagtgtgaggccttctggaggagcggccgcacagccaagctgtacagcgtgtag

SEQ ID NO: 149190 - DNA, 4518 bp, Artificial Sequence
  Description of Artificial Sequence: Synthetic coding sequence
atggagcccaggtccatggagtacttctgtgcccaggtgcagcagaaggatgtgggcggccgcctgcaggtgggccaggagctgctgctgtacctgggcgcccctggggccatcagtgacctggaggaggacctgggccgcctgggcaagacagtggatgccctgaccggctgggtgggcagcagcaactacagagtgtccctgatgggcctggagatcctgagcgcctttgtggaccggctgagcacccgcttcaagagctatgtggccatggtgattgtggccctgattgacaggatgggagatgccaaggacaaggtgagagatgaggcccagaccctcatcctgaagctgatggaccaggtggccccacccatgtacatctgggagcagctggccagcggcttcaagcacaagaacttccgcagccgggagggcgtgtgcctgtgcctgattgagaccctgaacatctttggagcccagcccctggtgatcagcaagctgatcccccacctgtgcatcctgtttggagacagcaacagccaggtgagagatgctgccatcctggccatcgtggagatctacagacatgtgggggagaaggtgaggatggacctgtacaagaggggcatccccccagcccggctggagatgatctttgccaagtttgatgaggtgcagagcagcggcggcatgatcctgtctgtgtgcaaggacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggcggggccagcaaggagggcggggccggggctgtggatgaagatgacttcatcaaggccttcacagatgtgcccagcatccagatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccacggggctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatggaacagcctctgaagatggccgggtgcgggccaagctgagcgcccccctggccggcatgggaaatgccaaggctgacagccggggccgcagcaggaccaagatggtgtcccagagccagcccggcagccgcagcggcagccctggccgggtgctgaccaccacagccctgagcacagtgtcctctggagtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctgggccctggctacggcatcagccagagcagccggctgagcagctctgtgtctgccatgagggtgctgaacacaggcagtgatgtggaggaggccgtggctgatgccctgaagaagccagcccggcggcgctatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaaggtgttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgagaaatactggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtggaggagaggaagatcgccctgtatgagctgatgaagctgacccaggaggagagcttctctgtgtgggatgagcacttcaagaccatcctgctgctgctgctggagaccctgggggacaaggagcccaccatccgggccctggccctgaaggtgctgcgggagatcctgcggcaccagcctgcccgcttcaagaactatgcagagctgactgtgatgaagaccctggaggcccacaaggacccccacaaggaggtggtgcgctctgctgaggaggccgcctctgtgctggccaccagcatcagccctgagcagtgcatcaaggtgctgtgccccatcatccagacagctgactaccccatcaacctggccgccatcaagatgcagaccaaggtgattgagcgggtgtccaaggagaccctgaacctgctgctgcctgagatcatgcctggcctcatccagggctatgacaacagcgagagctctgtgaggaaggcctgtgtgttctgcctggtggccgtgcatgctgtgattggagatgagctgaagccccacctgagccagctgaccggcagcaagatgaagctgctgaacctgtacatcaagagggcccagacaggcagcggcggcgctgaccccaccacagatgtgtctggccagagctag

SEQ ID NO: 149191 - DNA, 4542 bp, Artificial Sequence
  Description of Artificial Sequence: Synthetic coding sequence
atggagcccaggtccatggagtacttctgtgcccaggtgcagcagaaggatgtgggcggccgcctgcaggtgggccaggagctgctgctgtacctgggcgcccctggggccatcagtgacctggaggaggacctgggccgcctgggcaagacagtggatgccctgaccggctgggtgggcagcagcaactacagagtgtccctgatgggcctggagatcctgagcgcctttgtggaccggctgagcacccgcttcaagagctatgtggccatggtgattgtggccctgattgacaggatgggagatgccaaggacaaggtgagagatgaggcccagaccctcatcctgaagctgatggaccaggtggccccacccatgtacatctgggagcagctggccagcggcttcaagcacaagaacttccgcagccgggagggcgtgtgcctgtgcctgattgagaccctgaacatctttggagcccagcccctggtgatcagcaagctgatcccccacctgtgcatcctgtttggagacagcaacagccaggtgagagatgctgccatcctggccatcgtggagatctacagacatgtgggggagaaggtgaggatggacctgtacaagaggggcatccccccagcccggctggagatgatctttgccaagtttgatgaggtgcagagcagcggcggcatgatcctgtctgtgtgcaaggacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggcggggccagcaaggagggcggggccggggctgtggatgaagatgacttcatcaaggccttcacagatgtgcccagcatccagatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccacggggctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatggaacagcctctgaagatggccgggtgcgggccaagctgagcgcccccctggccggcatgggaaatgccaaggctgacagccggggccgcagcaggaccaagatggtgtcccagagccagcccggcagccgcagcggcagccctggccgggtgctgaccaccacagccctgagcacagtgtcctctggagtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctgggccctggctacggcatcagccagagcagccggctgagcagctctgtgtctgccatgagggtgctgaacacaggcagtgatgtggaggaggccgtggctgatgccctgctgctgggggacatccgcaccaagaagaagccagcccggcggcgctatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaaggtgttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgagaaatactggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtggaggagaggaagatcgccctgtatgagctgatgaagctgacccaggaggagagcttctctgtgtgggatgagcacttcaagaccatcctgctgctgctgctggagaccctgggggacaaggagcccaccatccgggccctggccctgaaggtgctgcgggagatcctgcggcaccagcctgcccgcttcaagaactatgcagagctgactgtgatgaagaccctggaggcccacaaggacccccacaaggaggtggtgcgctctgctgaggaggccgcctctgtgctggccaccagcatcagccctgagcagtgcatcaaggtgctgtgccccatcatccagacagctgactaccccatcaacctggccgccatcaagatgcagaccaaggtgattgagcgggtgtccaaggagaccctgaacctgctgctgcctgagatcatgcctggcctcatccagggctatgacaacagcgagagctctgtgaggaaggcctgtgtgttctgcctggtggccgtgcatgctgtgattggagatgagctgaagccccacctgagccagctgaccggcagcaagatgaagctgctgaacctgtacatcaagagggcccagacaggcagcggcggcgctgaccccaccacagatgtgtctggccagagctag

SEQ ID NO: 149192 - DNA, 4545 bp, Artificial Sequence
  Description of Artificial Sequence: Synthetic coding sequence
atggagcccaggtccatggagtacttctgtgcccaggtgcagcagaaggatgtgggcggccgcctgcaggtgggccaggagctgctgctgtacctgggcgcccctggggccatcagtgacctggaggaggacctgggccgcctgggcaagacagtggatgccctgaccggctgggtgggcagcagcaactacagagtgtccctgatgggcctggagatcctgagcgcctttgtggaccggctgagcacccgcttcaagagctatgtggccatggtgattgtggccctgattgacaggatgggagatgccaaggacaaggtgagagatgaggcccagaccctcatcctgaagctgatggaccaggtggccccacccatgtacatctgggagcagctggccagcggcttcaagcacaagaacttccgcagccgggagggcgtgtgcctgtgcctgattgagaccctgaacatctttggagcccagcccctggtgatcagcaagctgatcccccacctgtgcatcctgtttggagacagcaacagccaggtgagagatgctgccatcctggccatcgtggagatctacagacatgtgggggagaaggtgaggatggacctgtacaagaggggcatccccccagcccggctggagatgatctttgccaagtttgatgaggtgcagagcagcggcggcatgatcctgtctgtgtgcaaggacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggcgctggggccagcaaggagggcggggccggggctgtggatgaagatgacttcatcaaggccttcacagatgtgcccagcatccagatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccatggagctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatggaacagcctctgaagatggccgggtgcgggccaagctgagcgcccccctggccggcatgggaaatgccaaggctgacagccggggccgcagcaggaccaagatggtgtcccagagccagcccggcagccgcagcggcagccctggccgggtgctgaccaccacagccctgagcacagtgagcagcggcgtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctgggccctggctacggcatcagccagagcagccggctgagcagctctgtgtctgccatgagggtgctgaacacaggcagtgatgtggaggaggccgtggctgatgccctgctgctgggggacatccgcaccaagaagaagccagccaggagaagatatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaaggtgttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgaggaacacaggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtggaggagaggaagatcgccctgtatgagctgatgaagctgacccaggaggagagcttctctgtgtgggatgagcacttcaagaccatcctgctgctgctgctggagaccctgggggacaaggagcccaccatccgggccctggccctgaaggtgctgcgggagatcctgcggcaccagcctgcccgcttcaagaactatgcagagctgactgtgatgaagaccctggaggcccacaaggacccccacaaggaggtggtgcgctctgctgaggaggccgcctctgtgctggccaccagcatcagccctgagcagtgcatcaaggtgctgtgccccatcatccagacagctgactaccccatcaacctggccgccatcaagatgcagaccaaggtgattgaaagagtgtccaaggagaccctgaacctgctgctgcctgagatcatgcctggcctcatccagggctatgacaacagcgagagctctgtgaggaaggcctgtgtgttctgcctggtggccgtgcatgctgtgattggagatgagctgaagccccacctgagccagctgaccggcagcaagatgaagctgctgaacctgtacatcaagagggcccagacaggcagcggcggcgctgaccccaccacagatgtgtctggccagagctag

SEQ ID NO: 149193 - DNA, 3882 bp, Artificial Sequence
  Description of Artificial Sequence: Synthetic coding sequence
atggccatgggagatgacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggcggggccagcaaggagggcggggccggggctgtggatgaagatgacttcatcaaggccttcacagatgtgcccagcatccagatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccatggagctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatggaacagcctctgaagatggccgggtgcgggccaagctgagcgcccccctggccggcatgggaaatgccaaggctgacagccggggccgcagcaggaccaagatggtgtcccagagccagcccggcagccgcagcggcagccctggccgggtgctgaccaccacagccctgagcacagtgagcagcggcgtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctggccagccgccaccacagccgcagcactggagccctgtatgcccctgaggtgtatggagccagcggccctggctacggcatcagccagagcagccggctgagcagctctgtgtctgccatgagggtgctgaacacaggcagtgatgtggaggaggccgtggctgatgccctgaagaagccagcccggcggcgctatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaaggtgttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgagaaatactggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtggaggagaggaagatcgccctgtatgagctgatgaagctgacccaggaggagagcttctctgtgtgggatgagcacttcaagaccatcctgctgctgctgctggagaccctgggggacaaggagcccaccatccgggccctggccctgaaggtgctgcgggagatcctgcggcaccagcctgcccgcttcaagaactatgcagagctgactgtgatgaagaccctggaggcccacaaggacccccacaaggaggtggtgcgctctgctgaggaggccgcctctgtgctggccaccagcatcagccctgagcagtgcatcaaggtgctgtgccccatcatccagacagctgactaccccatcaacctggccgccatcaagatgcagaccaaggtgattgagcgggtgtccaaggagaccctgaacctgctgctgcctgagatcatgcctggcctcatccagggctatgacaacagcgagagctctgtgaggaaggcctgtgtgttctgcctggtggccgtgcatgctgtgattggagatgagctgaagccccacctgagccagctgaccggcagcaagatgaagctgctgaacctgtacatcaagagggcccagacaggcagcggcggcgctgaccccaccacagatgtgtctggccagagctag

SEQ ID NO: 149194 - DNA, 3192 bp, Artificial Sequence
  Description of Artificial Sequence: Synthetic coding sequence
atgaggaggctcatctgcaagaggatctgtgactacaagagctttgatgatgaggagagcgtggatggcaaccggcccagcagcgctgccagcgccttcaaggtgcctgcccccaagaccagcggcaacccagccaacagcgccaggaagccaggcagcgctgggggccccaaggtgggggagctgctgagcatcatgatctacagcagccgggagctggaggagaccctgaacaagatccgggagatcctgagtgatgacaagcatgactgggaccagagggccaatgccctgaagaagatccgcagcctgctggtggccggggccgcccagtatgactgcttcttccagcacctgcggctgctggatggagccctgaagctgagcgccaaggacctgcggagccaggtggtgcgggaggcctgcatcaccgtggcccacctgagcacagtgctgggcaacaagtttgaccacggggctgaggccatcgtgcccaccctcttcaacctggtgcccaacagcgccaaggtgatggccaccagcggctgtgccgccatccgcttcatcatccgccacacccacgtgcccaggctcatccccctcatcaccagcaactgcaccagcaagtctgtgcctgtgagaagaagaagctttgagttcctggacctgctgctgcaggagtggcagacccacagcctggagagacatgctgctgtgctggtggagaccatcaagaagggcatccatgatgctgatgctgaggcccgggtggaggccaggaagacctacatgggcctgaggaaccacttccctggagaggccgagaccctgtacaacagcctggagcccagctaccagaagagcctgcagacctacctgaagagcagcggctctgtggccagcctgccccagagcgacaggagcagcagcagcagccaggagagcctgaaccggcccttcagcagcaagtggagcacagccaaccccagcacagtggccggccgggtgtctgctggcagcagcaaggccagcagcctgcccggcagcctgcagaggagcagaagtgacattgatgtgaatgctgctgctggggccaaggcccaccacgccgccggccagagcgtgcgcagcggccgcctgggcgctggggccctgaatgccggcagctatgccagcctggaggacaccagtgacaagctggatgacctcttcagtgacaatggccgggtgcgggccaagctgagcgcccccctggccggcatgggaaatgccaaggctgacagccggggccgcagcaggaccaagatggtgtcccagagccagaggagcagcagcccagacaagaatgaaggcagccagagcgccaacaccatcggggccggcagccgcagcggcagccctggccgggtgctgaccaccacagccctgagcacagtgtcctctggagtgcagagggtgctggtgaacagcgccagcgcccagaagaggagcaagatccccaggagccagggctgcagccgggaggccagccccagccggctgtctgtggcccggagcagccgcatcccccggcccagcgtgtcccagggctgcagccgggaggccagccgggagagcagccgggacaccagccctgtgcgctccttccagcccctgggccctggctacggcatcagccagagcagccggctgagcagctctgtgtctgccatgagggtgctgaacacaggcagtgatgtggaggaggccgtggctgatgccctggtgctgtttgacttcaagaccaagaagaagccagcccggcggcgctatgagagctatggcatgcacagtgatgatgatgccaacagtgatgccagcagcgcctgcagcgagaggagctacagcagcagaaatggcagcatccccacctacatgaggcagacagaagatgtggccgaggtgctgaacagatgtgccagcagcaactggagcgagaggaaggagggcctgctgggcctgcagaacctgctgaagaaccagaggaccctgagccgggtggagctgaagaggctgtgtgagatcttcaccaggatgtttgctgacccccacggcaaggtgttctccatgttcctggagaccctggtggacttcatccaggtgcacaaggatgacctgcaggactggctgtttgtgctgctgacccagctgctgaagaagatgggcgctgacctgctgggctctgtgcaggccaaggtgcagaaggccctggatgtgacccgggagagcttccccaatgacctgcagttcaacatcctgatgaggttcaccgtggaccagacccagacccccagcctgaaggtgaaggtggccatcctgaagtacatcgagaccctggccaagcagatggaccccggggacttcatcaacagcagcgagacccggctggccgtgtccagggtcatcacctggaccacagagcccaagagcagtgatgtgaggaaggccgcccagagcgtgctgatcagcctgtttgagctgaacaccccagagttcaccatgctgctgggcgccctgcccaagaccttccaggatggagccaccaagctgctgcacaaccacctgagaaatactggaaatggcacccagagctccatgggcagccccctgacccggcccacccccaggagccctgccaactggagcagccccctgaccagccccaccaacaccagccagaacaccctgagccccagcgcctttgattatgacacagagaacatgaacagcgaggacatctacagcagcctgcggggcgtgacagaggccatccagaacttctccttccgcagccaggaggacatgaatgagcccctgaagagggacagcaagaaggatgatggagacagcatgtgtggcggccctggcatgtctgaccccagggctggaggagatgccacagacagcagccagacagccctggacaacaaggccagcctgctgcacagcatgcccacccacagcagccccaggagccgggactacaacccctacaactacagcgacagcatcagccccttcaacaagagcgccctgaaggaggccatgtttgatgatgatgctgaccagttcccagatgacctgagcctggaccacagcgacctggtggccgagctgctgaaggagctgagcaaccacaatgaaagagtgtag

SEQ ID NO: 149195 - DNA, 1680 bp, Artificial Sequence
  Description of Artificial Sequence: Synthetic coding sequence
atgcccccacccagcccagacagtgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagcagaagaagccctgtgagcccccagctgcagcagcagcaccaggccgctgctgctgccttcctgcagcagaggaacagctacaaccaccaccagcccctgctgaagcagagcccctggagcaaccaccagagcagcggctggggcaccggctccatgtcctggggcgccatgcacggccgggaccacagaagaactggaaacatgggcatccctggcaccatgaaccagatcagccccctgaagaagcccttctctggaaatgtgattgccccacccaagttcaccaggagcacccccagcctgacccccaagtcctggattgaggacaacgtgttcagaacagacaacaacagcaacaccctgctgcccctgcaggacaggagcaggatgtatgacagcctgaacatgcacagcctggagaacagcctgattgacatcatgagagctgagcatgaccccctgaagggccgcctgagctacccccaccctggaacagacaacctgctgatgctgaatggccgcagcagcctcttccccattgatgatggcctgctggatgatggccacagcgaccaggtgggcgtgctgaacagccccacctgctacagcgcccaccagaatggagagagaattgagcgcttcagcaggaaggtgtttgtgggcggcctgcccccagacattgatgaagatgagatcacagccagcttcagaagatttggccccctggtggtggactggccccacaaggccgagagcaagagctacttcccccccaagggctacgccttcctgctcttccaggaggagagctctgtgcaggccctgattgatgcctgcatcgaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggggccggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagcagagctggccgggagttccacaagcccctggtgaaggagggcgctgaccggccccggcagatccacttccgctggaactag

SEQ ID NO: 149196 - DNA, 1731 bp, Artificial Sequence
  Description of Artificial Sequence: Synthetic coding sequence
atgcccccacccagcccagacagtgaaaatggcttctacccaggcctgcccagctccatgaacccagccttcttccccagcttcagccctgtgagcccccacggctgcaccggcctgtctgtgcccccacctccagccatgaacatcccccagcagcagcccccacctcctgctgccccccagcagccccagagccgccgcagccctgtgagcccccagctgcagcagcagcaccaggccgctgctgctgccttcctgcagcagagaaattcctacaaccaccaccagcccctgctgaagcagagcccctggagcaaccaccagagcagcggctggggcaccggctccatgtcctggggcgccatgcacggccgggaccacagaagaacaggcaacatgggcatccctggcaccatgaaccagatcagccccctgaagaagcccttctctggaaatgtcatcgccccacccaagttcaccaggagcacccccagcctgacccccaagtcctggattgaagataatgtgttcagaacagacaacaacagcaacaccctgctgcccctgcaggtgcgcagcagcctgcagctgcctgcctggggcagtgacagcctgcaggacagctggtgcacagctgctggcaccagcagaattgaccaggacaggagcaggatgtatgacagcctgaacatgcacagcctggagaacagcctgattgacatcatgagagctgagcatgaccccctgaagggccgcctgagctacccccaccctggaacagacaacctgctgatgctgaatgcccggagctatggaagaagaagaggccgcagcagcctcttccccattgatgatggcctgctggatgatggccacagcgaccaggtgggcgtgctgaacagccccacctgctacagcgcccaccagaatggagagcgcatcgagcgcttcagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcattgaagaagatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagccgggccggccgggagttccacaagcccctggtgaaggagggcgctgaccggccccggcagatccacttccgctggaactag

SEQ ID NO: 149197 - DNA, 1704 bp, Artificial Sequence
  Description of Artificial Sequence: Synthetic coding sequence
atgcccccacccagcccagacagtgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagcagaagaagccctgtgagcccccagctgcagcagcagcaccaggccgctgctgctgccttcctgcagcagaggaacagctacaaccaccaccagcccctgctgaagcagagcccctggagcaaccaccagagcagcggctggggcaccggctccatgtcctggggcgccatgcacggccgggaccacagaagaactggaaacatgggcatccctggcaccatgaaccagatcagccccctgaagaagcccttctctggaaatgtgattgccccacccaagttcaccaggagcacccccagcctgacccccaagtcctggattgaggacaacgtgttcagaacagacaacaacagcaacaccctgctgcccctgcaggacaggagcaggatgtatgacagcctgaacatgcacagcctggagaacagcctgattgacatcatgagagctgagcatgaccccctgaagggccgcctgagctacccccaccctggaacagacaacctgctgatgctgaatgcccggagctatggaagaagaagaggccgcagcagcctcttccccattgatgatggcctgctggatgatggccacagcgaccaggtgggcgtgctgaacagccccacctgctacagcgcccaccagaatggagagagaattgagcgcttcagcaggaaggtgtttgtgggcggcctgcccccagacattgatgaagatgagatcacagccagcttcagaagatttggccccctggtggtggactggccccacaaggccgagagcaagagctacttcccccccaagggctacgccttcctgctcttccaggaggagagctctgtgcaggccctgattgatgcctgcatcgaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggggccggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagcagagctggccgggagttccacaagcccctggtgaaggagggcgctgaccggccccggcagatccacttccgctggaactag

SEQ ID NO: 149198 - DNA, 1689 bp, Artificial Sequence
  Description of Artificial Sequence: Synthetic coding sequence
atgcccccacccagcccagacagtgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagcagaagaagccctgtgagcccccagctgcagcagcagcaccaggccgctgctgctgccttcctgcagcagaggaacagctacaaccaccaccagcccctgctgaagcagagcccctggagcaaccaccagagcagcggctggggcaccggctccatgtcctggggcgccatgcacggccgggaccacagaagaactggaaacatgggcatccctggcaccatgaaccagatcagccccctgaagaagcccttctctggaaatgtgattgccccacccaagttcaccaggagcacccccagcctgacccccaagtcctggattgaggacaacgtgttcagaacagacaacaacagcaacaccctgctgcccctgcaggtgaggatggacaggagcaggatgtatgacagcctgaacatgcacagcctggagaacagcctgattgacatcatgagagctgagcatgaccccctgaagggccgcctgagctacccccaccctggaacagacaacctgctgatgctgaatggccgcagcagcctcttccccattgatgatggcctgctggatgatggccacagcgaccaggtgggcgtgctgaacagccccacctgctacagcgcccaccagaatggagagcgcatcgagcgcttcagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcattgaagaagatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagccgggccggccgggagttccacaagcccctggtgaaggagggcgctgaccggccccggcagatccacttccgctggaactag

SEQ ID NO: 149199 - DNA, 3024 bp, Artificial Sequence
  Description of Artificial Sequence: Synthetic coding sequence
atgagggactttggcttcggcgtgctgcagacagcccccctgcggagcagcagccctggccccctcttctgtggggaggcctacggcccctatgctgtgggctctgtgaaccccctgcccagcgccaccccatttggccccctgagccccccacccctgcctgtgacaggcttcctggaggccgccagccccttctctgtgcccctgggcggcggggccggcagccctgctgctgctgccagcagcagcagccccttcctggcccaccagcagaccatgcaggatgagctgctgctgggcctgacccagcagcctgcccggcccctgagcggggctgctgccacagagaagctgcctgaccaccaccctgggggcggcaccatcgccggcgtgacccacctgctgcccagccaggacttcaagcccagcctgcaccaccccagcagcagcagcgccagcagctgctgctgctgcaggaccagcagcccccaggacttcagcaagaggcagcagcagcagctgagcagccagaagaggaaggagttcagccccccccacctgccccaccccccagacagcaagcccccacctcctcctccacccctgcactgccccggccgcttcagccccccacctcctcctgctggccccctgctgcagcctgcccagctggcccagaggcagcagcagcagcccccccagcagttcagcctgctgcaccagcagcacctgagcccccaggactttgccccccggcagaggcctgctgacctgccccccctgccccagctgccccccagccccccagctgccccccggcggcggcacggcggggccggcagccccaggaagaccccagctgctggggagggcagcgctgctgagagccccaatgccggcctggccagcagcacccctgtgaacccagcccctggctccatggagagccccaaccaccccctgctgaacagccccagcaacctgctgcccggcggggccctgggcgctggggccttcagcagcctgcagagcccagacctgccccaccctgggggcggcggcggcggcggcggcggcggccccccaggcggcggcggcggcggcggcagcgccagccccccacccctgcccggcttcggcaccccctggagcgtgcagacagccagccccccaccccagccccagcagcccccacccacccagccccagcagcagcccccaccaccccagcagcccccccagccccagccccagcccccaggcagcagcgccaccaccccaggcggcggcagcggcggcagcctgagcgccatgcccccacccagcccagattctgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagccgccgcagccctgtgagcccccagctgcagcagcagcaccaggccgctgctgctgccttcctgcagcagagaaattcctacaaccaccaccagcccctgctgaagcagagcccctggagcaaccaccagagcagcggctggggcaccggctccatgtcctggggcgccatgcacggccgggaccacagaagaacaggcaacatgggcatccctggcaccatgaaccagatcagccccctgaagaagcccttctctggaaatgtcatcgccccacccaagttcaccaggagcacccccagcctgacccccaagtcctggattgaagataatgtgttcagaacagacaacaacagcaacaccctgctgcccctgcaggtgaggatggacaggagcaggatgtatgacagcctgaacatgcacagcctggagaacagcctgattgacatcatgagagctgagcatgaccccctgaagggccgcctgagctacccccaccctggaacagacaacctgctgatgctgaatgcccggagctatggaagaagaagaggccgcagcagcctcttccccattgatgatggcctgctggatgatggccacagcgaccaggtgggcgtgctgaacagccccacctgctacagcgcccaccagaatggagagagaattgagcgcttcagcaggaaggtgtttgtgggcggcctgcccccagacattgatgaagatgagatcacagccagcttcagaagatttggccccctggtggtggactggccccacaaggccgagagcaagagctacttcccccccaagggctacgccttcctgctcttccaggaggagagctctgtgcaggccctgattgatgcctgcatcgaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggggccggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagcagagctggccgggagttccacaagcccctggtgaaggagggcgctgaccggccccggcagatccacttccgctggaactag

SEQ ID NO: 149200 - DNA, 1770 bp, Artificial Sequence
  Description of Artificial Sequence: Synthetic coding sequence
atgcccccacccagcccagacagtgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagcagaagaagccctgtgagcccccagctgcagcagcagcaccaggccgctgctgctgccttcctgcagcagaggaacagctacaaccaccaccagcccctgctgaagcagagcccctggagcaaccaccagagcagcggctggggcaccggctccatgtcctggggcgccatgcacggccgggaccacagaagaactggaaacatgggcatccctggcaccatgaaccagatcagccccctgaagaagcccttctctggaaatgtgattgccccacccaagttcaccaggagcacccccagcctgacccccaagtcctggattgaggacaacgtgttcagaacagacaacaacagcaacaccctgctgcccctgcaggtgcgcagcagcctgcagctgcctgcctggggcagtgacagcctgcaggacagctggtgcacagctgctggcaccagcagaattgaccaggacaggagcaggatgtatgacagcctgaacatgcacagcctggagaacagcctgattgacatcatgagagctgagcatgaccccctgaagggccgcctgagctacccccaccctggaacagacaacctgctgatgctgaatggccgcagcagcctcttccccattgatgatggcctgctggatgatggccacagcgaccaggtgggcgtgctgaacagccccacctgctacagcgcccaccagaatggagagagaattgagcgcttcagcaggaaggtgtttgtgggcggcctgcccccagacattgatgaagatgagatcacagccagcttcagaagatttggccccctggtggtggactggccccacaaggccgagagcaagagctacttcccccccaagggctacgccttcctgctcttccaggaggagagctctgtgcaggccctgattgatgcctgcatcgaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggggccggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagcagagctggccgggagttccacaagcccctggtgaaggagggcgctgaccggccccggcagatccacttccgctggaactag

SEQ ID NO: 149201 - DNA, 3105 bp, Artificial Sequence
  Description of Artificial Sequence: Synthetic coding sequence
atgagggactttggcttcggcgtgctgcagacagcccccctgcggagcagcagccctggccccctcttctgtggggaggcctacggcccctatgctgtgggctctgtgaaccccctgcccagcgccaccccatttggccccctgagccccccacccctgcctgtgacaggcttcctggaggccgccagccccttctctgtgcccctgggcggcggggccggcagccctgctgctgctgccagcagcagcagccccttcctggcccaccagcagaccatgcaggatgagctgctgctgggcctgacccagcagcctgcccggcccctgagcggggctgctgccacagagaagctgcctgaccaccaccctgggggcggcaccatcgccggcgtgacccacctgctgcccagccaggacttcaagcccagcctgcaccaccccagcagcagcagcgccagcagctgctgctgctgcaggaccagcagcccccaggacttcagcaagaggcagcagcagcagctgagcagccagaagaggaaggagttcagccccccccacctgccccaccccccagacagcaagcccccacctcctcctccacccctgcactgccccggccgcttcagccccccacctcctcctgctggccccctgctgcagcctgcccagctggcccagaggcagcagcagcagcccccccagcagttcagcctgctgcaccagcagcacctgagcccccaggactttgccccccggcagaggcctgctgacctgccccccctgccccagctgccccccagccccccagctgccccccggcggcggcacggcggggccggcagccccaggaagaccccagctgctggggagggcagcgctgctgagagccccaatgccggcctggccagcagcacccctgtgaacccagcccctggctccatggagagccccaaccaccccctgctgaacagccccagcaacctgctgcccggcggggccctgggcgctggggccttcagcagcctgcagagcccagacctgccccaccctgggggcggcggcggcggcggcggcggcggccccccaggcggcggcggcggcggcggcagcgccagccccccacccctgcccggcttcggcaccccctggagcgtgcagacagccagccccccaccccagccccagcagcccccacccacccagccccagcagcagcccccaccaccccagcagcccccccagccccagccccagcccccaggcagcagcgccaccaccccaggcggcggcagcggcggcagcctgagcgccatgcccccacccagcccagattctgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagccgccgcagccctgtgagcccccagctgcagcagcagcaccaggccgctgctgctgccttcctgcagcagagaaattcctacaaccaccaccagcccctgctgaagcagagcccctggagcaaccaccagagcagcggctggggcaccggctccatgtcctggggcgccatgcacggccgggaccacagaagaacaggcaacatgggcatccctggcaccatgaaccagatcagccccctgaagaagcccttctctggaaatgtcatcgccccacccaagttcaccaggagcacccccagcctgacccccaagtcctggattgaagataatgtgttcagaacagacaacaacagcaacaccctgctgcccctgcaggtgcgcagcagcctgcagctgcctgcctggggcagtgacagcctgcaggacagctggtgcacagctgctggcaccagcagaattgaccaggacaggagcaggatgtatgacagcctgaacatgcacagcctggagaacagcctgattgacatcatgagagctgagcatgaccccctgaagggccgcctgagctacccccaccctggaacagacaacctgctgatgctgaatgcccggagctatggaagaagaagaggccgcagcagcctcttccccattgatgatggcctgctggatgatggccacagcgaccaggtgggcgtgctgaacagccccacctgctacagcgcccaccagaatggagagcgcatcgagcgcttcagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcattgaagaagatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagccgggccggccgggagttccacaagcccctggtgaaggagggcgctgaccggccccggcagatccacttccgctggaactag

SEQ ID NO: 149202 - DNA, 3081 bp, Artificial Sequence
  Description of Artificial Sequence: Synthetic coding sequence
atgagggactttggcttcggcgtgctgcagacagcccccctgcggagcagcagccctggccccctcttctgtggggaggcctacggcccctatgctgtgggctctgtgaaccccctgcccagcgccaccccatttggccccctgagccccccacccctgcctgtgacaggcttcctggaggccgccagccccttctctgtgcccctgggcggcggggccggcagccctgctgctgctgccagcagcagcagccccttcctggcccaccagcagaccatgcaggatgagctgctgctgggcctgacccagcagcctgcccggcccctgagcggggctgctgccacagagaagctgcctgaccaccaccctgggggcggcaccatcgccggcgtgacccacctgctgcccagccaggacttcaagcccagcctgcaccaccccagcagcagcagcgccagcagctgctgctgctgcaggaccagcagcccccaggacttcagcaagaggcagcagcagcagctgagcagccagaagaggaaggagttcagccccccccacctgccccaccccccagacagcaagcccccacctcctcctccacccctgcactgccccggccgcttcagccccccacctcctcctgctggccccctgctgcagcctgcccagctggcccagaggcagcagcagcagcccccccagcagttcagcctgctgcaccagcagcacctgagcccccaggactttgccccccggcagaggcctgctgacctgccccccctgccccagctgccccccagccccccagctgccccccggcggcggcacggcggggccggcagccccaggaagaccccagctgctggggagggcagcgctgctgagagccccaatgccggcctggccagcagcacccctgtgaacccagcccctggctccatggagagccccaaccaccccctgctgaacagccccagcaacctgctgcccggcggggccctgggcgctggggccttcagcagcctgcagagcccagacctgccccaccctgggggcggcggcggcggcggcggcggcggccccccaggcggcggcggcggcggcggcagcgccagccccccacccctgcccggcttcggcaccccctggagcgtgcagacagccagccccccaccccagccccagcagcccccacccacccagccccagcagcagcccccaccaccccagcagcccccccagccccagccccagcccccaggcagcagcgccaccaccccaggcggcggcagcggcggcagcctgagcgccatgcccccacccagcccagattctgaaaatggcttctacccaggcctgcccagctccatgaacccagccttcttccccagcttcagccctgtgagcccccacggctgcaccggcctgtctgtgcccaccagcggcggcggcggcggcggctttggaggccccttcagcgccacagctgtgcccccacctcctcctccagccatgaacatcccccagcagcagcccccacctcctgctgccccccagcagccccagagccgccgcagccctgtgagcccccagctgcagcagcagcaccaggccgctgctgctgccttcctgcagcagagaaattcctacaaccaccaccagcccctgctgaagcagagcccctggagcaaccaccagagcagcggctggggcaccggctccatgtcctggggcgccatgcacggccgggaccacagaagaacaggcaacatgggcatccctggcaccatgaaccagatcagccccctgaagaagcccttctctggaaatgtcatcgccccacccaagttcaccaggagcacccccagcctgacccccaagtcctggattgaagataatgtgttcagaacagacaacaacagcaacaccctgctgcccctgcaggtgcgcagcagcctgcagctgcctgcctggggcagtgacagcctgcaggacagctggtgcacagctgctggcaccagcagaattgaccaggacaggagcaggatgtatgacagcctgaacatgcacagcctggagaacagcctgattgacatcatgagagctgagcatgaccccctgaagggccgcctgagctacccccaccctggaacagacaacctgctgatgctgaatggccgcagcagcctcttccccattgatgatggcctgctggatgatggccacagcgaccaggtgggcgtgctgaacagccccacctgctacagcgcccaccagaatggagagcgcatcgagcgcttcagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcattgaagaagatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacggggacatcgacaagagggtggaggtgaagccctacgtgctggatgaccagatgtgtgatgagtgccagggcgcccgctgtggcggcaagtttgcccccttcttctgtgccaacgtgacctgcctgcagtactactgtgagttctgctgggccaacatccacagccgggccggccgggagttccacaagcccctggtgaaggagggcgctgaccggccccggcagatccacttccgctggaactag

SEQ ID NO: 149203 - DNA, 2097 bp, Artificial Sequence
  Description of Artificial Sequence: Synthetic coding sequence
atgcaggatgacctgctgatggacaagagcaagacccagccccagccccagcagcagcagaggcagcagcagcagccccagcctgagagctctgtgtctgaggcccccagcacccccctgagcagcgagacccccaagccagaagaaaattctgctgtgcctgccctgagccctgctgctgcccccccagcccccaacggccctgacaagatgcagatggagagccccctgctgcccggcctgtccttccaccagcccccccagcagcccccaccaccccaggagcctgctgcccctggggccagcctgagccccagctttggcagcacctggagcacaggcaccaccaatgctgtggaggacagcttcttccagggcatcacccctgtgaatggcaccatgctgttccagaacttcccccaccacgtgaaccctgtgtttggaggcaccttcagcccccagatcggcctggcccagacccagcaccaccagcagcccccacctccagccccagccccccagcctgcccagcctgcccagcccccccaggcccagcccccccagcagaggaggagccctgccagccccagccaggccccctatgcccagaggtctgctgctgctgcctacggccaccagcccatcatgaccagcaagcccagcagcagcagcgctgtggccgctgctgctgctgctgctgctgccagcagcgccagcagctcctggaacacccaccagagcgtgaatgctgcctggagcgcccccagcaacccctggggcggcctgcaggccggccgggaccccaggagagctgtgggcgtgggcgtgggcgtgggcgtgggcgtgcccagccccctgaaccccatcagccccctgaagaagcccttcagcagcaatgtgattgccccacccaagttccccagggctgcccccctgaccagcaagtcctggatggaggacaatgccttcagaacagacaatggaaacaacctgctgcccttccaggacaggagccggccctatgacaccttcaacctgcacagcctggagaacagcctgatggacatgatcagaacagaccacgagcccctgaagggcaagcactacccacccagcggcccccccatgagctttgctgacatcatgtggaggaaccactttgctggccgcatgggcatcaacttccaccaccctggaacagacaacatcatggccctgaacaatgccttcctggatgacagccatggagaccaggccctgagcagcggcctgagcagccccacccgctgccagaatggagagcgggtggagcgctacagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcctggaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacaatgacatcgacaagagggtggaggtgaagccctacgtgctggatgaccagatgtgtgatgagtgccagggcacccgctgtggcggcaagtttgcccccttcttctgtgccaacgtgacctgcctgcagtactactgtgagtactgctgggccagcatccacagccgggccggccgggagttccacaagcccctggtgaaggagggcggggaccggcccaggcatgtgcccttccgctggagctag

SEQ ID NO: 149204 - DNA, 2055 bp, Artificial Sequence
  Description of Artificial Sequence: Synthetic coding sequence
atgcaggatgacctgctgatggacaagagcaagacccagccccagccccagcagcagcagaggcagcagcagcagccccagcctgagagctctgtgtctgaggcccccagcacccccctgagcagcgagacccccaagccagaagaaaattctgctgtgcctgccctgagccctgctgctgcccccccagcccccaacggccctgacaagatgcagatggagagccccctgctgcccggcctgtccttccaccagcccccccagcagcccccaccaccccaggagcctgctgcccctggggccagcctgagccccagctttggcagcacctggagcacaggcaccaccaatgctgtggaggacagcttcttccagggcatcacccctgtgaatggcaccatgctgttccagaacttcccccaccacgtgaaccctgtgtttggaggcaccttcagcccccagatcggcctggcccagacccagcaccaccagcagcccccacctccagccccagccccccagcctgcccagcctgcccagcccccccaggcccagcccccccagcagaggaggagccctgccagccccagccaggccccctatgcccagaggtctgctgctgctgcctacggccaccagcccatcatgaccagcaagcccagcagcagcagcgctgtggccgctgctgctgctgctgctgctgccagcagcgccagcagctcctggaacacccaccagagcgtgaatgctgcctggagcgcccccagcaacccctggggcggcctgcaggccggccgggaccccaggagagctgtgggcgtgggcgtgggcgtgggcgtgggcgtgcccagccccctgaaccccatcagccccctgaagaagcccttcagcagcaatgtgattgccccacccaagttccccagggctgcccccctgaccagcaagtcctggatggaggacaatgccttcagaacagacaatggaaacaacctgctgcccttccaggacaggagccggccctatgacaccttcaacctgcacagcctggagaacagcctgatggacatgatcagaacagaccacgagcccctgaagggccgcatgggcatcaacttccaccaccctggaacagacaacatcatggccctgaacagccgcagcagcctcttcccctttgaagatgccttcctggatgacagccatggagaccaggccctgagcagcggcctgagcagccccacccgctgccagaatggagagcgggtggagcgctacagcaggaaggtgtttgtgggcggcctgcccccagacattgatgaagatgagatcacagccagcttccgccgcttcggccccctggtggtggactggccccacaaggccgagagcaagagctacttcccccccaagggctacgccttcctgctcttccaggaggagagctctgtgcaggccctgattgatgcctgcctggaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacaatgacatcgacaagagggtggaggtgaagccctacgtgctggatgaccagatgtgtgatgagtgccagggcacccgctgtggcggcaagtttgcccccttcttctgtgccaacgtgacctgcctgcagtactactgtgagtactgctgggccagcatccacagccgggccggccgggagttccacaagcccctggtgaaggagggcggggaccggcccaggcatgtgcccttccgctggagctag

SEQ ID NO: 149205 - DNA, 2055 bp, Artificial Sequence; identical to SEQ ID NO: 149204
  Description of Artificial Sequence: Synthetic coding sequence

SEQ ID NO: 149206 - DNA, 2190 bp, Artificial Sequence
  Description of Artificial Sequence: Synthetic coding sequence
atgggagactatggcttcggcgtgctggtgcagagcaacacaggcaacaagagcgccttccctgtgcgcttccacccccacctgcagcccccccaccaccaccagaatgccacccccagccctgctgccttcatcaacaacaacacagctgccaacggcagcagcgctggcagcgcctggctgtttcctgccccagccacccacaacatccaggatgagatcctgggcagcgagaaggccaagagccagcagcaggagcagcaggaccccctggagaagcagcagctgagccccagccctggccaggaggccggcatcctgcctgagacagagaaggccaagtctgaggagaaccagggcgacaacagcagtgaaaatggaaatggcaaggagaagatcagaattgagagccctgtgctgactggatttgactaccaggaggccaccggcctgggcaccagcacccagcccctgaccagcagcgccagcagcctgaccggcttcagcaactggagcgctgccatcgcccccagcagcagcaccatcatcaatgaagatgccagcttcttccaccagggcggcgtgcctgctgccagcgccaacaacggggccctgctcttccagaacttcccccaccacgtgtccccaggctttggaggcagcttcagcccccagatcggccccctgagccagcaccacccccaccacccccacttccagcaccaccacagccagcaccagcagcagaggaggagccctgccagcccccaccccccacccttcacccacagaaatgctgccttcaaccagctgccccacctggccaacaacctgaacaagccacccagcccctggagcagctaccagagccccagccccacccccagcagctcctggagccctgggggcggcggctacggcggctggggcggcagccagggccgggaccaccggcggggcctgaatggaggcatcacccccctgaacagcatcagccccctgaagaagaactttgccagcaaccacatccagctgcagaagtatgcccggcccagcagcgcctttgcccccaagtcctggatggaggacagcctgaacagagctgacaacatcttccccttcccagaccggcccaggacctttgacatgcacagcctggagagcagcctgattgacatcatgagagcagaaaatgacaccatcaagggccgcctgaactacagctacccaggcagtgacagcagcctgctgatcaatgcccggacctatggaagaagaagaggccagagcagcctcttccccatggaggatggcttcctggatgatggccgcggggaccagcccctgcacagcggcctgggcagcccccactgcttcagccaccagaatggagagcgggtggagcgctacagcaggaaggtgtttgtgggcggcctgcccccagacattgatgaagatgagatcacagccagcttcagaagatttggccccctgattgtggactggccccacaaggccgagagcaagagctacttcccccccaagggctacgccttcctgctcttccaggatgagagctctgtgcaggccctgattgatgcctgcatcgaggaggatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggggccggccgggtggccttcagcaaccagcagagctacatcgccgccatcagcgccaggtttgtgcagctgcagcacggggagattgacaagagggtggaggtgaagccctacgtgctggatgaccagctgtgtgatgagtgccagggcgcccgctgtggcggcaagtttgcccccttcttctgtgccaacgtgacctgcctgcagtactactgtgagtactgctgggccgccatccacagcagagctggccgggagttccacaagcccctggtgaaggagggcggggaccggcccaggcacatctccttccgctggaactag

SEQ ID NO: 149207 - DNA, 2139 bp, Artificial Sequence
  Description of Artificial Sequence: Synthetic coding sequence
atgggagactatggcttcggcgtgctggtgcagagcaacacaggcaacaagagcgccttccctgtgcgcttccacccccacctgcagcccccccaccaccaccagaatgccacccccagccctgctgccttcatcaacaacaacacagctgccaacggcagcagcgctggcagcgcctggctgtttcctgccccagccacccacaacatccaggatgagatcctgggcagcgagaaggccaagagccagcagcaggagcagcaggaccccctggagaagcagcagctgagccccagccctggccaggaggccggcatcctgcctgagacagagaaggccaagtctgaggagaaccagggcgacaacagcagtgaaaatggaaatggcaaggagaagatcagaattgagagccctgtgctgactggatttgactaccaggaggccaccggcctgggcaccagcacccagcccctgaccagcagcgccagcagcctgaccggcttcagcaactggagcgctgccatcgcccccagcagcagcaccatcatcaatgaagatgccagcttcttccaccagggcggcgtgcctgctgccagcgccaacaacggggccctgctcttccagaacttcccccaccacgtgtccccaggctttggaggcagcttcagcccccagatcggccccctgagccagcaccacccccaccacccccacttccagcaccaccacagccagcaccagcagcagaggaggagccctgccagcccccaccccccacccttcacccacagaaatgctgccttcaaccagctgccccacctggccaacaacctgaacaagccacccagcccctggagcagctaccagagccccagccccacccccagcagctcctggagccctgggggcggcggctacggcggctggggcggcagccagggccgggaccaccggcggggcctgaatggaggcatcacccccctgaacagcatcagccccctgaagaagaactttgccagcaaccacatccagctgcagaagtatgcccggcccagcagcgcctttgcccccaagtcctggatggaggacagcctgaacagagctgacaacatcttccccttcccagaccggcccaggacctttgacatgcacagcctggagagcagcctgattgacatcatgagagcagaaaatgacaccatcaaggcccggacctacggcagaagaagaggccagagcagcctcttccccatggaggatggcttcctggatgatggccgcggggaccagcccctgcacagcggcctgggcagcccccactgcttcagccaccagaatggagagcgggtggagcgctacagcaggaaggtgtttgtgggcggcctgcccccagacattgatgaagatgagatcacagccagcttccgccgcttcggccccctcatcgtggactggccccacaaggccgagagcaagagctacttcccccccaagggctacgccttcctgctcttccaggatgagagctctgtgcaggccctgattgatgcctgcattgaagaagatggcaagctgtacctgtgtgtgagcagccccaccatcaaggacaagcctgtgcagatccggccctggaacctgagtgacagcgactttgtgatggatggcagccagcccctggaccccaggaagaccatctttgtgggcggcgtgccccggcccctgcgggctgtggagctggccatgatcatggaccggctgtatggaggagtgtgctacgccggcatcgacacagatcctgagctgaagtaccccaagggagctggccgggtggccttcagcaaccagcagagctacatcgccgccatcagcgccaggtttgtgcagctgcagcacggggagattgacaagagggtggaggtgaagccctacgtgctggatgaccagctgtgtgatgagtgccagggcgcccgctgtggcggcaagtttgcccccttcttctgtgccaacgtgacctgcctgcagtactactgtgagtactgctgggccgccatccacagccgggccggccgggagttccacaagcccctggtgaaggagggcggggaccggcccaggcacatctccttccgctggaactag

SEQ ID NO: 149208 - DNA, 2049 bp, Artificial Sequence
  Description of Artificial Sequence: Synthetic coding sequence
atgagcaccccagctgtgccccaggacctgcagctgccccccagccagagggcccagagcgccttcaaggagcagaggcggcagaagctgaaggagcacctgctgcggaggaagaccctgtttgcctacaagcaggagaatgagatgctgagcagccgggaccagagggtggtgaccagcgaggaccaggtgcaggagggcaccaaggtgctgaagctgaagaccaagatggctgacaaggagaacatgaagaggcctgctgagagcaagaacaacacagtggtgggcaagcactgcatccccctgaagcccagcaatgagctgaccaacagcacagtggtgattgacacccacaagcccaaggacagcaaccagaccccccacctgctgctgacagaagatgacccccagagccagcacatgaccctgagccaggccttccacctgaagaacaacagcaagaagaagcagatgaccacagagaagcagaagcaggatgccaacatgcccaagaagcctgtgctgggcagctaccggggccagatcgtgcagagcaagatcaacagcttcaggaagcccctgcaggtgaaggatgagagcagcgctgccaccaagaagctgagcgccaccatccccaaggccaccaagccccagcctgtgaacaccagctctgtgacagtgaagagcaacagaagcagcaacatgacagccaccaccaagtttgtgtccaccaccagccagaacacccagctggtgcggccccccatccgcagccaccacagcaacacccgggacacagtgaagcagggcatcagcaggaccagcgccaacgtgaccatcaggaagggcccccatgagaaggagctgctgcagagcaagacagccctgagctctgtgaagaccagcagcagccagggcatcatccggaacaagaccctgagccgcagcatcgccagcgaggtgattgcccggcctgccagcctgagcaatgacaagctgatggagaagtctgagcctgtggaccagaggaggcacacagctgggaaggccatcgtggacagccgcagcgcccagcccaaggagaccagcgaggagaggaaggcccggctgtctgagtggaaggccggcaagggccgggtgctgaagaggcctcccaacagcgtggtgacccagcacgagcctgctggccagaatgagaagcctgtgggcagcttctggaccaccatggccgaggaggatgagcagaggctcttcacagagaaggtgaacaacaccttcagcgagtgcctgaacctgatcaatgaaggctgccccaaggaggacatcctggtgaccctgaatgacctgatcaagaacatcccagatgccaagaagctggtgaagtactggatctgcctggccctgattgagcccatcaccagccccatcgagaacatcatcgccatctatgagaaggccatcctggccggggcccagcccatcgaggagatgaggcacaccatcgtggacatcctgaccatgaagagccaggagaaggccaacctgggggagaacatggagaagagctgtgccagcaaggaggaggtgaaggaggtgtccattgaagatactggagtggatgtggaccctgagaagctggagatggagagcaagctgcacaggaacctgctcttccaggactgtgagaaggagcaggacaacaagaccaaggaccccacccatgatgtgaagacccccaacacagagaccaggaccagctgcctgatcaagtacaacgtgtccaccaccccctacctgcagagcgtgaagaagaaggtgcagtttgatggcaccaacagcgccttcaaggagctgaagttcctgacccctgtgagaagaagccggcggctgcaggagaagaccagcaagctgcctgacatgctgaaggaccactacccctgtgtgagcagcctggagcagctgacagagctgggccgggagacagatgcctttgtgtgccggcccaatgctgccctgtgccgggtgtactatgaagctgacaccacctag

SEQ ID NO: 149209 - DNA, 1485 bp, Artificial Sequence
  Description of Artificial Sequence: Synthetic coding sequence
atgagcaccccagctgtgccccaggacctgcagctgccccccagccagagggcccagagcgccttcaaggagcagaggcggcagaagctgaaggagcacctgctgcggaggaagaccctgtttgcctacaagcaggagaatgagatgctgagcagccgggaccagagggtggtgaccagcgaggaccaggtgcaggagggcaccaaggtgctgaagctgaagaccaagatggctgacaaggagaacatgaagaggcctgctgagagcaagaacaacacagtggtgggcaagcactgcatccccctgaagcccagcaatgagctgaccaacagcacagtggtgattgacacccacaagcccaaggacagcaaccagaccccccacctgctgctgacagaagatgacccccagagccagcacatgaccctgagccaggccttccacctgaagaacaacagcaagaagaagcagatgaccacagagaagcagaagcaggatgccaacatgcccaagaagcctgtgctgggcagctaccggggccagatcgtgcagagcaagatcaacagcttcaggaagcccctgcaggtgaaggatgagagcagcgctgccaccaagaagctgagcgccaccatccccaaggccaccaagccccagcctgtgaacaccagctctgtgacagtgaagagcaacagaagcagcaacatgacagccaccaccaagtttgtgtccaccaccagccagaacacccagctggtgcggccccccatccgcagccaccacagcaacacccgggacacagtgaagcagggcatcagcaggaccagcgccaacgtgaccatcaggaagggcccccatgagaaggagctgctgcagagcaagacagccctgagctctgtgaagaccagcagcagccagggcatcatccggaacaagaccctgagccgcagcatcgccagcgaggtgattgcccggcctgccagcctgagcaatgacaagctgatggagaagtctgagcctgtggaccagaggaggcacacagctgggaaggccatcgtggacagccgcagcgcccagcccaaggagaccagcgaggagaggaaggcccggctgtctgagtggaaggccggcaagggccgggtgctgaagaggcctcccaacagcgtggtgacccagcacgagcctgctggccagaatgagaagcctgtgggcagcttctggaccaccatggccgaggaggatgagcagaggctcttcacagagaaggtgaacaacaccttcagcgagtgcctgaacctgatcaatgaaggctgccccaaggaggacatcctggtgaccctgaatgacctgatcaagaacatcccagatgccaagaagctggtgaagtactggatctgcctggccctgattgagcccatcaccagccccatcgagaacatcatcgccatctatgagaaggccatcctggccggggcccaggtgaggtag

SEQ ID NO: 149210 - DNA, 2052 bp, Artificial Sequence
  Description of Artificial Sequence: Synthetic coding sequence
atgagcaccccagctgtgccccaggacctgcagctgccccccagccagagggcccagagcgccttcaaggagcagaggcggcagaagctgaaggagcacctgctgcggaggaagaccctgtttgcctacaagcaggagaatgagatgctgagcagcagccgggaccagagggtggtgaccagcgaggaccaggtgcaggagggcaccaaggtgctgaagctgaagaccaagatggctgacaaggagaacatgaagaggcctgctgagagcaagaacaacacagtggtgggcaagcactgcatccccctgaagcccagcaatgagctgaccaacagcacagtggtgattgacacccacaagcccaaggacagcaaccagaccccccacctgctgctgacagaagatgacccccagagccagcacatgaccctgagccaggccttccacctgaagaacaacagcaagaagaagcagatgaccacagagaagcagaagcaggatgccaacatgcccaagaagcctgtgctgggcagctaccggggccagatcgtgcagagcaagatcaacagcttcaggaagcccctgcaggtgaaggatgagagcagcgctgccaccaagaagctgagcgccaccatccccaaggccaccaagccccagcctgtgaacaccagctctgtgacagtgaagagcaacagaagcagcaacatgacagccaccaccaagtttgtgtccaccaccagccagaacacccagctggtgcggccccccatccgcagccaccacagcaacacccgggacacagtgaagcagggcatcagcaggaccagcgccaacgtgaccatcaggaagggcccccatgagaaggagctgctgcagagcaagacagccctgagctctgtgaagaccagcagcagccagggcatcatccggaacaagaccctgagccgcagcatcgccagcgaggtgattgcccggcctgccagcctgagcaatgacaagctgatggagaagtctgagcctgtggaccagaggaggcacacagctgggaaggccatcgtggacagccgcagcgcccagcccaaggagaccagcgaggagaggaaggcccggctgtctgagtggaaggccggcaagggccgggtgctgaagaggcctcccaacagcgtggtgacccagcacgagcccgccggccagaatgagaagcctgtgggcagcttctggaccaccatggccgaggaggatgagcagaggctcttcacagagaaggtgaacaacaccttctctgaatgtctgaacctgatcaatgaaggctgccccaaggaggacatcctggtgaccctgaatgacctgatcaagaacatcccagatgccaagaagctggtgaagtactggatctgcctggccctgattgagcccatcaccagccccatcgagaacatcatcgccatctatgagaaggccatcctggccggggcccagcccatcgaggagatgaggcacaccatcgtggacatcctgaccatgaagagccaggagaaggccaacctgggggagaacatggagaagagctgtgccagcaaggaggaggtgaaggaggtgtccattgaggacaccggggtggatgtggaccctgagaagctggagatggagagcaagctgcacaggaacctgctcttccaggactgtgagaaggagcaggacaacaagaccaaggaccccacccatgatgtgaagacccccaacacagagaccaggaccagctgcctgatcaagtacaacgtgtccaccaccccctacctgcagagcgtgaagaagaaggtgcagtttgatggcaccaacagcgccttcaaggagctgaagttcctgacccctgtgcggcgcagccggcggctgcaggagaagaccagcaagctgcctgacatgctgaaggaccactacccctgtgtgagcagcctggagcagctgacagagctgggccgggagacagatgcctttgtgtgccggcccaatgctgccctgtgccgggtgtactatgaggccgacaccacctag

SEQ ID NO: 149211 - DNA, 1488 bp, Artificial Sequence
  Description of Artificial Sequence: Synthetic coding sequence
atgagcaccccagctgtgccccaggacctgcagctgccccccagccagagggcccagagcgccttcaaggagcagaggcggcagaagctgaaggagcacctgctgcggaggaagaccctgtttgcctacaagcaggagaatgagatgctgagcagcagccgggaccagagggtggtgaccagcgaggaccaggtgcaggagggcaccaaggtgctgaagctgaagaccaagatggctgacaaggagaacatgaagaggcctgctgagagcaagaacaacacagtggtgggcaagcactgcatccccctgaagcccagcaatgagctgaccaacagcacagtggtgattgacacccacaagcccaaggacagcaaccagaccccccacctgctgctgacagaagatgacccccagagccagcacatgaccctgagccaggccttccacctgaagaacaacagcaagaagaagcagatgaccacagagaagcagaagcaggatgccaacatgcccaagaagcctgtgctgggcagctaccggggccagatcgtgcagagcaagatcaacagcttcaggaagcccctgcaggtgaaggatgagagcagcgctgccaccaagaagctgagcgccaccatccccaaggccaccaagccccagcctgtgaacaccagctctgtgacagtgaagagcaacagaagcagcaacatgacagccaccaccaagtttgtgtccaccaccagccagaacacccagctggtgcggccccccatccgcagccaccacagcaacacccgggacacagtgaagcagggcatcagcaggaccagcgccaacgtgaccatcaggaagggcccccatgagaaggagctgctgcagagcaagacagccctgagctctgtgaagaccagcagcagccagggcatcatccggaacaagaccctgagccgcagcatcgccagcgaggtgattgcccggcctgccagcctgagcaatgacaagctgatggagaagtctgagcctgtggaccagaggaggcacacagctgggaaggccatcgtggacagccgcagcgcccagcccaaggagaccagcgaggagaggaaggcccggctgtctgagtggaaggccggcaagggccgggtgctgaagaggcctcccaacagcgtggtgacccagcacgagcccgccggccagaatgagaagcctgtgggcagcttctggaccaccatggccgaggaggatgagcagaggctcttcacagagaaggtgaacaacaccttctctgaatgtctgaacctgatcaatgaaggctgccccaaggaggacatcctggtgaccctgaatgacctgatcaagaacatcccagatgccaagaagctggtgaagtactggatctgcctggccctgattgagcccatcaccagccccatcgagaacatcatcgccatctatgagaaggccatcctggccggggcccagcacatctag

SEQ ID NO: 149212 - DNA, 5919 bp, Artificial Sequence
  Description of Artificial Sequence: Synthetic coding sequence
atgggagatgattctgagtggctgaagctgcctgtggaccagaagtgtgagcacaagctgtggaaggcccggctgagcggctatgaggaggccctgaagatcttccagaagatcaaggatgagaagagccctgagtggagcaagttcctgggcctcatcaagaagtttgtgacagacagcaatgctgtggtgcagctgaagggcctggaggccgccctggtgtatgtggagaatgcccacgtggccggcaagaccaccggggaggtggtgtctggagtggtgtccaaggtgttcaaccagcccaaggccaaggccaaggagctgggcatcgagatctgcctgatgtacattgaaattgaaaaaggagaggccgtgcaggaggagctgctgaagggcctggacaacaagaaccccaagatcatcgtggcctgcatcgagaccctgaggaaggccctgtctgaatttggcagcaagatcatcctgctgaagcccatcatcaaggtgctgcccaagctgtttgagagccgggagaaggctgtgagagatgaggccaagctgattgctgtggagatctaccgctggatcagagatgccctgcggccccccctgcagaacatcaacagcgtgcagctgaaggagctggaggaggagtgggtgaagctgcccaccagcgccccccggcccacccgcttcctgcggagccagcaggagctggaggccaagctggagcagcagcagagcgctggaggagatgctgagggcggcggagatgatggagatgaggtgccccagattgatgcctatgagctgctggaggccgtggagatcctgagcaagctgcccaaggacttctatgacaagattgaggccaagaagtggcaggagaggaaggaggccctggagagcgtggaggtgctgatcaagaaccccaagctggaggccggggactatgctgacctggtgaaggccctgaagaaggtggtgggcaaggacaccaacgtgatgctggtggccctggccgccaagtgcctgaccggcctggccgtgggcctgaggaagaagtttggccagtatgccggccacgtggtgcccaccatcctggagaagttcaaggagaagaagccccaggtggtgcaggccctgcaggaggccattgatgccatcttcctgaccaccaccctgcagaacatcagtgaagatgtgctggccgtgatggacaacaagaaccccaccatcaagcagcagaccagcctcttcatcgcccgctccttccgccactgcacagccagcaccctgcccaagagcctgctgaagcccttctgtgccgccctgctgaagcacatcaatgattctgcccctgaggtgagagatgctgcctttgaggccctgggcacagccctgaaggtggtgggggagaaggctgtgaaccccttcctggctgatgtggacaagctgaagctggacaagatcaaggagtgcagcgagaaggtggagctgattcatggcaagaaggccggcctggccgctgacaagaaggagttcaagcccctgcccggccgcacagctgccagcggggctgctggggacaaggacaccaaggacatcagcgcccccaagccaggccccctgaagaaggccccagctgccaaggccggcggcccccccaagaagggcaagccagctgcccctggaggagctggcaacacaggcaccaagaacaagaagggcctggagaccaaggagatcgtggagcctgagctgagcattgaggtgtgtgaggagaaggccagcgctgtgctgccccccacctgcatccagctgctggacagcagcaactggaaggagcggctggcctgcatggaggagttccagaaggctgtggagctgatggacagaacagagatgccctgccaggccctggtgaggatgctggccaagaagccaggctggaaggagaccaacttccaggtgatgcagatgaagctgcacatcgtggccctgattgcccagaagggcaacttcagcaagaccagcgcccaggtggtgctggatggcctggtggacaagattggagatgtgaagtgtggcaacaatgccaaggaggccatgacagccatcgccgaggcctgcatgctgccctggacagctgagcaggtggtgtccatggccttcagccagaagaaccccaagaaccagagcgagaccctgaactggctgagcaatgccatcaaggagtttggcttcagcggcctgaatgtgaaggccttcatcagcaatgtgaagacagccctggccgccaccaacccagctgtgaggacagctgccatcaccctgctgggcgtgatgtacctgtatgtgggccccagcctgaggatgttctttgaagatgagaagccagccctgctgagccagattgatgctgagtttgagaagatgcagggccagagccccccagcccccacccggggcatcagcaagcacagcaccagcggcacagatgaaggagaagatggagatgagccagatgatggcagcaatgatgtggtggacctgctgcccaggacagagatcagtgacaagatcaccagcgagctggtgtccaagattggagacaagaactggaagatcaggaaggagggcctggatgaggtggccggcatcatcaatgatgccaagttcatccagcccaacatcggggagctgcccacagccctgaagggccgcctgaatgacagcaacaagatcctggtgcagcagaccctgaacatcctgcagcagctggccgtggccatgggccccaacatcaagcagcacgtgaagaacctgggcatccccatcatcaccgtgctgggggacagcaagaacaacgtgcgggccgccgccctggccaccgtgaatgcctgggccgagcagacaggcatgaaggagtggctggagggggaggacctgtctgaggagctgaagaaggagaaccccttcctgcggcaggagctgctgggctggctggccgagaagctgcccaccctgcggagcacccccacagacctgatcctgtgtgtgccccacctgtacagctgcctggaggacagaaatggagatgtgaggaagaaggcccaggatgccctgcccttcttcatgatgcacctgggctatgagaagatggccaaggccaccgggaagctgaagcccaccagcaaggaccaggtgctggccatgctggagaaggccaaggtgaacatgcctgccaagccagccccacccaccaaggccaccagcaagcccatgggcggcagcgccccagccaagttccagcctgccagcgccccagctgaggactgcatcagcagcagcacagagcccaagccagaccccaagaaggccaaggcccctggcctgagcagcaaggccaagagcgcccagggcaagaagatgcccagcaagaccagcctgaaggaggatgaggacaagagcggccccatcttcatcgtggtgcccaacgggaaggagcagaggatgaaggatgagaagggcctgaaggtgctgaagtggaacttcaccaccccaagagatgagtacatcgagcagctgaagacccagatgagcagctgtgtggccaagtggctgcaggatgagatgttccacagcgacttccagcaccacaacaaggccctggccgtgatggtggaccacctggagagcgagaaggagggcgtgattggctgcctggacctgatcctgaagtggctgaccctgcgcttctttgacaccaacacctctgtgctgatgaaggccctggagtacctgaagctgctcttcaccctgctgtctgaggaggagtaccacctgacagaaaatgaggccagcagcttcatcccctacctggtggtgaaggtgggggagcccaaggatgtgatcaggaaggatgtgcgggccatcctgaacaggatgtgcctggtgtacccagccagcaagatgttccccttcatcatggagggcaccaagagcaagaacagcaagcagagagcagaatgtctggaggagctgggctgcctggtggagagctatggcatgaatgtgtgccagcccacccctgggaaggccctgaaggagattgctgtgcacatcggggaccgggacaatgctgtgagaaatgctgccctgaacaccatcgtgacagtgtacaacgtgcatggagaccaggtgttcaagctgattggcaacctgtctgagaaggacatgtccatgctggaggagcgcatcaagaggtctgccaagaggcccagcgctgcccccatcaagcaggtggaggagaagccccagagggcccagaacatcagcagcaatgccaacatgctgaggaagggccctgctgaggacatgagcagcaagctgaaccaggcccgctccatgagcggccaccctgaggccgcccagatggtgagaagagagttccagctggacctggatgaaattgaaaatgacaatggaacagtgcgctgtgagatgcctgagctggtgcagcacaagctggatgacatctttgagcctgtgctgatccctgagcccaagatccgggctgtgagcccccactttgatgacatgcacagcaacacagccagcaccatcaacttcatcatcagccaggtggccagcggggacatcaacaccagcatccaggccctgacccagctgttccagatcgagagcctggcccgggaggccagcactggagtgctgaaggacctgatgcacggcctcatcaccctgatgctggacagcagaattgaggacctggaggagggccagcaggtgatccgctctgtgaacctgctggtggtgaaggtgctggagaagagtgaccagaccaacatcctgagcgccctgctggtgctgctgcaggacagcctgctggccacagccagcagccccaagttcagcgagctggtgatgaagtgcctgtggaggatggtgcggctgctgcctgacaccatcaacagcatcaacctggaccgcatcctgctggacatccacatcttcatgaaggtgttccccaaggagaagctgaagcagtgcaagtctgagttccccatccgcaccctgaagaccctgctgcacaccctgtgcaagctgaagggccccaagatcctggaccacctgaccatgattgacaacaagaatgaaagtgagctggaggcccacctgtgcaggatgatgaagcacagcatggaccagacaggcagcaagagtgacaaggagacagagaagggggccagcagaattgatgagaagagcagcaaggccaaggtgaatgacttcctggccgagatcttcaagaagattggcagcaaggagaacaccaaggagggcctggccgagctgtatgagtacaagaagaagtacagtgatgctgacatcgagcccttcctgaagaacagcagccagttcttccagagctatgtggagcggggcctgcgggtgattgagatggagcgggagggcaagggccgcatcagcaccagcacaggcatcagcccccagatggaggtgacctgtgtgcccacccccaccagcacagtgagcagcatcggcaacaccaacggggaggaggtgggccccagcgtgtacctggagcggctgaagatcctgcggcagagatgtggcctggacaacaccaagcaggatgacaggcctcccctgaccagcctgctgagcaagccagctgtgcccaccgtggccagcagcacagacatgctgcacagcaagctgagccagctgcgggagagccgggagcagcaccagcacagcgacctggacagcaaccagacccacagcagcggcaccgtgaccagcagcagcagcacagccaacattgatgacctgaagaagaggctggagcgcatcaagagcagcaggaagtag

SEQ ID NO: 149213 - DNA, 5919 bp, Artificial Sequence; identical to SEQ ID NO: 149212
  Description of Artificial Sequence: Synthetic coding sequence

SEQ ID NO: 149214 - DNA, 906 bp, Artificial Sequence
  Description of Artificial Sequence: Synthetic coding sequence
atgggagatgattctgagtggctgaagctgcctgtggaccagaagtgtgagcacaagctgtggaaggcccggctgagcggctatgaggaggccctgaagatcttccagaagatcaaggatgagaagagccctgagtggagcaagttcctgggcctcatcaagaagtttgtgacagacagcaatgctgtggtgcagctgaagggcctggaggccgccctggtgtatgtggagaatgcccacgtggccggcaagaccaccggggaggtggtgtctggagtggtgtccaaggtgttcaaccagcccaaggccaaggccaaggagctgggcatcgagatctgcctgatgtacattgaaattgaaaaaggagaggccgtgcaggaggagctgctgaagggcctggacaacaagaaccccaagatcatcgtggcctgcatcgagaccctgaggaaggccctgtctgaatttggcagcaagatcatcctgctgaagcccatcatcaaggtgctgcccaagctgtttgagagccgggagaaggctgtgagagatgaggccaagctgattgctgtggagatctaccgctggatcagagatgccctgcggccccccctgcagaacatcaacagcgtgcagctgaaggagctggaggaggagtgggtgaagctgcccaccagcgccccccggcccacccgcttcctgcggagccagcaggagctggaggccaagctggagcagcagcagagcgctggaggagatgctgagggcggcggagatgatggagatgaggtgccccagattgatgcctatgagctgctggaggccgtggagatcctgagcaagcccaagaccttcatgaccaagctgcggcagaagaatggcaagcgggagaagaggccctggagcctgtag

SEQ ID NO: 149215 - DNA, 6120 bp, Artificial Sequence
  Description of Artificial Sequence: Synthetic coding sequence
atgggagatgattctgagtggctgaagctgcctgtggaccagaagtgtgagcacaagctgtggaaggcccggctgagcggctatgaggaggccctgaagatcttccagaagatcaaggatgagaagagccctgagtggagcaagttcctgggcctcatcaagaagtttgtgacagacagcaatgctgtggtgcagctgaagggcctggaggccgccctggtgtatgtggagaatgcccacgtggccggcaagaccaccggggaggtggtgtctggagtggtgtccaaggtgttcaaccagcccaaggccaaggccaaggagctgggcatcgagatctgcctgatgtacattgaaattgaaaaaggagaggccgtgcaggaggagctgctgaagggcctggacaacaagaaccccaagatcatcgtggcctgcatcgagaccctgaggaaggccctgtctgaatttggcagcaagatcatcctgctgaagcccatcatcaaggtgctgcccaagctgtttgagagccgggagaaggctgtgagagatgaggccaagctgattgctgtggagatctaccgctggatcagagatgccctgcggccccccctgcagaacatcaacagcgtgcagctgaaggagctggaggaggagtgggtgaagctgcccaccagcgccccccggcccacccgcttcctgcggagccagcaggagctggaggccaagctggagcagcagcagagcgctggaggagatgctgagggcggcggagatgatggagatgaggtgccccagattgatgcctatgagctgctggaggccgtggagatcctgagcaagctgcccaaggacttctatgacaagattgaggccaagaagtggcaggagaggaaggaggccctggagagcgtggaggtgctgatcaagaaccccaagctggaggccggggactatgctgacctggtgaaggccctgaagaaggtggtgggcaaggacaccaacgtgatgctggtggccctggccgccaagtgcctgaccggcctggccgtgggcctgaggaagaagtttggccagtatgccggccacgtggtgcccaccatcctggagaagttcaaggagaagaagccccaggtggtgcaggccctgcaggaggccattgatgccatcttcctgaccaccaccctgcagaacatcagtgaagatgtgctggccgtgatggacaacaagaaccccaccatcaagcagcagaccagcctcttcatcgcccgctccttccgccactgcacagccagcaccctgcccaagagcctgctgaagcccttctgtgccgccctgctgaagcacatcaatgattctgcccctgaggtgagagatgctgcctttgaggccctgggcacagccctgaaggtggtgggggagaaggctgtgaaccccttcctggctgatgtggacaagctgaagctggacaagatcaaggagtgcagcgagaaggtggagctgattcatggcaagaaggccggcctggccgctgacaagaaggagttcaagcccctgcccggccgcacagctgccagcggggctgctggggacaaggacaccaaggacatcagcgcccccaagccaggccccctgaagaaggccccagctgccaaggccggcggcccccccaagaagggcaagccagctgcccctggaggagctggcaacacaggcaccaagaacaagaagggcctggagaccaaggagatcgtggagcctgagctgagcattgaggtgtgtgaggagaaggccagcgctgtgctgccccccacctgcatccagctgctggacagcagcaactggaaggagcggctggcctgcatggaggagttccagaaggctgtggagctgatggacagaacagagatgccctgccaggccctggtgaggatgctggccaagaagccaggctggaaggagaccaacttccaggtgatgcagatgaagctgcacatcgtggccctgattgcccagaagggcaacttcagcaagaccagcgcccaggtggtgctggatggcctggtggacaagattggagatgtgaagtgtggcaacaatgccaaggaggccatgacagccatcgccgaggcctgcatgctgccctggacagctgagcaggtggtgtccatggccttcagccagaagaaccccaagaaccagagcgagaccctgaactggctgagcaatgccatcaaggagtttggcttcagcggcctgaatgtgaaggccttcatcagcaatgtgaagacagccctggccgccaccaacccagctgtgaggacagctgccatcaccctgctgggcgtgatgtacctgtatgtgggccccagcctgaggatgttctttgaagatgagaagccagccctgctgagccagattgatgctgagtttgagaagatgcagggccagagccccccagcccccacccggggcatcagcaagcacagcaccagcggcacagatgaaggagaagatggagatgagccagatgatggcagcaatgatgtggtggacctgctgcccaggacagagatcagtgacaagatcaccagcgagctggtgtccaagattggagacaagaactggaagatcaggaaggagggcctggatgaggtggccggcatcatcaatgatgccaagttcatccagcccaacatcggggagctgcccacagccctgaagggccgcctgaatgacagcaacaagatcctggtgcagcagaccctgaacatcctgcagcagctggccgtggccatgggccccaacatcaagcagcacgtgaagaacctgggcatccccatcatcaccgtgctgggggacagcaagaacaacgtgcgggccgccgccctggccaccgtgaatgcctgggccgagcagacaggcatgaaggagtggctggagggggaggacctgtctgaggagctgaagaaggagaaccccttcctgcggcaggagctgctgggctggctggccgagaagctgcccaccctgcggagcacccccacagacctgatcctgtgtgtgccccacctgtacagctgcctggaggacagaaatggagatgtgaggaagaaggcccaggatgccctgcccttcttcatgatgcacctgggctatgagaagatggccaaggccaccgggaagctgaagcccaccagcaaggaccaggtgctggccatgctggagaaggccaaggtgaacatgcctgccaagccagccccacccaccaaggccaccagcaagcccatgggcggcagcgccccagccaagttccagcctgccagcgccccagctgaggactgcatcagcagcagcacagagcccaagccagaccccaagaaggccaaggcccctggcctgagcagcaaggccaagagcgcccagggcaagaagatgcccagcaagaccagcctgaaggaggatgaggacaagagcggccccatcttcatcgtggtgcccaacgggaaggagcagaggatgaaggatgagaagggcctgaaggtgctgaagtggaacttcaccaccccaagagatgagtacatcgagcagctgaagacccagatgagcagctgtgtggccaagtggctgcaggatgagatgttccacagcgacttccagcaccacaacaaggccctggccgtgatggtggaccacctggagagcgagaaggagggcgtgattggctgcctggacctgatcctgaagtggctgaccctgcgcttctttgacaccaacacctctgtgctgatgaaggccctggagtacctgaagctgctcttcaccctgctgtctgaggaggagtaccacctgacagaaaatgaggccagcagcttcatcccctacctggtggtgaaggtgggggagcccaaggatgtgatcaggaaggatgtgcgggccatcctgaacaggatgtgcctggtgtacccagccagcaagatgttccccttcatcatggagggcaccaagagcaagaacagcaagcagagagcagaatgtctggaggagctgggctgcctggtggagagctatggcatgaatgtgtgccagcccacccctgggaaggccctgaaggagattgctgtgcacatcggggaccgggacaatgctgtgagaaatgctgccctgaacaccatcgtgacagtgtacaacgtgcatggagaccaggtgttcaagctgattggcaacctgtctgagaaggacatgtccatgctggaggagcgcatcaagaggtctgccaagaggcccagcgctgcccccatcaagcaggtggaggagaagccccagagggcccagaacatcagcagcaatgccaacatgctgaggaagggccctgctgaggacatgagcagcaagctgaaccaggcccgctccatgagcggccaccctgaggccgcccagatggtgagaagagagttccagctggacctggatgaaattgaaaatgacaatggaacagtgcgctgtgagatgcctgagctggtgcagcacaagctggatgacatctttgagcctgtgctgatccctgagcccaagatccgggctgtgagcccccactttgatgacatgcacagcaacacagccagcaccatcaacttcatcatcagccaggtggccagcggggacatcaacaccagcatccaggccctgacccagattgatgaggtgctgcggcaggaggacaaggccgaggccatgagcggccacatcgaccagttcctgattgccaccttcatgcagctgcggctcatctacaacacccacatggctgatgagaagctggagaaggatgagatcatcaagctgtacagctgcatcatcggcaacatgatcagcctcttccagatcgagagcctggcccgggaggccagcactggagtgctgaaggacctgatgcacggcctcatcaccctgatgctggacagcagaattgaggacctggaggagggccagcaggtgatccgctctgtgaacctgctggtggtgaaggtgctggagaagagtgaccagaccaacatcctgagcgccctgctggtgctgctgcaggacagcctgctggccacagccagcagccccaagttcagcgagctggtgatgaagtgcctgtggaggatggtgcggctgctgcctgacaccatcaacagcatcaacctggaccgcatcctgctggacatccacatcttcatgaaggtgttccccaaggagaagctgaagcagtgcaagtctgagttccccatccgcaccctgaagaccctgctgcacaccctgtgcaagctgaagggccccaagagctgcatgtgcctgccccagatcctggaccacctgaccatgattgacaacaagaatgaaagtgagctggaggcccacctgtgcaggatgatgaagcacagcatggaccagacaggcagcaagagtgacaaggagacagagaagggggccagcagaattgatgagaagagcagcaaggccaaggtgaatgacttcctggccgagatcttcaagaagattggcagcaaagaaaacaccaaggagggcctggccgagctgtatgagtacaagaagaagtacagtgatgctgacatcgagcccttcctgaagaacagcagccagttcttccagagctatgtggagcggggcctgcgggtcatcgagatggagcgggagggcaagggccgcatcagcaccagcacaggcatcagcccccagatggaggtgacctgtgtgcccacccccaccagcacagtgagcagcatcggcaacaccaatggagaggaggtgggccccagcgtgtacctggagcggctgaagatcctgcggcagagatgtggcctggacaacaccaagcaggatgaccggccccccctgaccagcctgctgagcaagccagctgtgcccaccgtggccagcagcacagacatgctgcacagcaagctgagccagctgcgggagagccgggagcagcaccagcacagcgacctggacagcaaccagacccacagcagcggcaccgtgaccagcagcagcagcacagccaacattgatgacctgaagaagaggctggagcgcatcaagagcagcaggaagtag

SEQ ID NO: 149216 - DNA, 456 bp, Artificial Sequence
  Description of Artificial Sequence: Synthetic coding sequence
atgggagatgattctgagtggctgaagctgcctgtggaccagaagtgtgagcacaagctgtggaaggcccggctgagcggctatgaggaggccctgaagatcttccagaagatcaaggatgagaagagccctgagtggagcaagttcctgggcctcatcaagaagtttgtgacagacagcaatgctgtggtgcagctgaagggcctggaggccgccctggtgtatgtggagaatgcccacgtggccggcaagaccaccggggaggtggtgtctggagtggtgtccaaggtgttcaaccagcccaaggccaaggccaaggagctgggcatcgagatctgcctgatgtacattgaaattgaaaaaggagaggccgtgcaggaggagctgctgaagggcctggacaacaagaaccccaagatcatcgtggcctgcatcgagaccctgaggaaggcctag

SEQ ID NO: 149217 - DNA, 6099 bp, Artificial Sequence
  Description of Artificial Sequence: Synthetic coding sequence
atgggagatgattctgagtggctgaagctgcctgtggaccagaagtgtgagcacaagctgtggaaggcccggctgagcggctatgaggaggccctgaagatcttccagaagatcaaggatgagaagagccctgagtggagcaagttcctgggcctcatcaagaagtttgtgacagacagcaatgctgtggtgcagctgaagggcctggaggccgccctggtgtatgtggagaatgcccacgtggccggcaagaccaccggggaggtggtgtctggagtggtgtccaaggtgttcaaccagcccaaggccaaggccaaggagctgggcatcgagatctgcctgatgtacattgaaattgaaaaaggagaggccgtgcaggaggagctgctgaagggcctggacaacaagaaccccaagatcatcgtggcctgcatcgagaccctgaggaaggccctgtctgaatttggcagcaagatcatcctgctgaagcccatcatcaaggtgctgcccaagctgtttgagagccgggagaaggctgtgagagatgaggccaagctgattgctgtggagatctaccgctggatcagagatgccctgcggccccccctgcagaacatcaacagcgtgcagctgaaggagctggaggaggagtgggtgaagctgcccaccagcgccccccggcccacccgcttcctgcggagccagcaggagctggaggccaagctggagcagcagcagagcgctggaggagatgctgagggcggcggagatgatggagatgaggtgccccagattgatgcctatgagctgctggaggccgtggagatcctgagcaagctgcccaaggacttctatgacaagattgaggccaagaagtggcaggagaggaaggaggccctggagagcgtggaggtgctgatcaagaaccccaagctggaggccggggactatgctgacctggtgaaggccctgaagaaggtggtgggcaaggacaccaacgtgatgctggtggccctggccgccaagtgcctgaccggcctggccgtgggcctgaggaagaagtttggccagtatgccggccacgtggtgcccaccatcctggagaagttcaaggagaagaagccccaggtggtgcaggccctgcaggaggccattgatgccatcttcctgaccaccaccctgcagaacatcagtgaagatgtgctggccgtgatggacaacaagaaccccaccatcaagcagcagaccagcctcttcatcgcccgctccttccgccactgcacagccagcaccctgcccaagagcctgctgaagcccttctgtgccgccctgctgaagcacatcaatgattctgcccctgaggtgagagatgctgcctttgaggccctgggcacagccctgaaggtggtgggggagaaggctgtgaaccccttcctggctgatgtggacaagctgaagctggacaagatcaaggagtgcagcgagaaggtggagctgattcatggcaagaaggccggcctggccgctgacaagaaggagttcaagcccctgcccggccgcacagctgccagcggggctgctggggacaaggacaccaaggacatcagcgcccccaagccaggccccctgaagaaggccccagctgccaaggccggcggcccccccaagaagggcaagccagctgcccctggaggagctggcaacacaggcaccaagaacaagaagggcctggagaccaaggagatcgtggagcctgagctgagcattgaggtgtgtgaggagaaggccagcgctgtgctgccccccacctgcatccagctgctggacagcagcaactggaaggagcggctggcctgcatggaggagttccagaaggctgtggagctgatggacagaacagagatgccctgccaggccctggtgaggatgctggccaagaagccaggctggaaggagaccaacttccaggtgatgcagatgaagctgcacatcgtggccctgattgcccagaagggcaacttcagcaagaccagcgcccaggtggtgctggatggcctggtggacaagattggagatgtgaagtgtggcaacaatgccaaggaggccatgacagccatcgccgaggcctgcatgctgccctggacagctgagcaggtggtgtccatggccttcagccagaagaaccccaagaaccagagcgagaccctgaactggctgagcaatgccatcaaggagtttggcttcagcggcctgaatgtgaaggccttcatcagcaatgtgaagacagccctggccgccaccaacccagctgtgaggacagctgccatcaccctgctgggcgtgatgtacctgtatgtgggccccagcctgaggatgttctttgaagatgagaagccagccctgctgagccagattgatgctgagtttgagaagatgcagggccagagccccccagcccccacccggggcatcagcaagcacagcaccagcggcacagatgaaggagaagatggagatgagccagatgatggcagcaatgatgtggtggacctgctgcccaggacagagatcagtgacaagatcaccagcgagctggtgtccaagattggagacaagaactggaagatcaggaaggagggcctggatgaggtggccggcatcatcaatgatgccaagttcatccagcccaacatcggggagctgcccacagccctgaagggccgcctgaatgacagcaacaagatcctggtgcagcagaccctgaacatcctgcagcagctggccgtggccatgggccccaacatcaagcagcacgtgaagaacctgggcatccccatcatcaccgtgctgggggacagcaagaacaacgtgcgggccgccgccctggccaccgtgaatgcctgggccgagcagacaggcatgaaggagtggctggagggggaggacctgtctgaggagctgaagaaggagaaccccttcctgcggcaggagctgctgggctggctggccgagaagctgcccaccctgcggagcacccccacagacctgatcctgtgtgtgccccacctgtacagctgcctggaggacagaaatggagatgtgaggaagaaggcccaggatgccctgcccttcttcatgatgcacctgggctatgagaagatggccaaggccaccgggaagctgaagcccaccagcaaggaccaggtgctggccatgctggagaaggccaaggtgaacatgcctgccaagccagccccacccaccaaggccaccagcaagcccatgggcggcagcgccccagccaagttccagcctgccagcgccccagctgaggactgcatcagcagcagcacagagcccaagccagaccccaagaaggccaaggcccctggcctgagcagcaaggccaagagcgcccagggcaagaagatgcccagcaagaccagcctgaaggaggatgaggacaagagcggccccatcttcatcgtggtgcccaacgggaaggagcagaggatgaaggatgagaagggcctgaaggtgctgaagtggaacttcaccaccccaagagatgagtacatcgagcagctgaagacccagatgagcagctgtgtggccaagtggctgcaggatgagatgttccacagcgacttccagcaccacaacaaggccctggccgtgatggtggaccacctggagagcgagaaggagggcgtgattggctgcctggacctgatcctgaagtggctgaccctgcgcttctttgacaccaacacctctgtgctgatgaaggccctggagtacctgaagctgctcttcaccctgctgtctgaggaggagtaccacctgacagaaaatgaggccagcagcttcatcccctacctggtggtgaaggtgggggagcccaaggatgtgatcaggaaggatgtgcgggccatcctgaacaggatgtgcctggtgtacccagccagcaagatgttccccttcatcatggagggcaccaagagcaagaacagcaagcagagagcagaatgtctggaggagctgggctgcctggtggagagctatggcatgaatgtgtgccagcccacccctgggaaggccctgaaggagattgctgtgcacatcggggaccgggacaatgctgtgagaaatgctgccctgaacaccatcgtgacagtgtacaacgtgcatggagaccaggtgttcaagctgattggcaacctgtctgagaaggacatgtccatgctggaggagcgcatcaagaggtctgccaagaggcccagcgctgcccccatcaagcaggtggaggagaagccccagagggcccagaacatcagcagcaatgccaacatgctgaggaagggccctgctgaggacatgagcagcaagctgaaccaggcccgctccatgagcggccaccctgaggccgcccagatggtgagaagagagttccagctggacctggatgaaattgaaaatgacaatggaacagtgcgctgtgagatgcctgagctggtgcagcacaagctggatgacatctttgagcctgtgctgatccctgagcccaagatccgggctgtgagcccccactttgatgacatgcacagcaacacagccagcaccatcaacttcatcatcagccaggtggccagcggggacatcaacaccagcatccaggccctgacccagattgatgaggtgctgcggcaggaggacaaggccgaggccatgagcggccacatcgaccagttcctgattgccaccttcatgcagctgcggctcatctacaacacccacatggctgatgagaagctggagaaggatgagatcatcaagctgtacagctgcatcatcggcaacatgatcagcctcttccagatcgagagcctggcccgggaggccagcactggagtgctgaaggacctgatgcacggcctcatcaccctgatgctggacagcagaattgaggacctggaggagggccagcaggtgatccgctctgtgaacctgctggtggtgaaggtgctggagaagagtgaccagaccaacatcctgagcgccctgctggtgctgctgcaggacagcctgctggccacagccagcagccccaagttcagcgagctggtgatgaagtgcctgtggaggatggtgcggctgctgcctgacaccatcaacagcatcaacctggaccgcatcctgctggacatccacatcttcatgaaggtgttccccaaggagaagctgaagcagtgcaagtctgagttccccatccgcaccctgaagaccctgctgcacaccctgtgcaagctgaagggccccaagatcctggaccacctgaccatgattgacaacaagaatgaaagtgagctggaggcccacctgtgcaggatgatgaagcacagcatggaccagacaggcagcaagagtgacaaggagacagagaagggggccagcagaattgatgagaagagcagcaaggccaaggtgaatgacttcctggccgagatcttcaagaagattggcagcaaggagaacaccaaggagggcctggccgagctgtatgagtacaagaagaagtacagtgatgctgacatcgagcccttcctgaagaacagcagccagttcttccagagctatgtggagcggggcctgcgggtgattgagatggagcgggagggcaagggccgcatcagcaccagcacaggcatcagcccccagatggaggtgacctgtgtgcccacccccaccagcacagtgagcagcatcggcaacaccaacggggaggaggtgggccccagcgtgtacctggagcggctgaagatcctgcggcagagatgtggcctggacaacaccaagcaggatgacaggcctcccctgaccagcctgctgagcaagccagctgtgcccaccgtggccagcagcacagacatgctgcacagcaagctgagccagctgcgggagagccgggagcagcaccagcacagcgacctggacagcaaccagacccacagcagcggcaccgtgaccagcagcagcagcacagccaacattgatgacctgaagaagaggctggagcgcatcaagagcagcaggaagtag

SEQ ID NO: 149218 - DNA, 1020 bp, Artificial Sequence
  Description of Artificial Sequence: Synthetic coding sequence
atgaaggacagcctggtgctgctgggccgggtgcctgcccacccagacagccgctgctggttcctggcctggaacccagctggcaccctgctggccagctgtggcggggaccggcgcatccgcatctggggcacagaaggagacagctggatctgcaagtctgtgctgtctgagggccaccagaggacagtgaggaaggtggcctggagcccctgtggcaactacctggccagcgccagctttgatgccaccacctgcatctggaagaagaaccaggatgactttgaatgtgtgaccaccctggagggccatgaaaatgaggtgaagtctgtggcctgggcccccagcggcaacctgctggccacctgcagccgggacaagtctgtgtgggtgtgggaggtggatgaagaagatgaatatgaatgtgtgtctgtgctgaacagccacacccaggatgtgaagcacgtggtgtggcaccccagccaggagctgctggccagcgccagctatgatgacacagtgaagctgtaccgggaggaggaggatgactgggtgtgctgtgccaccctggagggccacgagagcacagtgtggagcctggcctttgaccccagcggccagaggctggccagctgcagtgatgacagaacagtgcgcatctggaggcagtacctgcctggaaatgagcagggcgtggcctgcagcggcagtgaccccagctggaagtgcatctgcaccctgagcggcttccacagcaggaccatctatgacatcgcctggtgccagctgaccggggccctggccacagcctgtggagatgatgccatccgggtcttccaggaggaccccaacagcgacccccagcagcccaccttcagcctgacagcccacctgcaccaggcccacagccaggatgtgaactgtgtggcctggaaccccaaggagcccggcctgctggccagctgcagtgatgatggagaggtggccttctggaagtaccagaggcctgagggcctgtag

SEQ ID NO: 149219 - DNA, 1380 bp, Artificial Sequence
  Description of Artificial Sequence: Synthetic coding sequence
atggccgccagcggggctgtggagcccggccccccaggagctgctgtggcccccagccctgccccagcccctcctccagccccagaccacctgttccggcccatctctgcagaagatgaggagcagcagcccacagaaattgagagcctgtgcatgaactgctactgcaatggcatgacccggctgctgctgaccaagatccccttcttccgggagatcatcgtgtcctccttcagctgtgagcactgcggctggaacaacacagagatccagagcgctggccgcatccaggaccagggcgtgcgctacaccctgtctgtgcgggccctggaggacatgaaccgggaggtggtgaagacagacagcgctgccacccgcatccctgagctggactttgagatcccagccttcagccagaagggggccctgaccaccgtggagggcctcatcacccgggccatcagcggcctggagcaggaccagcctgcccggcgggccaacaaggatgccacagctgagagaattgatgagttcatcgtgaagctgaaggagctgaagcaggtggccagccccttcaccctcatcattgatgaccccagcggcaacagctttgtggagaacccccacgccccccagaaggatgatgccctggtgatcacccactacaacagaacccggcagcaggaggagatgctgggcctgcaggaggaggccccagctgagaagccagaggaggaggacctgagaaatgaggtgctgcagttcagcaccaactgcccagaatgtaatgccccagcccagaccaacatgaagctggtgcagatcccccacttcaaggaggtgatcatcatggccaccaactgtgagaactgtggccacaggaccaatgaggtgaagagcggcggcgctgtggagcccctgggcacccgcatcaccctgcacatcacagatgccagtgacatgacccgggacctgctgaagtctgagacctgcagcgtggagatccctgagctggagtttgagctgggcatggctgtgctgggcggcaagttcaccaccctggagggcctgctgaaggacatccgggagctggtgaccaagaaccccttcaccctgggggacagcagcaaccctggccagacagagcggctgcaggagttcagccagaagatggaccagatcatcgagggcaacatgaaggcccacttcatcatggatgatcctgctggcaacagctacctgcagaatgtgtatgccccagaagatgatcctgagatgaaggtggagcgctacaagaggacctttgaccagaatgaggagctgggcctgaatgacatgaagacagagggctatgaagctggcctggccccccagaggtag

SEQ ID NO: 149220 - DNA, 585 bp, Artificial Sequence
  Description of Artificial Sequence: Synthetic coding sequence
atgtgggtgaagctgctgagcatcgtggccgagttctgcttcagccccttcctggtgacagatgaggagacagccagtgatgccctggagaggaacagcctgagcagccaggacccccagcagcccaccagcacagtgtctgtgacagaggacagcagcaccagcgagattgacaaggaggagaaggagcagaccacccaggaccctgacctgaccacagaggccaacccccagtacctgggcctggccaggaagaagagcggcatcctgctgctgaccctggtgtccttcctgatcttcatcctcttcatcatcgtgcagctgttcatcatgaagctgaggaaggcccacgtgatctggaagaaggaaaatgaggtgtctgagcacaccctggagagctaccgcagccgcagcaacaatgaggagaccagcagcgaggagaagaatggccagagcagccaccccatgcgctgcatgaactacatcaccaagctgtacagcgaggccaagaccaagaggaaagaaaatgtgcagcacagcaagctggaggagaagcacatccaggtgcctgagagcatcgtgtag

SEQ ID NO: 149221 - DNA, 525 bp, Artificial Sequence
  Description of Artificial Sequence: Synthetic coding sequence
atggcctgcctgggcttccagaggcacaaggcccagctgaacctggccaccaggacctggccctgcaccctgctcttcttcctgctcttcatccctgtgttctgcaaggccatgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgccaaggagaagaagcccagctacaacagaggcctgtgtgaaaatgcccccaacagagccaggatgtag

SEQ ID NO: 149222 - DNA, 672 bp, Artificial Sequence
  Description of Artificial Sequence: Synthetic coding sequence
atggcctgcctgggcttccagaggcacaaggcccagctgaacctggccaccaggacctggccctgcaccctgctcttcttcctgctcttcatccctgtgttctgcaaggccatgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgatcctgagccctgcccagacagcgacttcctgctgtggatcctggccgctgtgagcagcggcctcttcttctacagcttcctgctgacagctgtgtccctgagcaagatgctgaagaagaggagccccctgaccaccggggtgtatgtgaagatgccacccacagagccagaatgtgagaagcagttccagccctacttcatccccatcaactag

SEQ ID NO: 149223 - DNA, 414 bp, Artificial Sequence
  Description of Artificial Sequence: Synthetic coding sequence
atgcacgtggcccagcctgctgtggtgctggccagcagccggggcatcgccagctttgtgtgtgaatatgccagccctgggaaggccacagaggtgcgggtgacagtgctgcggcaggccgacagccaggtgacagaggtgtgtgccgccacctacatgatgggaaatgagctgaccttcctggatgacagcatctgcaccggcaccagcagcggcaaccaggtgaacctgaccatccagggcctgcgggccatggacaccggcctgtacatctgcaaggtggagctgatgtaccccccaccctactacctgggcattggaaatggcacccagatctacgtgattgccaaggagaagaagcccagctacaacagaggcctgtgtgaaaatgcccccaacagagccaggatgtag

SEQ ID NO: 149224 - DNA, 171 bp, Artificial Sequence
  Description of Artificial Sequence: Synthetic coding sequence
atggcctgcctgggcttccagaggcacaaggcccagctgaacctggccaccaggacctggccctgcaccctgctcttcttcctgctcttcatccctgtgttctgcaaggtgcccccaacagagccagaatgtgagaagcagttccagccctacttcatccccatcaactag

SEQ ID NO: 149225 - DNA, 660 bp, Artificial Sequence
  Description of Artificial Sequence: Synthetic coding sequence
atggccagcgctggggacacccaggccggccccagagatgctgctgaccagaactttgactacatgttcaagctgctgctgattggcaacagctctgtgggcaagaccagcttcctgttccgctatgcagatgacagcttcaccccagcctttgtgtccacagtgggcatcgacttcaaggtgaagacagtgtacagacatgacaagaggatcaagctgcagatctgggacacagctggccaggagcgctaccgcaccatcaccacagcctactacagaggagccatgggcttcctgctgatgtatgacatcgccaaccaggagagctttgctgctgtgcaggactgggccacccagatcaagacctacagctgggacaatgcccaggtgatcctggtgggcaacaagtgtgacctggaggatgagcgggtggtgcctgcagaagatggaagaaggctggctgatgacctgggctttgagttctttgaggccagcgccaaggagaacatcaacgtgaagcaggtgtttgagcggctggtggatgtgatctgtgagaagatgaatgaaagcctggagcccagcagcagcagcggcagcaatggcaagggccctgctgtgggagatgccccagccccccagcccagcagctgcagctgctag

SEQ ID NO: 149226 - DNA, 1566 bp, Artificial Sequence
  Description of Artificial Sequence: Synthetic coding sequence
atgctgccccggcggcccctggcctggccagcctggctgctgcggggggcccctggagctgctggctcctggggccggcctgtgggccccctggcccggcggggctgctgcagcgcccctggcaccccagaggtgcccctgacccgggagcgctaccctgtgcggcggctgcccttcagcacagtgtccaagcaggacctggccgcctttgaaagaattgtgcctggaggagtggtgacagatcctgaggccctgcaggccccaaatgtggactggctgcggaccctgcggggctgcagcaaggtgctgctgcggcccaggaccagcgaggaggtgagccacatcctgcggcactgccacgagaggaacctggccgtgaacccccagggcggcaacacaggcatggtgggcggctctgtgcctgtgtttgatgagatcatcctgagcacagccaggatgaacagagtgctgtccttccacagcgtgtctggcatcctggtgtgccaggccggctgtgtgctggaggagctgagccgctacgtggaggagcgggacttcatcatgcccctggacctgggcgccaagggcagctgccacatcggcggcaatgtggccaccaatgctgggggcctgcgcttcctgcgctatggcagcctgcacggcaccgtgctgggcctggaggtggtgctggctgatggcaccgtgctggactgcctgaccagcctgaggaaggacaacacaggctatgacctgaagcagctgttcatcggcagcgagggcaccctgggcatcatcaccaccgtgtccatcctgtgcccccccaagcccagggctgtgaatgtggccttcctgggctgccccggctttgctgaggtgctgcagaccttcagcacctgcaagggcatgctgggggagatcctgagcgcctttgagttcatggatgctgtgtgcatgcagctggtgggccgccacctgcacctggccagccctgtgcaggagagccccttctacgtgctgattgagaccagcggcagcaatgccggccatgatgctgagaagctgggccacttcctggagcacgccctgggcagcggcctggtgacagatggcaccatggccacagaccagaggaaggtgaagatgctgtgggccctgcgggagcgcatcacagaggccctgagcagagatggctacgtgtacaagtatgacctgagcctgcctgtggagcggctgtatgacatcgtgacagacctgcgggcccggctgggcccccacgccaagcacgtggtgggctacggccacctgggagatggcaacctgcacctgaatgtgacagctgaggccttcagccccagcctgctggccgccctggagccccacgtgtatgagtggacagctggccagcagggctctgtgtctgctgagcacggcgtgggcttcaggaagagagatgtgctgggctacagcaagcccccaggggccctgcagctgatgcagcagctgaaggccctgctggaccccaagggcatcctgaacccctacaagaccctgcccagccaggcctag

SEQ ID NO: 149227 - DNA, 960 bp, Artificial Sequence
  Description of Artificial Sequence: Synthetic coding sequence
atgctgccccggcggcccctggcctggccagcctggctgctgcggggggcccctggagctgctggctcctggggccggcctgtgggccccctggcccggcggggctgctgcagcgcccctggcaccccagaggtgcccctgacccgggagcgctaccctgtgcggcggctgcccttcagcacagtgtccaagcaggacctggccgcctttgaaagaattgtgcctggaggagtggtgacagatcctgaggccctgcaggccccaaatgtggactggctgcggaccctgcggggctgcagcaaggtgctgctgcggcccaggaccagcgaggaggtgagccacatcctgcggcactgccacgagaggaacctggccgtgaacccccagggcggcaacacaggcatggtgggcggctctgtgcctgtgtttgatgagatcatcctgagcacagccaggatgaacagagtgctgtccttccacagcgtgtctggcatcctggtgtgccaggccggctgtgtgctggaggagctgagccgctacgtggaggagcgggacttcatcatgcccctggacctgggcgccaagggcagctgccacatcggcggcaatgtggccaccaatgctgggggcctgcgcttcctgcgctatggcagcctgcacggcaccgtgctgggcctggaggtggtgctggctgatggcaccgtgctggactgcctgaccagcctgaggaaggacaacacaggctatgacctgaagcagctgttcatcggcagcgagggcaccctgggcatcatcaccaccgtgtccatcctgtgcccccccaagcccagggctgtgaatgtggccttcctggtgacctgtgtgcccccagcctgtggccctggcagccccaggcctgcccggctgccccacccagccctgcggaccccaggagtgtgcccccagcccctgcggctgtag

SEQ ID NO: 149228 - DNA, 1164 bp, Artificial Sequence
  Description of Artificial Sequence: Synthetic coding sequence
atggtgggcggctctgtgcctgtgtttgatgagatcatcctgagcacagccaggatgaacagagtgctgtccttccacagcgtgtctggcatcctggtgtgccaggccggctgtgtgctggaggagctgagccgctacgtggaggagcgggacttcatcatgcccctggacctgggcgccaagggcagctgccacatcggcggcaatgtggccaccaatgctgggggcctgcgcttcctgcgctatggcagcctgcacggcaccgtgctgggcctggaggtggtgctggctgatggcaccgtgctggactgcctgaccagcctgaggaaggacaacacaggctatgacctgaagcagctgttcatcggcagcgagggcaccctgggcatcatcaccaccgtgtccatcctgtgcccccccaagcccagggctgtgaatgtggccttcctgggctgccccggctttgctgaggtgctgcagaccttcagcacctgcaagggcatgctgggggagatcctgagcgcctttgagttcatggatgctgtgtgcatgcagctggtgggccgccacctgcacctggccagccctgtgcaggagagccccttctacgtgctgattgagaccagcggcagcaatgccggccatgatgctgagaagctgggccacttcctggagcacgccctgggcagcggcctggtgacagatggcaccatggccacagaccagaggaaggtgaagatgctgtgggccctgcgggagcgcatcacagaggccctgagcagagatggctacgtgtacaagtatgacctgagcctgcctgtggagcggctgtatgacatcgtgacagacctgcgggcccggctgggcccccacgccaagcacgtggtgggctacggccacctgggagatggcaacctgcacctgaatgtgacagctgaggccttcagccccagcctgctggccgccctggagccccacgtgtatgagtggacagctggccagcagggctctgtgtctgctgagcacggcgtgggcttcaggaagagagatgtgctgggctacagcaagcccccaggggccctgcagctgatgcagcagctgaaggccctgctggaccccaagggcatcctgaacccctacaagaccctgcccagccaggcctag

SEQ ID NO: 149229 - DNA, 978 bp, Artificial Sequence
  Description of Artificial Sequence: Synthetic coding sequence
atgctgccccggcggcccctggcctggccagcctggctgctgcggggggcccctggagctgctggctcctggggccggcctgtgggccccctggcccggcggggctgctgcagcgcccctggcaccccagaggtgcccctgacccgggagcgctaccctgtgcggcggctgcccttcagcacagtgtccaagcaggacctggccgcctttgaaagaattgtgcctggaggagtggtgacagatcctgaggccctgcaggccccaaatgtggactggctgcggaccctgcggggctgcagcaaggtgctgctgcggcccaggaccagcgaggaggtgagccacatcctgcggcactgccacgagaggaacctggccgtgaacccccagggcggcaacacaggcatggtgggcggctctgtgcctgtgtttgatgagatcatcctgagcacagccaggatgaacagagtgctgtccttccacagcgtgtctggcatcctggtgtgccaggccggctgtgtgctggaggagctgagccgctacgtggaggagcgggacttcatcatgcccctggacctgggcgccaagggcagctgccacatcggcggcaatgtggccaccaatgctgggggcctgcgcttcctgcgctatggcagcctgcacggcaccgtgctgggcctggaggtggtgctggctgatggcaccgtgctggactgcctgaccagcctgaggaaggacaacacaggctatgacctgaagcagctgttcatcggcagcgagggcaccctgggcatcatcaccaccgtgtccatcctgtgcccccccaagcccagggctgtgaatgtggccttcctggtgacctgtgtgcccccagcctgtggccctggcagccccaggcctgcccggctgccccacccagccctgcggaccccaggcctgcggcaggagagcctggccagcagctgccacgcccacgtgtag

SEQ ID NO: 149230 - DNA, 426 bp, Artificial Sequence
  Description of Artificial Sequence: Synthetic coding sequence
atgctgtgggccctgcgggagcgcatcacagaggccctgagcagagatggctacgtgtacaagtatgacctgagcctgcctgtggagcggctgtatgacatcgtgacagacctgcgggcccggctgggcccccacgccaagcacgtggtgggctacggccacctgggagatggcaacctgcacctgaatgtgacagctgaggccttcagccccagcctgctggccgccctggagccccacgtgtatgagtggacagctggccagcagggctctgtgtctgctgagcacggcgtgggcttcaggaagagagatgtgctgggctacagcaagcccccaggggccctgcagctgatgcagcagctgaaggccctgctggaccccaagggcatcctgaacccctacaagaccctgcccagccaggcctag

SEQ ID NO: 149231 - DNA, 609 bp, Artificial Sequence
  Description of Artificial Sequence: Synthetic coding sequence
atgtccttcccccccctgtggcccaccaggcatgtgcctgccagccaccccacctgccccctgctgcccggcccctgctgctgcccccactgcctgtgtgacagcgccccacccagcctgccctgccccaccctggtgcagggcgccagccggcccatcctgatcctgcgggccttccctggcccctgccacagcgtgccctgccacgacctgaagctgcaggtgggcgccagccccttccgccacggctgccccccatctgtgcgctgccccagccggctgattgctggggtgcccggctgcagcgtgctgtcctggagcctgggccacagcctgtctggaattgacagccgggtgggcgccaccccaggcctgggccacagcctgtcctgggtgcgggcccctcctggcctgggccacagcctgtctggagtgggcgccaccccaggcctgggccacctgctgagcggcgtgggcgccagccctggagaggacacagagcacgccgccgccctgaccccctgtggggtgccccctgtgcccggctgccgcagccacagccagcccctgagccacctggtgagcagcagccgctgctgcggcccctag

SEQ ID NO: 149232 - DNA, 849 bp, Artificial Sequence
  Description of Artificial Sequence: Synthetic coding sequence
atggccctgagctgcagctcctggtgccgcagcccccagtggaagtttgaggccagcaagagccacgccaaccaccggcccatctgcctgagcccccgcatctggccaggcagcgccagcgccaccagcacagtgtgcagcagcagcgagagcttcctgccccggggccccccagctgtgtccctgctgctgcacggccccccaacagtgtccttccccccaccctggcccacccaccacgtgctgcccagccctgtggcccaccccccctgcccctgcctgcccccagacatgcccctggagctgcccggcccctgctgctgcccccactgcctgtgtgacagcgccccacccagcctgccctgccccaccctggtgcagggcgccagccggcccatcctgatcctgcgggccttccctggcccctgccacagcgtgccctgccacgacctgaagctgcaggtgggcgccagccccttccgccacggctgccccccatctgtgcgctgccccagccggctgattgctggggtgcccggctgcagcgtgctgtcctggagcctgggccacagcctgtctggaattgacagccgggtgggcgccaccccaggcctgggccacagcctgtcctgggtgcgggcccctcctggcctgggccacagcctgtctggagtgggcgccaccccaggcctgggccacctgctgagcggcgtgggcgccagccctggagaggacacagagcacgccgccgccctgaccccctgtggggtgccccctgtgcccggctgccgcagccacagccagcccctgagccacctggtgagcagcagccgctgctgcggcccctag

SEQ ID NO: 149233 - DNA, 1245 bp, Artificial Sequence
  Description of Artificial Sequence: Synthetic coding sequence
atgggcggcctgagcgcccggcccacagctggccgcacagatcctgctggcacctgctggggccaggaccccggcagcaagatggccaccgtcatccctggccccctgagcctgggggaggacttctaccgggaggccatcgagcactgccgcagctacaatgcccggctgtgtgccgagaggagcctgcggctgcccttcctggacagccagacaggagtggcccagaacaactgctacatctggatggagaagacccaccggggccctggcctggcccctggccagatctacacctacccagcccgctgctggaggaagaagaggcggctgaacatcctggaggacccccggctgcggccctgtgagtacaagattgactgtgaggcccccctgaagaaggagggcggcctgcctgagggccctgtgctggaggccctgctgtgtgccgagaccggggagaagaagattgagctgaaggaggaggagaccatcatggactgccagaagcagcagctgctggagttcccccatgacctggaggtggaggacctggaggatgacatccccaggaggaagaacagagccaagggcaaggcctatggaattggaggcctgaggaagaggcaggacacagccagcctggaggaccgggacaagccctacgtgtgtgacatctgtgggaagcgctacaagaacagacctggcctgagctaccactacacccacacccacctggccgaggaggagggggaggagaatgctgagagacatgccctgcccttccacaggaagaacaaccacaagcagttctacaaggagctggcctgggtgcctgaggcccagaggaagcacacagccaagaaggccccagatggcaccgtcatccccaacggctactgtgacttctgcctgggcggcagcaagaagacaggctgcccagaagatctcatcagctgtgccgactgtggccgcagcggccaccccagctgcctgcagttcaccgtgaacatgacagctgctgtgaggacctaccgctggcagtgcatcgagtgcaagagctgcagcctgtgtggcaccagtgaaaatgatgaccagctgctcttctgtgatgactgtgaccggggctaccacatgtactgcctgagcccccccatggccgagcccccagagggctcctggagctgccacctgtgcctgcggcacctgaaggagaaggccagcgcctacatcaccctgacctag

SEQ ID NO: 149234 - DNA, 1074 bp, Artificial Sequence
  Description of Artificial Sequence: Synthetic coding sequence
atggccaccgtcatccacaaccccctgaaggccctgggggaccagttctacaaggaggccatcgagcactgccgcagctacaacagccggctgtgtgccgagaggtctgtgcggctgcccttcctggacagccagacaggagtggcccagaacaactgctacatctggatggagaagaggcaccggggccctggcctggcccctggccagctgtacacctacccagcccgctgctggaggaagaagaggcggctgcaccccccagaggaccccaagctgcggctgctggagatcaagccagaggtggagctgcccctgaagaaggatggcttcaccagcgagagcaccaccctggaggccctgctgcggggggagggcgtggagaagaaggtggatgcccgggaggaggagagcatccaggagatccagagggtgctggagaatgatgaaaatgtggaggagggcaatgaggaggaggacctggaggaggacatccccaagaggaagaacagaacccggggccgggcccggggcagcgctgggggcagaagaagacatgatgctgccagccaggaggaccatgacaagccctacgtgtgtgacatctgtgggaagcgctacaagaacagacctggcctgagctaccactacgcccacacccacctggccagcgaggagggagatgaggcccaggaccaggagaccaggagcccccccaaccacagaaatgaaaaccaccggccccagaagggcccagatggcaccgtcatccccaacaactactgtgacttctgcctgggcggcagcaacatgaacaagaagagcggccggcctgaggagctggtgtcctgtgccgactgtggccgcagcgcccacctgggcggggagggcaggaaggagaaggaggccgctgctgctgcccggaccacagaggacctgtttggcagcaccagcgagagtgacaccagcaccttccacggctttgatgaagatgacctggaggagcccaggagctgccggggccgccgcagcggccggggcagccccacagctgacaagaagggcagctgctag

SEQ ID NO: 149235 - DNA, 999 bp, Artificial Sequence
  Description of Artificial Sequence: Synthetic coding sequence
atggagaagacccaccggggccctggcctggcccctggccagatctacacctacccagcccgctgctggaggaagaagaggcggctgaacatcctggaggacccccggctgcggccctgtgagtacaagattgactgtgaggcccccctgaagaaggagggcggcctgcctgagggccctgtgctggaggccctgctgtgtgccgagaccggggagaagaagattgagctgaaggaggaggagaccatcatggactgccagaagcagcagctgctggagttcccccatgacctggaggtggaggacctggaggatgacatccccaggaggaagaacagagccaagggcaaggcctatggaattggaggcctgaggaagaggcaggacacagccagcctggaggaccgggacaagccctacgtgtgtgacatctgtgggaagcgctacaagaacagacctggcctgagctaccactacacccacacccacctggccgaggaggagggggaggagaatgctgagagacatgccctgcccttccacaggaagaacaaccacaagcagttctacaaggagctggcctgggtgcctgaggcccagaggaagcacacagccaagaaggccccagatggcaccgtcatccccaacggctactgtgacttctgcctgggcggcagcaagaagacaggctgcccagaagatctcatcagctgtgccgactgtggccgcagcggccaccccagctgcctgcagttcaccgtgaacatgacagctgctgtgaggacctaccgctggcagtgcatcgagtgcaagagctgcagcctgtgtggcaccagtgaaaatgatgaccagctgctcttctgtgatgactgtgaccggggctaccacatgtactgcctgagcccccccatggccgagcccccagagggctcctggagctgccacctgtgcctgcggcacctgaaggagaaggccagcgcctacatcaccctgacctag

SEQ ID NO: 149236 - DNA, 1143 bp, Artificial Sequence
  Description of Artificial Sequence: Synthetic coding sequence
atgggcggcctgagcgcccggcccacagctggccgcacagatcctgctggcacctgctggggccaggaccccggcagcaagatggccaccgtcatccctggccccctgagcctgggggaggacttctaccgggaggccatcgagcactgccgcagctacaatgcccggctgtgtgccgagaggagcctgcggctgcccttcctggacagccagacaggagtggcccagaacaactgctacatctggatggagaagacccaccggggccctggcctggcccctggccagatctacacctacccagcccgctgctggaggaagaagaggcggctgaacatcctggaggacccccggctgcggccctgtgagtacaagattgactgtgaggcccccctgaagaaggagggcggcctgcctgagggccctgtgctggaggccctgctgtgtgccgagaccggggagaagaagattgagctgaaggaggaggagaccatcatggactgccagaagcagcagctgctggagttcccccatgacctggaggtggaggacctggaggatgacatccccaggaggaagaacagagccaagggcaaggcctatggaattggaggcctgaggaagaggcaggacacagccagcctggaggaccgggacaagccctacgtgtgtgacaagttctacaaggagctggcctgggtgcctgaggcccagaggaagcacacagccaagaaggccccagatggcaccgtcatccccaacggctactgtgacttctgcctgggcggcagcaagaagacaggctgcccagaagatctcatcagctgtgccgactgtggccgcagcggccaccccagctgcctgcagttcaccgtgaacatgacagctgctgtgaggacctaccgctggcagtgcatcgagtgcaagagctgcagcctgtgtggcaccagtgaaaatgatggagcctcctgggccggcctgaccccccaggaccagctgctcttctgtgatgactgtgaccggggctaccacatgtactgcctgagcccccccatggccgagcccccagagggctcctggagctgccacctgtgcctgcggcacctgaaggagaaggccagcgcctacatcaccctgacctag

SEQ ID NO: 149237 - DNA, 612 bp, Artificial Sequence
  Description of Artificial Sequence: Synthetic coding sequence
atggccacagccatccagaaccccctgaagagcctgggggaggacttctaccgggaggccatcgagcactgccgcagctacaatgcccggctgtgtgccgagaggagcctgcggctgcccttcctggacagccagacaggagtggcccagaacaactgctacatctggatggagaagacccaccggggccctggcctggcccctggccagatctacacctacccagcccgctgctggaggaagaagaggcggctgaacatcctggaggacccccggctgcggccctgtgagtacaagattgactgtgaggcccccctgaagaaggagggcggcctgcctgagggccctgtgctggaggccctgctgtgtgccgagaccggggagaagaagattgagctgaaggaggaggagaccatcatggactgccagaagcagcagctgctggagttcccccatgacctggaggtggaggacctggaggatgacatccccaggaggaagaacagagccaagggcaaggcctatggaattggaggcctgaggaagaggcaggacacagccagcctggaggaccgggacaagccctacgtgtgtgacagcgagagcttctag

SEQ ID NO: 149238 - DNA, 1245 bp, Artificial Sequence; identical to SEQ ID NO: 149233
  Description of Artificial Sequence: Synthetic coding sequence

SEQ ID NO: 149239 - DNA, 1167 bp, Artificial Sequence
  Description of Artificial Sequence: Synthetic coding sequence
atggccacagccatccagaaccccctgaagagcctgggggaggacttctaccgggaggccatcgagcactgccgcagctacaatgcccggctgtgtgccgagaggagcctgcggctgcccttcctggacagccagacaggagtggcccagaacaactgctacatctggatggagaagacccaccggggccctggcctggcccctggccagatctacacctacccagcccgctgctggaggaagaagaggcggctgaacatcctggaggacccccggctgcggccctgtgagtacaagattgactgtgaggcccccctgaagaaggagggcggcctgcctgagggccctgtgctggaggccctgctgtgtgccgagaccggggagaagaagattgagctgaaggaggaggagaccatcatggactgccagaagcagcagctgctggagttcccccatgacctggaggtggaggacctggaggatgacatccccaggaggaagaacagagccaagggcaaggcctatggaattggaggcctgaggaagaggcaggacacagccagcctggaggaccgggacaagccctacgtgtgtgacatctgtgggaagcgctacaagaacagacctggcctgagctaccactacacccacacccacctggccgaggaggagggggaggagaatgctgagagacatgccctgcccttccacaggaagaacaaccacaagcagttctacaaggagctggcctgggtgcctgaggcccagaggaagcacacagccaagaaggccccagatggcaccgtcatccccaacggctactgtgacttctgcctgggcggcagcaagaagacaggctgcccagaagatctcatcagctgtgccgactgtggccgcagcggccaccccagctgcctgcagttcaccgtgaacatgacagctgctgtgaggacctaccgctggcagtgcatcgagtgcaagagctgcagcctgtgtggcaccagtgaaaatgatgaccagctgctcttctgtgatgactgtgaccggggctaccacatgtactgcctgagcccccccatggccgagcccccagagggctcctggagctgccacctgtgcctgcggcacctgaaggagaaggccagcgcctacatcaccctgacctag

SEQ ID NO: 149240 - DNA, 1176 bp, Artificial Sequence
  Description of Artificial Sequence: Synthetic coding sequence
atggctgctgtggtggagaatgtggtgaagctgctgggggagcagtactacaaggatgccatggagcagtgccacaactacaatgcccggctgtgtgccgagaggtctgtgcggctgcccttcctggacagccagacaggagtggcccagagcaactgctacatctggatggagaagaggcaccggggccctggcctggccagcggccagctgtacagctacccagcccggcgctggaggaagaagagaagagcccaccccccagaggacccccggctgtccttccccagcatcaagccagacacagaccagaccctgaagaaggagggcctcatcagccaggacggcagcagcctggaggccctgctgaggacagaccccctggagaagagaggagccccagacccccgggtggatgatgacagcctgggggagttccctgtgaccaacagccgggccaggaagaggatcctggagccagatgacttcctggatgacctggatgatgaggactatgaggaggacacccccaagagaagaggcaagggcaagagcaagggcaagggcgtgggcagcgccaggaagaagctggatgccagcatcctggaggaccgggacaagccctatgcctgtgacatctgtgggaagcgctacaagaaccggcccggcctgagctaccactacgcccacagccacctggccgaggaggagggggaggacaaggaggacagccagccccccacccctgtgtcccagaggtctgaggagcagaagagcaagaagggcccagatggcctggccctgcccaacaactactgtgacttctgcctgggggacagcaagatcaacaagaagacaggccagcctgaggagctggtgtcctgcagcgactgtggccgcagcggccaccccagctgcctgcagttcacccctgtgatgatggctgctgtgaagacctaccgctggcagtgcatcgagtgcaagtgctgcaacatctgtggcaccagtgaaaatgatgaccagctgctcttctgtgatgactgtgaccggggctaccacatgtactgcctgacccccagcatgtctgagcccccagagggctcctggagctgccacctgtgcctggacctgctgaaggagaaggccagcatctaccagaaccagaacagcagctag

SEQ ID NO: 149241 - DNA, 1134 bp, Artificial Sequence
  Description of Artificial Sequence: Synthetic coding sequence
agcagcatcatccagaaccggctgaagaagctgggggaccagttctacaaggaggccatcgagcactgccgcagctacaacagccggctgtgtgccgagaggtctgtgcggctgcccttcctggacagccagacaggagtggcccagaacaactgctacatctggatggagaagaggcaccggggccctggcctggcccctggccagctgtacacctacccagcccgctgctggaggaagaagaggcggctgcaccccccagaggaccccaagctgcggctgctggagatcaagccagaggtggagctgcccctgaagaaggatggcttcaccagcgagagcaccaccctggaggccctgctgcggggggagggcgtggagaagaaggtggatgcccgggaggaggagagcatccaggagatccagagggtgctggagaatgatgaaaatgtggaggagggcaatgaggaggaggacctggaggaggacatccccaagaggaagaacagaacccggggccgggcccggggcagcgctgggggcagaagaagacatgatgctgccagccaggaggaccatgacaagccctacgtgtgtgacatctgtgggaagcgctacaagaaccggcccggcctgagctaccactacgcccacacccacctggccagcgaggagggagatgaggcccaggaccaggagaccaggagcccccccaaccacagaaatgaaaaccaccggccccagaagggcccagatggcaccgtcatccccaacaactactgtgacttctgcctgggcggcagcaacatgaacaagaagagcggccggcctgaggagctggtgtcctgtgccgactgtggccgcagcggccaccccacctgcctgcagttcaccctgaacatgacagaggccgtgaagacctacaagtggcagtgcatcgagtgcaagagctgcatcctgtgtggcaccagtgaaaatgatgaccagctgctcttctgtgatgactgtgaccggggctaccacatgtactgcctgaacccccctgtggccgagcccccagagggctcctggagctgccacctgtgctgggagctgctgaaggagaaggccagcgccttcggctgccaggcctag

SEQ ID NO: 149242 - DNA, 1074 bp, Artificial Sequence; identical to SEQ ID NO: 149234
  Description of Artificial Sequence: Synthetic coding sequence

SEQ ID NO: 149243 - DNA, 1137 bp, Artificial Sequence
  Description of Artificial Sequence: Synthetic coding sequence
atggccaccgtcatccacaaccccctgaaggccctgggggaccagttctacaaggaggccatcgagcactgccgcagctacaacagccggctgtgtgccgagaggtctgtgcggctgcccttcctggacagccagacaggagtggcccagaacaactgctacatctggatggagaagaggcaccggggccctggcctggcccctggccagctgtacacctacccagcccgctgctggaggaagaagaggcggctgcaccccccagaggaccccaagctgcggctgctggagatcaagccagaggtggagctgcccctgaagaaggatggcttcaccagcgagagcaccaccctggaggccctgctgcggggggagggcgtggagaagaaggtggatgcccgggaggaggagagcatccaggagatccagagggtgctggagaatgatgaaaatgtggaggagggcaatgaggaggaggacctggaggaggacatccccaagaggaagaacagaacccggggccgggcccggggcagcgctgggggcagaagaagacatgatgctgccagccaggaggaccatgacaagccctacgtgtgtgacatctgtgggaagcgctacaagaacagacctggcctgagctaccactacgcccacacccacctggccagcgaggagggagatgaggcccaggaccaggagaccaggagcccccccaaccacagaaatgaaaaccaccggccccagaagggcccagatggcaccgtcatccccaacaactactgtgacttctgcctgggcggcagcaacatgaacaagaagagcggccggcctgaggagctggtgtcctgtgccgactgtggccgcagcggccaccccacctgcctgcagttcaccctgaacatgacagaagctgtgaagacctacaagtggcagtgcatcgagtgcaagagctgcatcctgtgtggcaccagtgaaaatgatgaccagctgctcttctgtgatgactgtgaccggggctaccacatgtactgcctgaacccccctgtggccgagcccccagagggctcctggagctgccacctgtgctgggagctgctgaaggagaaggccagcgccttcggctgccaggcctag

SEQ ID NO: 149244 - DNA, 4110 bp, Artificial Sequence
  Description of Artificial Sequence: Synthetic coding sequence
atgagcccctgtggcaggaagatgggagagggccggcagcagaggcgggcccctgtgggcaagctgctgctgctgcccggccggcgggacacccctcatggccgcagcggcagcagcggggcccggacccagaggagcctgctgtggctgctggtgcacgtgtggctgtgggccgccagcggcagcagcgcccagctgttcaacctgaccctgtctgtggatgagggcctgcccccagacaccctggtgggggacatccgggccggcctgcctgctgcccagcagcaggagggcagcggcttcttcctgtctgaagattctgatgacagccccctgctggatgacttccacgtgcacccagacaccggcatcatcagaacagcccggcggctggaccgggagcggcgggaccactacagctttgtggccgccaccctgctgggcgctgtggtgcaggtggagatccgggtgaatgatgtgaatgaccacagcccccgcttccccctggacagcctgcagctggatgtgtctgagctgagccccccaggcacagccttccggctgcctgtggcccatgaccctgatgctggcctcttcagcacccagggctacaccctggtgcagcccagcgacctgcccaaggaccctgctggccccttcttccagctgcgctaccgcaccccaggccccctgcccagccccctgctgcccggcagcagcagccccctggagcccctggacctggtgctgctgcggcggctggaccgggaggaggccgccgcccaccggctgcagatcgaggcctgggatggcggccggcccaggagaacaggcctgctgtctgtggagctgcgggtgctggatgaaaatgacaacccccctgtgtttgagcaggatgagtacagagctgctgtgagagaagatgcccagcctggagctgaggtgtgccgggtgcgggccacagaccgggacctgggccccaacggctttgtgcgctacagcgtgcgggcccggcaggtgcctggagctggcagcggcggcggggccctgggagatgctgcctactttgctgtggaggagctgagcggcgtggtgcgggtgtggaggcccctggaccgggaggcccaggcctggcaccagctggtggtggaggccagagatggaggagctgagcctgaggtggccaccgtgcgggtgtccattgctgtgctggatgtgaatgacaacagacctgccatccacgtgctcttcctgacagaaggaggagtggcccgggtgtctgagggcgcccggcctggggactatgtggcccgggtgtctgtgtctgatgctgatggagactgggagaaggaggatgaggccactggagagctgggcgtgggcctgggagatggcagcatcagcctgagcctggagggcggggagggggactttgccctgctgcccggcggccccccaggagtcttcttcctgtgtgtggagggccccctggaccgggagagccgggacctgtatgagctgctgctggtggccacagatgctggcagcccccccctgagcacagaggagaccctgctgctgcgggtggccgacctgaatgaccagcccccactcttcagccagcagcactacaaggcctctgtgtctgaggccgccgcccctggcaccgtggtgatgtgggtgtctgccagtgatgctgatgaagctggcagtgaccacgcctggctgcgctacacagtggtgcagctgagcgccccctgcaacctgggcagcctgcagagcaagatggtgcacacagcagaatgtggccccagctttgccatcgacagcgagagcggggccatcagcaccatccgcaccctggaccgggaggtgcaggaggccgtggagctgaaggtggtggcccaggacctgggggagccccccctgagcgccacctgcctggtgtccatcaccgtggatgatgtgaatgacaatgagcccatcttctggaggcaggtgtacaatgccaccatcgccgagcacgcccctgtgggccactgcttcctgcaggtgacagccagtgatgctgacagcggcctgtatggcttcatcgagtacagcctgtatgatggcttcctgtcctatgaggccccccaggccttcagaattgacccccatgatggccagatctgtgtgtcccaggacatcgaccgggagcgggaccctgccacctatgacctgctggtggaggccaaggatggcggcggcctgagcgcccaggcctttgtgcgggtggacctggaggatgtgaatgacaaccaccctgtgttcaaccccagcacctacgtgaccagcatcagtgatgagacccagcccggcacagagatcatcaacgtgctggccacagaccaggacagcggcatctatggaacagtggcctatgagctgatccctggaaatgtgagcagcctcttcaccatcgacagcaccaccggcatcatctacctgaccctgcccctgagccacctggagagcaccaccctgagcctgatggtgtctgcccaggacggcggcggcctgacagctgtgatcaatgctgatgtgaccatccacatcttccagaccaccctggccccagctgagtttgagcggcccaagtacaccttcctggtgtatgaagatgtgcctgaggacagccccatcggcaccgtgaaggcccgggagcccctgaacagcagcgagcccatcttctaccgcatcagcagcggggacctgggcggcaagttcagcatccacccccggctgggcaccatccgcaccaggaagcccctggaccacgagacccagcctgtggtggtgctgactgtgcaggcccagctgggcagcgccccagcctgcagcagcacagaggtgaacatcaccgtgatggatgtgaatgacaaccacccagccttcctgcggaccagtgatgagatccgcatcagccagaccaccccacctggaacagccctgtacctggcccgggcagaggaccgggacagcggcagaaatggcctcatccgctacagcatcgccagcccccagcccggggtgtttgccatcgaccgggccctgggcgtgctcttcctgaatggcagcctgggcgctggggagcagcgggagctgaccctgaccctgcgggcagaggaccagggcgtgcacccccaggccgccctgctggtgctgactgtggtgattgagaagcgggagcacagccccagctggacctttgagcacctggtgtaccaggtggaggtgtctgagagcctgagccccatgacccagatgctgcagacccaggcccaccccctgggcccccagagagctgccagccccctgcgctacagcctggagcccagcgtggacagcgccatgtttggcatccggccctacacaggctggatctacctgcggcggcagtttgattatgagagcacccagacctacaacttccgggtgtttgcctggatcccagaagatggcttcctgcagaatgtgtccaccaccgtcatcgtgcgggtgtgggatgaaaatgacaacagccccaccttcctgcatgatgtgctcttcctgaaggtggaggagagccctgtgccccagggcgtcatcggcaagatcacagccatcgacatggacagcggcaagaatggccagctgctgtacttcctgctgagtgatggcaagttcttcaagatgaaccccaacacaggagagctgatcaactgggtggccctggaccgggagcaccggggccaccacgagatgacagtgctggtgacagaccggggcagccccccaagaaatgccaccatggctgtgtatgtgtctgtgacagacatcaatgacaaccggcccttcttcccccagtgcctgcccgggaaggagctgcacgtgaaggtgctggagggccagcctgtgaacatgctggtgaccaccgtgtttgccaaggaccctgatgagggcaacaatgctgaggtgacctacagcgtgtcctctgcccggcccatgcccctgaagggcaagacagccttcggcaagcagagctgcaagaagcagaccaacaagcagaccaacaagatcctgacctag

SEQ ID NO: 149245 - DNA, 8751 bp, Artificial Sequence
  Description of Artificial Sequence: Synthetic coding sequence
atgaggctggatgagatcaccaagtcagaaaatgaagatggagagaagaagatgttcacccagcagtttgagagcacagatgcctgtgtgtatgaggtgtatgtgaagatcaacagcatcgtgaagagccagagccagtgtggcctgaagaggggcagccctgagacagagctgtggggcgccatcgtgttccgcagccaggaggagaatgccaagcctgtgaaggagacagaggtgacagccagtgatgctgacagcggcctgtatggcttcatcgagtacagcctgtatgatggcttcctgtcctatgaggccccccaggccttcagaattgacccccatgatggccagatctgtgtgtcccaggacatcgaccgggagcgggaccctgccacctatgacctgctggtggaggccaaggatggagatgagcagaggatgacccacctggccctggtgaagggcggcctgagcgcccaggcctttgtgcgggtggacctggaggatgtgaatgacaaccaccctgtgttcaaccccagcacctacgtgaccagcatcagtgatgagacccagcccggcacagagatcatcaacgtgctggccacagaccaggacagcggcatctatggaacagtggcctatgagctgatccctggaaatgtgagcagcctcttcaccatcgacagcaccaccggcctgtacagccctgaggtggagatcctgtctgctgtgaacttctctgctgacaaggaggtgatgaacagcctggagatgttcctgcccctgctgcggcacttcaagaaggtggagagagatgaggaggccgctgagaagaagtttgaggccagccggggctggttcatgaggttcaagggcagaagacacctgcactacctgaaggtgcaggatgaagctgccagcgcagatggagaggccgccgcccgctacgtggccaacctggccaagatcctgggggagggcatcatctacctgaccctgcccctgagccacctggagagcaccaccctgagcctgatggtgtctgcccaggacggcggcggcctgacagctgtgatcaatgctgatgtgaccatccacatcttccagaccaccctggccccagctgagtttgagcggcccaagtacaccttcctggtgtatgaagatgtgcctgaggacagccccatcggcaccgtgaaggcccgggagcccctgaacagcagcgagcccatcttctaccgcatcagcagcggggacctgggcggcaagttcagcatccacccccggctgggcaccatccgcaccaggaagcccctggaccacgagacccagcctgtggtggtgctgactgtgcaggcccagctgggcagcgccccagcctgcagcagcacagaggtgaacatcaccgtgatggatgtgaatgacaaccacccagccttcctgcggaccagtgatgagatccgcatcagccagaccaccccacctggaacagccctgtacctggcccgggcagaagatcgggacagcggcagaaatggcctcatccgctacagcatcgccagcccccagcccggggtgtttgccatcgaccgggccctgggcgtgctcttcctgaatggcagcctgggcgctggggagcagcgggagctgaccctgaccctgcgggcagaggaccagggcgtgcacccccaggccgccctgctggtgctgactgtggtgattgagaagcgggagcacagccccagctggacctttgagcacctggtgtaccaggtggaggtgtctgagagcctgagccccatgacccagatgctgcagacccaggcccaccccctgggcccccagagagctgccagccccctgcgctacagcctggagcccagcgtggacagcgccatgtttggcatccggccctacacaggctggatctacctgcggcggcagtttgattatgagagcacccagacctacaacttccgggtgtttgcctggatcccagaagatggcttcctgcagaatgtgtccaccaccgtgattgtgcgggtgtgggatgaaaatgacaacagccccaccttcctgcatgatgtgctcttcctgaaggtggaggagagccctgtgccccagggcgtgattggcaagatcacagccatcgacatggattctgggaagaatggccagctgctgtacttcctgctgagtgatggcaagttcttcaagatgaaccccaacacaggccctgctggcaccatctacgtgatcacctgggcagatggagctgctgccttctctggaacagactttgccttcagcagtgatgagctgcaggcctttgtgctgaagagcctcttctgtgagctgggggagggggagctgatcaactgggtggccctggaccgggagcaccggggccaccacgagatgacagtgctggtgacagaccggggcagccccccaagaaatgccaccatggctgtgtatgtgtctgtgacagacatcaatgacaaccggcccttcttcccccagtgcctgcccgggaaggagctgcacgtgaaggtgctggagggccagcctgtgaacatgctggtgaccaccgtgtttgccaaggaccctgatgagggcaacaatgctgaggtgacctacagcgtgtcctctgaggacagcagtgaccacttcaagattgatgccaacaatggagagatccgcaccaccaccatcctgtcctatgactaccggcccagctacaggatgtctgtgattgccacagaccagggcgtgccccccctgcagggccaggccgtggtgaacatccaggtgatccccctgagcaagggccgggccatcatgagccagaacatccgccacctgatcatccctgagaacctgaagcccaccaagatcatgagcctcatcaagagcagtgaccacctgcagcagcactacaacgggaagctgcacttcagcatcgtggctgatgacaaggatggccactttgaaattgacagcagcactggagacctcttcctgagcaaggagctggactatgagaccaccagccactacctgttccgggtcatcaccacagaccacagcaagaacctgagcctgagcagcaccgtcttcctgagcattgatgtggaggaccagaatgaccacagccccagcttccaggatgagctgattgtcatctctgtggaggagaatgtgcccatcggcaccctggtgtatgtgttcaatgccaaggatgatgatggcagcttcctgaacagccgcatccagtactacatcgagagccacaaccctggcaccaaccccttcctgatccaccccagctttggcaccctggtgacagtgtcccggctggaccgggagagcatccccaccgtcatcctgactgtgacagccagtgaccaggccgtgaatgtgacagaccggcggctgcggagcctgacagcccagatcgtcatcctggatgtgaatgaccacaaccccaccttcatctccttccccaatgcccacgtgaaggaggatgtgacagtgggcagcctggtgcaccacatcacagcccatgaccctgatgagggcagaaatggcaaggtgacctacagcatcctgtctggaaatgaaaacatgaccttcatgctggatgagagcagcggcctgctgaccaccacctgccccctggactatgagatgaagacccagcacatcctgactgtgctggccctggatgatggcaccccagccctgagcagcagccagaccctgactgtgacagtgctggatgtgaatgatgaggcccctgtgttcaagcagcacctgtatgaggcctctgtgaaggagaaccagaaccctggagaatttgtgaccagggtggaggccctggaccgggacagcggcgtgaacagcaagctgcagtttgagatcatgcctggggccagctttgagctgtttgagatcaacagcgacacaggagaggtggtgaccaccaccatcctggaccgggagatccaggaggtgttcaccctgcgggtgctggtgagagatggcggcttccccagcctgagcagcaccaccaccatcctgtgcaccgtggaggatgaaaatgaccacgcccctgagttcatcgtgagcagctatgacatcgaggtgctggagaaccaggagcctgaggtggtgtacacagtgctggccagtgacatggatgctggcaacaacagagctgtggagtaccacatcattgatggcaacacagatgagtgcttcaccatcaatgagatgtctggagagctgagcaccacccgggccctggaccgggagcagatcagcaacttcaccctggtgatcctgtgcagcgacctgggggacccccccaggagcagcgtcatccacctgcaggtgcgggtgctggatgccaatgaccacagccccagcttccccaccctgtactaccagagctctgtgagagaagatgctgaggtgggcaccgtggtgctggtgctgtctgctgtggacaaggatgagggcctgaatggccagacagagtacttcctgacagatgaggccagcggggccttcaccatcgaccccatgagcggcaccctgaagaccagcaacaccctggaccgggaggcccggagccagcacaccttctctgctgtggcccgggactgcagcatccagggcagccgcagcaccaccgtcatcatcaaggtgtatgtgacagatgtgaatgacaatgaccctgtgctggagcagaacccctttgatgtgttcctgagccctgagagccccaccaaccagaccaccgtcatcgtgcgggcagatgacctggacctgggccccaatggaacagtggtgttctcctttgctgagacccagagcatgttcagcattgacaagtacacaggagagatccagttccagcagaaccccagcagcgagtacttccccatctggctgcagctgaaggtgacagaccagggcatcccagcccggaccaccaccggcctgctggtgatccacatggagggggaggatgtgaagatctccttcagccaccacctgtacaagggcctggtgacagagaactgtgaggccggcaccagcatcgtgacagtgaaggcctttgccccagacagcatccaggacagcatgaagtacagcatcttctctggaaatgaagatggagtgctgagcctgtgcagcaagagcggccagctgactgtgaaggagcccaagttcctggactttgaggtgagaaatgaggtgcagctgattgtgctggccgagagcagcggccaccgggcctactgcaaggtggccgtgctgatccaggatgaaaatgacaacagcccctgctttgagcagagcatctaccaggcctctgtgtctgagagccagctgtacaatgcccacgtgatccaggtgtttgccacagacctggacagcggcctgaatggcctcatcgagtacagcatcctgagcggcaaccaggaggaggccttccagattgatgccctgtctggagtcatcaccaccaaggccatcctggactatgagctgaccagcagctacagcctgattgtgcaggccacagacaagggcatgccccggctgagcaacaccaccgtcatcaaggtgcaggtgacagacatcaatgacaatgccccagccttcctgcccagcgaggccgtggagatcacagaggacagcctgcccggggtgattgtgacccacgtgtctgtgcatgatgtggacctgaacagcgccttcatcttctcctttgccaaggagagcaaccctggcaccaagtttgccatcgaccagaacacaggagtggtggtgctggtgaagaccctggactttgaggagatgacagaatatgagctgctgatccagatcagtgacagcgtgcactacacagagggcgccctggtggtgcgggtgctggatgtgaatgacaacccccctgtgttcagccaggacttctaccaggtgacagtgcctgagagcatccctgtgggctacagcgtgctgaccctgagcgccacagacctggagagcaatgaaaacatctcctaccgcatcctgagcagcagcaaggagttcagcattgaccccaagaatggcaccatcttcaccatcagccctgtgctgctgctggacaccatcagcaccacccagttcctggtggaggccagtgatggcggcaacccagacctgcgggccctgaccctggtggagatcggcatcgaggacatgaacaactatgcccctgagttcaccgtgaagagctacaacctgagcctgtctgaagatgccctggtgggcagcaccctggtgaccttcagcaacatcgaccatgactggacccgggagaacacctacgtggagtacagcatcatcagcggcaacagccagaacaacttccacgtggagaccaagttcttccacagcgagtacccctacaagcaggtgggctacctggtgctgctgcacagcctggaccgggaggccagcgccagccatgagctggtgatcctggccagtgacagcggctgcccccccctgagcagcacagctgtgatcagcatccaggtgctggatgtgaatgacaacccccccaacttcagcagcctgagctaccacacccacgtgaaggagagcacccccctgggcagccacatcaccgtggtgtctgccaatgaccgggacaccggcagccatgctgagatcatctacaacatcatctctggaaatgagaagggccacttctacctggaggagaacacaggagtgctgtacctgatcaagcccctggactatgagaagatgaccaagttcaccctgactgtgcaggccagtgatgctgagaagaagcacttctcctttgctgtggtgtttgtgtctgtgctggatgacaatgaccacgccccccagttcatgttcagcagcttcagctgcatcgtgcctgagaacctgcccatcagcagcaccatctgcagcatcaatgccctggactttgatgctggcccctacggggagctgacctacagcatcgtgagcccctgcttcctgacccacggcatgtcctatgaccatgacctcttcctgattgaccccctgaccggggacatccacgccaagcagatcctggactatgaaaatggaaacaagtactgcctgactgtgcaggccaaggacaagggagatgccacagccagcctggtggtgtgggtggacatcgagggcattgatgaatttgagcccatcttcacccaggaccagtacttcttcaccctgcctgagaagaacaaggaccggcagctgattggccgggtggaggccagtgatgctgatgctggcattgatggagtcatcctgtacagcctgggcaccagcagccccttcttctctgtgaacaagaccaatggaaacatctacctgatccgggccctgcccctcatcaagagccagctgaacaaggaggacaccctggagatgaagatcatcgcccacagccccaagagtgacagcaagtttgccagctgcaccgtgtttgtgaatgtgtccttcagcagcgagggcacccccctggccgtgtttgccagcagcttcagcatcagcctggtggtgtccttcctggtgttcctgatcctgatctgcatcctgattgtgatgatcctgcggcacaagcagaaggacaccatcaacaactatgaggagaagaagaccagcagcctggatgctgacctgcgggtgaccagagatgcctctgtgctgaaggccttccagaagacagatgactgcagcaatgaggtggtgcctgtggatgccaccccagagtggctgagcctcatcagcatcatggagaaggacatcgtgaacctgtaccgccacagcaacagcagcggccactgcagcgtggagggggagacagctgaggacaaggagatccagaggatcaatgagcacccctacaggaagtgcagcgacagcgccctgagtgaccacgagagccgggtgcctgacagcggcatcccccgggacagcgaccagctgagctgcctgtctggagaaacagatgtgatggtgacagctgagacagctgaggccagccagacctttggagagggggaccagggcgagggctgcagcaccacctgtgcccagaacaacgtgctgccccagacagtgcagaagcgggaggccaaggagagcatcctggctgatgtgaggaaggagagcgtcttcatcagcggggaccaggaggtgcgctgtgccgccctgagcacccagaccaccagtgaccatgatggcaaggacaactaccactggaactacctgctgtcctgggagcccaagttccagcccctggccagcgtcttcaatgacatcgccaagctgaaggatgagcacctgcacatgcctggcatccccaaggagaagaagagctttgtgttccccccacccctcatcacagctgtggcccagcccggcatcaaggctgtgccccccaggatgcctgctgtgaacctgggccaggtgccccccaagcaccccaggagccccatcccctaccacctgggcagcctgcctgagggcatgacccccaacttcagccccagcctgagcctgctgaccatgcagcccccagccctgagccccctgctgcgggagggggagctgctgggcacccacatcagcggcacctgccacgagctgaaggcagaagatgaggtgcagatctag

SEQ ID NO: 149246 - DNA, 2130 bp, Artificial Sequence
  Description of Artificial Sequence: Synthetic coding sequence
atgagcccctgtggcaggaagatgggagagggccggcagcagaggcgggcccctgtgggcaagctgctgctgctgcccggccggcgggacacccctcatggccgcagcggcagcagcggggcccggacccagaggagcctgctgtggctgctggtgcacgtgtggctgtgggccgccagcggcagcagcgcccagctgttcaacctgaccctgtctgtggatgagggcctgcccccagacaccctggtgggggacatccgggccggcctgcctgctgcccagcagcaggagggcagcggcttcttcctgtctgaagattctgatgacagccccctgctggatgacttccacgtgcacccagacaccggcatcatcagaacagcccggcggctggaccgggagcggcgggaccactacagctttgtggccgccaccctgctgggcgctgtggtgcaggtggagatccgggtgaatgatgtgaatgaccacagcccccgcttccccctggacagcctgcagctggatgtgtctgagctgagccccccaggcacagccttccggctgcctgtggcccatgaccctgatgctggcctcttcagcacccagggctacaccctggtgcagcccagcgacctgcccaaggaccctgctggccccttcttccagctgcgctaccgcaccccaggccccctgcccagccccctgctgcccggcagcagcagccccctggagcccctggacctggtgctgctgcggcggctggaccgggaggaggccgccgcccaccggctgcagatcgaggcctgggatggcggccggcccaggagaacaggcctgctgtctgtggagctgcgggtgctggatgaaaatgacaacccccctgtgtttgagcaggatgagtacagagctgctgtgagagaagatgcccagcctggagctgaggtgtgccgggtgcgggccacagaccgggacctgggccccaacggctttgtgcgctacagcgtgcgggcccggcaggtgcctggagctggcagcggcggcggggccctgggagatgctgcctactttgctgtggaggagctgagcggcgtggtgcgggtgtggaggcccctggaccgggaggcccaggcctggcaccagctggtggtggaggccagagatggaggagctgagcctgaggtggccaccgtgcgggtgtccattgctgtgctggatgtgaatgacaacagacctgccatccacgtgctcttcctgacagaaggaggagtggcccgggtgtctgagggcgcccggcctggggactatgtggcccgggtgtctgtgtctgatgctgatggagactgggagaaggaggatgaggccactggagagctgggcgtgggcctgggagatggcagcatcagcctgagcctggagggcggggagggggactttgccctgctgcccggcggccccccaggagtcttcttcctgtgtgtggagggccccctggaccgggagagccgggacctgtatgagctgctgctggtggccacagatgctggcagcccccccctgagcacagaggagaccctgctgctgcgggtggccgacctgaatgaccagcccccactcttcagccagcagcactacaaggcctctgtgtctgaggccgccgcccctggcaccgtggtgatgtgggtgtctgccagtgatgctgatgaagctggcagtgaccacgcctggctgcgctacacagtggtgcagctgagcgccccctgcaacctgggcagcctgcagagcaagatggtgcacacagcagaatgtggccccagctttgccatcgacagcgagagcggggccatcagcaccatccgcaccctggaccgggaggtgcaggaggccgtggagctgaaggtggtggcccaggacctgggggagccccccctgagcgccacctgcctggtgtccatcaccgtggatgatgtgaatgacaatgagcccatcttctggaggcaggtgtacaatgccaccatcgccgagcacgcccctgtgggccactgcttcctgcagctgatcagcgcccaggtggcctttgtgaagatcaagcagaagcagaaggagatccaggagaagcagaacctggcctag

SEQ ID NO: 149247 - DNA, 2109 bp, Artificial Sequence
  Description of Artificial Sequence: Synthetic coding sequence
atgggagagggccggcagcagaggcgggcccctgtgggcaagctgctgctgctgcctggaagaagagacaccccccacggccgcagcggcagcagcggggcccggacccagaggagcctgctgtggctgctggtgcacgtgtggctgtgggccgccagcggcagcagcgcccagctgttcaacctgaccctgtctgtggatgagggcctgcccccagacaccctggtgggggacatccgggccggcctgcctgctgcccagcagcaggagggcagcggcttcttcctgtctgaggacagtgatgacagccccctgctggatgacttccacgtgcacccagacaccggcatcatcagaacagcccggcggctggaccgggagcggcgggaccactacagctttgtggccgccaccctgctgggcgctgtggtgcaggtggagatccgggtgaatgatgtgaatgaccacagcccccgcttccccctggacagcctgcagctggatgtgtctgagctgagccccccaggcacagccttccggctgcctgtggcccatgaccctgatgctggcctcttcagcacccagggctacaccctggtgcagcccagcgacctgcccaaggaccctgctggccccttcttccagctgcgctaccgcaccccaggccccctgcccagccccctgctgcccggcagcagcagccccctggagcccctggacctggtgctgctgcggcggctggaccgggaggaggccgccgcccaccggctgcagatcgaggcctgggatggcggccggcccaggagaacaggcctgctgtctgtggagctgcgggtgctggatgaaaatgacaacccccctgtgtttgagcaggatgagtacagagctgctgtgcgggaggatgcccagcccggggctgaggtgtgccgggtgcgggccacagaccgggacctgggccccaatggatttgtgcgctacagcgtgcgggcccggcaggtgcctggggccggcagcggcggcggggccctgggagatgctgcctactttgctgtggaggagctgtctggagtggtgcgggtgtggaggcccctggaccgggaggcccaggcctggcaccagctggtggtggaggccagagatggcggcgctgagcctgaggtggccaccgtgcgggtgtccattgctgtgctggatgtgaatgacaacagacctgccatccacgtgctcttcctgacagagggcggcgtggcccgggtgtctgagggcgcccggcctggggactatgtggcccgggtgtctgtgtctgatgctgatggagactgggagaaggaggatgaggccaccggggagctgggcgtgggcctgggagatggcagcatcagcctgagcctggagggcggggagggggactttgccctgctgcccggcggccccccaggagtcttcttcctgtgtgtggagggccccctggaccgggagagccgggacctgtatgagctgctgctggtggccacagatgctggcagcccccccctgagcacagaggagaccctgctgctgcgggtggccgacctgaatgaccagcccccactcttcagccagcagcactacaaggcctctgtgtctgaggccgccgcccctggcaccgtggtgatgtgggtgtctgccagtgatgctgatgaggccggcagtgaccacgcctggctgcgctacacagtggtgcagctgagcgccccctgcaacctgggcagcctgcagagcaagatggtgcacacagcagaatgtggccccagctttgccattgattctgagagcggggccatcagcaccatccgcaccctggaccgggaggtgcaggaggccgtggagctgaaggtggtggcccaggacctgggggagccccccctgagcgccacctgcctggtgtccatcaccgtggatgatgtgaatgacaatgagcccatcttctggaggcaggtgtacaatgccaccatcgccgagcacgcccctgtgggccactgcttcctgcagctgatcagcgcccaggtggcctttgtgaagatcaagcagaagcagaaggagatccaggagaagcagaacctggcctag

SEQ ID NO: 149248 - DNA, 4101 bp, Artificial Sequence
  Description of Artificial Sequence: Synthetic coding sequence
atgagcccctgtggcaggaagatgggagagggccggcagcagaggcgggcccctgtgggcaagctgctgctgctgcccggccggcgggacacccctcatggccgcagcggcagcagcggggcccggacccagaggagcctgctgtggctgctggtgcacgtgtggctgtgggccgccagcggcagcagcgcccagctgttcaacctgaccctgtctgtggatgagggcctgcccccagacaccctggtgggggacatccgggccggcctgcctgctgcccagcagcaggagggcagcggcttcttcctgtctgaagattctgatgacagccccctgctggatgacttccacgtgcacccagacaccggcatcatcagaacagcccggcggctggaccgggagcggcgggaccactacagctttgtggccgccaccctgctgggcgctgtggtgcaggtggagatccgggtgaatgatgtgaatgaccacagcccccgcttccccctggacagcctgcagctggatgtgtctgagctgagccccccaggcacagccttccggctgcctgtggcccatgaccctgatgctggcctcttcagcacccagggctacaccctggtgcagcccagcgacctgcccaaggaccctgctggccccttcttccagctgcgctaccgcaccccaggccccctgcccagccccctgctgcccggcagcagcagccccctggagcccctggacctggtgctgctgcggcggctggaccgggaggaggccgccgcccaccggctgcagatcgaggcctgggatggcggccggcccaggagaacaggcctgctgtctgtggagctgcgggtgctggatgaaaatgacaacccccctgtgtttgagcaggatgagtacagagctgctgtgagagaagatgcccagcctggagctgaggtgtgccgggtgcgggccacagaccgggacctgggccccaacggctttgtgcgctacagcgtgcgggcccggcaggtgcctggagctggcagcggcggcggggccctgggagatgctgcctactttgctgtggaggagctgagcggcgtggtgcgggtgtggaggcccctggaccgggaggcccaggcctggcaccagctggtggtggaggccagagatggaggagctgagcctgaggtggccaccgtgcgggtgtccattgctgtgctggatgtgaatgacaacagacctgccatccacgtgctcttcctgacagaaggaggagtggcccgggtgtctgagggcgcccggcctggggactatgtggcccgggtgtctgtgtctgatgctgatggagactgggagaaggaggatgaggccactggagagctgggcgtgggcctgggagatggcagcatcagcctgagcctggagggcggggagggggactttgccctgctgcccggcggccccccaggagtcttcttcctgtgtgtggagggccccctggaccgggagagccgggacctgtatgagctgctgctggtggccacagatgctggcagcccccccctgagcacagaggagaccctgctgctgcgggtggccgacctgaatgaccagcccccactcttcagccagcagcactacaaggcctctgtgtctgaggccgccgcccctggcaccgtggtgatgtgggtgtctgccagtgatgctgatgaagctggcagtgaccacgcctggctgcgctacacagtggtgcagctgagcgccccctgcaacctgggcagcctgcagagcaagatggtgcacacagcagaatgtggccccagctttgccatcgacagcgagagcggggccatcagcaccatccgcaccctggaccgggaggtgcaggaggccgtggagctgaaggtggtggcccaggacctgggggagccccccctgagcgccacctgcctggtgtccatcaccgtggatgatgtgaatgacaatgagcccatcttctggaggcaggtgtacaatgccaccatcgccgagcacgcccctgtgggccactgcttcctgcaggtgacagccagtgatgctgacagcggcctgtatggcttcatcgagtacagcctgtatgatggcttcctgtcctatgaggccccccaggccttcagaattgacccccatgatggccagatctgtgtgtcccaggacatcgaccgggagcgggaccctgccacctatgacctgctggtggaggccaaggatggcggcggcctgagcgcccaggcctttgtgcgggtggacctggaggatgtgaatgacaaccaccctgtgttcaaccccagcacctacgtgaccagcatcagtgatgagacccagcccggcacagagatcatcaacgtgctggccacagaccaggacagcggcatctatggaacagtggcctatgagctgatccctggaaatgtgagcagcctcttcaccatcgacagcaccaccggcatcatctacctgaccctgcccctgagccacctggagagcaccaccctgagcctgatggtgtctgcccaggacggcggcggcctgacagctgtgatcaatgctgatgtgaccatccacatcttccagaccaccctggccccagctgagtttgagcggcccaagtacaccttcctggtgtatgaagatgtgcctgaggacagccccatcggcaccgtgaaggcccgggagcccctgaacagcagcgagcccatcttctaccgcatcagcagcggggacctgggcggcaagttcagcatccacccccggctgggcaccatccgcaccaggaagcccctggaccacgagacccagcctgtggtggtgctgactgtgcaggcccagctgggcagcgccccagcctgcagcagcacagaggtgaacatcaccgtgatggatgtgaatgacaaccacccagccttcctgcggaccagtgatgagatccgcatcagccagaccaccccacctggaacagccctgtacctggcccgggcagaggaccgggacagcggcagaaatggcctcatccgctacagcatcgccagcccccagcccggggtgtttgccatcgaccgggccctgggcgtgctcttcctgaatggcagcctgggcgctggggagcagcgggagctgaccctgaccctgcgggcagaggaccagggcgtgcacccccaggccgccctgctggtgctgactgtggtgattgagaagcgggagcacagccccagctggacctttgagcacctggtgtaccaggtggaggtgtctgagagcctgagccccatgacccagatgctgcagacccaggcccaccccctgggcccccagagagctgccagccccctgcgctacagcctggagcccagcgtggacagcgccatgtttggcatccggccctacacaggctggatctacctgcggcggcagtttgattatgagagcacccagacctacaacttccgggtgtttgcctggatcccagaagatggcttcctgcagaatgtgtccaccaccgtcatcgtgcgggtgtgggatgaaaatgacaacagccccaccttcctgcatgatgtgctcttcctgaaggtggaggagagccctgtgccccagggcgtcatcggcaagatcacagccatcgacatggacagcggcaagaatggccagctgctgtacttcctgctgagtgatggcaagttcttcaagatgaaccccaacacaggagagctgatcaactgggtggccctggaccgggagcaccggggccaccacgagatgacagtgctggtgacagaccggggcagccccccaagaaatgccaccatggctgtgtatgtgtctgtgacagacatcaatgacaaccggcccttcttcccccagtgcctgcccgggaaggagctgcacgtgaaggtgctggagggccagcctgtgaacatgctggtgaccaccgtgtttgccaaggaccctgatgagggcaacaatgctgaggtgacctacagcgtgtcctctgcccggcccatgcccctgaagggcaagacagccttcggcaagcagagctgcaagaagcagaccaacaagcagaccaagagctag

SEQ ID NO: 149249 - DNA, 462 bp, Artificial Sequence
  Description of Artificial Sequence: Synthetic coding sequence
atgctggagaagctgatgggcgctgacagcctgcagctgttccgcagccgctacaccctgggcaagatctacttcatcggcttccagaggagcatcctgctgagcaagtctgagaacagcctgaacagcatcgccaaggagacagaggagggccgggagaccgtgaccaggaaggagggctggaagagaagacatgaagatggctacctggagatggcccagaggcacctgcagaggagcctgtgcccctgggtgtcctacctgccccagccctatgcagagctggaggaggtgagcagccacgtgggcaaggtgttcatggccagaaattatgagttcctggcctatgaggccagcaaggaccggcggcagcccctggagaggatgtggacctgcaactacaaccagcagaaggaccagagctgcaaccacaaggagatcaccagcaccaaggccgagtag

SEQ ID NO: 149250 - DNA, 249 bp, Artificial Sequence
  Description of Artificial Sequence: Synthetic coding sequence
atggcccagaggcacctgcagaggagcctgtgcccctgggtgtcctacctgccccagccctatgcagagctggaggaggtgagcagccacgtgggcaaggtgttcatggccaggaactatgagttcctggcctatgaggccagcaaggaccggcggcagcccctggagaggatgtggacctgcaactacaaccagcagaaggaccagagctgcaaccacaaggagatcaccagcaccaaggccgagtag

SEQ ID NO: 149251 - DNA, 378 bp, Artificial Sequence
  Description of Artificial Sequence: Synthetic coding sequence
atgaggacagccatctggaagtggcaccggggcatctacagagaccactacgtgctgggcagcctgaccttcctgagccccatgcagagagctggcaccagcaaccagtggaacatgggcaaggtgatgaccctggacagcggagatgaggtgaccttccacaagacctggcccacagaaacaggcagcccctaccgcctggaggaggtgagcagccacgtgggcaaggtgttcatggccagaaattatgagttcctggcctatgaggccagcaaggaccggcggcagcccctggagaggatgtggacctgcaactacaaccagcagaaggaccagagctgcaaccacaaggagatcaccagcaccaaggccgagtag

SEQ ID NO: 149252 - DNA, 1725 bp, Artificial Sequence
  Description of Artificial Sequence: Synthetic coding sequence
atggagctgaaggccgaggaggaggaggtgggcggcgtgcagcctgtgtccatccaggcctttgccagcagcagcaccctgcacggcctggcccacatcttctcctatgaaaggctgagcctgaagagggccctgtgggccctgtgcttcctgggcagcctggccgtgctgctgtgtgtgtgcacagagcgggtgcagtactacttccactaccaccacgtgaccaagctggatgaggtggccgccagccagctgaccttccctgctgtgaccctgtgcaacctgaatgagttccgcttcagccaggtgtccaagaatgacctgtaccacgccggggagctgctggccctgctgaacaacagatatgagatcccagacacccagatggctgatgagaagcagctggagatcctgcaggacaaggccaacttccgctccttcaagcccaagcccttcaacatgagggagttctatgacagagctggccatgacatccgggacatgctgctgagctgccacttccggggggaggtgtgcagcgctgaggacttcaaggtggtgttcaccaggtatggcaagtgctacaccttcaacagcggcagagatggccggccccggctgaagaccatgaagggcggcactggaaatggcctggagatcatgctggacatccagcaggatgagtacctgcctgtgtggggcgagacagatgagaccagctttgaagctggcatcaaggtgcagatccacagccaggatgagccccccttcatcgaccagctgggctttggagtggcccctggcttccagacctttgtggcctgccaggagcagaggctcatctacctgcccccaccctggggcacctgcaaggctgtgaccatggacagcgacctggacttctttgacagctacagcatcacagcctgcagaattgactgtgagacccgctacctggtggagaactgcaactgcaggatggtgcacatgcctggagatgccccctactgcaccccagagcagtacaaggaatgtgccgaccctgccctggacttcctggtggagaaggaccaggagtactgtgtgtgtgagatgccctgcaacctgaccaggtatggcaaggagctgtccatggtgaagatccccagcaaggccagcgccaagtacctggccaagaagttcaacaagtctgagcagtacatcggggagaacatcctggtgctggacatcttctttgaggtgctgaactatgagaccatcgagcagaagaaggcctatgaaattgctggcctgctgggggagctgctgatgacccctgtgcccttcagctgccacggccatggagtggccccctaccaccccaaggccggctgcagcctgctgagccatgagggccccccaccccagaggcccttccccaagccctgctgcctgggggacattggaggccagatgggcctcttcatcggggccagcatcctgactgtgctggagctgtttgattatgcctatgaggtgatcaagcacaagctgtgcagaagaggcaagtgccagaaggaggccaagaggagcagcgctgacaagggcgtggccctgagcctggatgatgtgaagaggcacaacccctgtgagagcctgcggggccaccctgctggcatgacctacgccgccaacatcctgccccaccacccagcccggggcacctttgaggacttcacctgctag

SEQ ID NO: 149253 - DNA, 594 bp, Artificial Sequence
  Description of Artificial Sequence: Synthetic coding sequence
atgagggtggtggtgattggagctggggtgattggcctgagcacagccctgtgcatccacgagcgctaccacagcgtgctgcagcccctggacatcaaggtgtatgctgaccgcttcacccccctgaccaccacagatgtggccgccggcctgtggcagccctacctgagtgaccccaacaacccccaggaggccgactggagccagcagacctttgactacctgctgagccacgtgcacagccccaatgctgagaacctgggcctcttcctgatcagcggctacaacctcttccacgaggccatcccagaccccagctggaaggacacagtgctgggcttcaggaagctgaccccccgggagctggacatgtttcctgactatggctacggctggttccacaccagcctcatcctggagggcaagaactacctgcagtggctgacagagcggctgacagagcggggcgtgaagttcttccagaggaaggtggagagctttgaggaggtggcccgggagggcgcagatgtgattgtgaactgcaccggggtgtgggccggggccctgcagagggaccccctgctgcagccctag

SEQ ID NO: 149254 - DNA, 2400 bp, Artificial Sequence
  Description of Artificial Sequence: Synthetic coding sequence
atgaagcccagccctgctggaacagccaaggagctggagcccccagccccagcccggggggagcagaggacagctgagcctgagggccgctggagggagaagggggaggccgacacagagcggcagaggacccgggagcggcaggaggccaccctggccggcctggccgagctggagtacctgcggcagaggcaggagctgctggtgcggggggccctgcggggggccggcggggccggggccgccgccccccgggccggggagctgctgggggaggccgcccagaggagccggctggaggagaagttcctggaggagaacatcctgctgctgaggaagcagctgaactgcctgcggaggagagatgctggcctgctgaaccagctgcaggagctggacaagcagatcagtgacctgcggctggatgtggagaagaccagcgaggagcacctggagacagacagccggcccagcagcggcttctatgagctgagtgatggagccagcggcagcctgagcaacagcagcaacagcgtcttcagcgagtgcctgagcagctgccacagcagcacctgcttctgcagccccctggaggccaccctgagcctgagtgatggctgccccaagtctgcagatgtgaaccccaagtaccagtgtgacctggtgtccaagaatggaaatgatgtgtaccgctaccccagccccctgcatgctgtggccgtgcagagccccatgttcctgctgtgcctgactggaaaccccctgcgggaggaggaccggctgggcaaccacgccagtgacatctgtggcggcagcgagctggatgctgtgaagacagacagcagcctgcccagccccagcagcctgtggagcgccagccaccccagcagcagcaagaagatggatggctacatcctgagcctggtgcagaagaagacccaccctgtgaggaccaacaagcccaggacctctgtgaatgctgaccccaccaagggcctgctgagaaatggatctgtgtgtgtgcgggcccctgggggcgtgtcccagggcaacagcgtgaacctgaagaacagcaagcaggcctgcctgcccagcggcggcatccccagcctgaacaacggcaccttcagcccccccaagcagtggagcaaggagagcaaggccgagcaggccgagagcaagagggtgcccctgcctgagggctgccccagcggggccgccagtgacctgcagagcaagcacctgcccaagacagccaagccagccagccaggagcacgcccgctgcagcgccatcggcaccggggagagccccaaggagagcgcccagctgagcggggccagccccaaggagagccccagccggggccctgccccaccccaggagaacaaggtggtgcagcccctgaagaagatgagccagaagaacagcctgcagggcgtgcccccagccaccccacccctgctgagcacagccttccctgtggaggagaggcctgccctggacttcaagtctgagggcagcagccagagcctggaggaggcccacctggtgaaggcccagttcatccctggccagcagcccagcgtgcggctgcaccggggccacaggaacatgggcgtggtgaagaacagcagcctgaagcaccggggccctgccctgcagggcctggagaatggcctgcccaccgtgcgggagaagacccgggccggcagcaagaagtgccgcttcccagatgacctggacaccaacaagaagctgaagaaggccagcagcaaaggaaggaagagcggcggcggccctgaggccggcgtgcccggccggcctgctgggggcggccaccgggccggcagccgggcccacggccacggccgggaggccgtggtggccaagcccaagcacaagaggacagactaccgccgctggaagagcagcgctgagatctcctatgaggaggccctgcggcgggcccggcggggcagaagagaaaatgtgggcctgtacccagcccctgtgcccctgccctatgccagcccctatgcctacgtggccagtgacagcgagtacagcgcagaatgtgagagcctcttccacagcacagtggtggacaccagtgaagatgagcagagcaactacaccaccaactgctttggagacagcgagagctctgtgtctgagggggagtttgtgggggagagcaccaccaccagtgacagcgaggagagcggcggcctcatctggagccagtttgtgcagaccctgcccatccagacagtgacagccccagacctgcacaaccacccagccaagacctttgtgaagatcaaggccagccacaacctgaagaagaagatcctgcgcttccgcagcggcagcctgaagctgatgaccaccgtgtag

SEQ ID NO: 149255 - DNA, 2511 bp, Artificial Sequence
  Description of Artificial Sequence: Synthetic coding sequence
atgaagcccagccctgctggaacagccaaggagctggagcccccagccccagcccggggggagcagaggacagctgagcctgagggccgctggagggagaagggggaggccgacacagagcggcagaggacccgggagcggcaggaggccaccctggccggcctggccgagctggagtacctgcggcagaggcaggagctgctggtgcggggggccctgcggggggccggcggggccggggccgccgccccccgggccggggagctgctgggggaggccgcccagaggagccggctggaggagaagttcctggaggagaacatcctgctgctgaggaagcagctgaactgcctgcggaggagagatgctggcctgctgaaccagctgcaggagctggacaagcagatcagtgacctgcggctggatgtggagaagaccagcgaggagcacctggagacagacagccggcccagcagcggcttctatgagctgagtgatggagccagcggcagcctgagcaacagcagcaacagcgtcttcagcgagtgcctgagcagctgccacagcagcacctgcttctgcagccccctggaggccaccctgagcctgagtgatggctgccccaagtctgctgacctgattggcctgctggagtacaaggagggccactgtgaggaccaggccagcggggctgtgtgccgcagcctgagcaccccccagttcaacagcctggatgtgattgctgatgtgaaccccaagtaccagtgtgacctggtgtccaagaatggaaatgatgtgtaccgctaccccagccccctgcatgctgtggccgtgcagagccccatgttcctgctgtgcctgaccggcaaccccctgcgggaggaggaccggctgggcaaccacgccagtgacatctgtggcggcagcgagctggatgctgtgaagacagacagcagcctgcccagccccagcagcctgtggagcgccagccaccccagcagcagcaagaagatggatggctacatcctgagcctggtgcagaagaagacccaccctgtgaggaccaacaagcccaggacctctgtgaatgctgaccccaccaagggcctgctgagaaatggatctgtgtgtgtgcgggcccctggaggagtgtcccagggcaacagcgtgaacctgaagaacagcaagcaggcctgcctgcccagcggcggcatccccagcctgaacaacggcaccttcagcccccccaagcagtggagcaaggagagcaaggccgagcaggccgagagcaagagggtgcccctgcctgagggctgccccagcggggccgccagtgacctgcagagcaagcacctgcccaagacagccaagccagccagccaggagcacgcccgctgcagcgccatcggcactggagagagccccaaggagagcgcccagctgagcggggccagccccaaggagagccccagccggggccctgccccaccccaggagaacaaggtggtgcagcccctgaagaagatgagccagaagaacagcctgcagggcgtgcccccagccaccccacccctgctgagcacagccttccctgtggaggagaggcctgccctggacttcaagtctgagggcagcagccagagcctggaggaggcccacctggtgaaggcccagttcatccctggccagcagcccagcgtgcggctgcaccggggccacaggaacatgggcgtggtgaagaacagcagcctgaagcaccggggccctgccctgcagggcctggagaatggcctgcccaccgtgcgggagaagaccagggctggcagcaagaagtgccgcttcccagatgacctggacaccaacaagaagctgaagaaggccagcagcaagggcaggaagagcggcggcggccctgaggccggcgtgcccggccggcctgctgggggcggccacagagctggcagccgggcccacggccacggccgggaggccgtggtggccaagcccaagcacaagaggacagactaccgccgctggaagagcagcgctgagatctcctatgaggaggccctgcggcgggcccggcggggccggcgggagaatgtgggcctgtacccagcccctgtgcccctgccctatgccagcccctatgcctacgtggccagtgacagcgagtacagcgcagaatgtgagagcctcttccacagcacagtggtggacaccagtgaagatgagcagagcaactacaccaccaactgcttcggggacagcgagagctctgtgtctgagggggagtttgtgggggagagcaccaccaccagtgacagcgaggagagcggcggcctcatctggagccagtttgtgcagaccctgcccatccagacagtgacagccccagacctgcacaaccacccagccaagacctttgtgaagatcaaggccagccacaacctgaagaagaagatcctgcgcttccgcagcggcagcctgaagctgatgaccaccgtgtag

SEQ ID NO: 149256 - DNA, 2325 bp, Artificial Sequence
  Description of Artificial Sequence: Synthetic coding sequence
atgtggacccctgggggccccccaggcagcgctggctgggacagaagaaggctgggcgcccggctgcgggccgcctttgctggcctgcaggagctgcagggcctgcgggccacccagcaggagcgggtgcggggggccctggccctgcagcccccaccagccccagctgccccctgtggcccccacggcctgcacggccctgagcagcagctggaggccgccctggccgccctgcaggagcagctgagccggctgcggcagcaggacatcggcctgaagacccacctggaccagctggacctgcagatcagcaagctgcagctggatgtgggcacagccagcggggaggccctggacagcgacagccggcccagcagcggcttctatgagatgtctgatggcggcagctgcagcctgagcaccagctgtgcctctgtgtgcagcgaccacatcagccccagcctgggcagcctgctgcctgtggcccaggcccacaaggcccggcccagcatgggagactggaggcccaggtctgtggatgagaccaccgtgcctgcctggaggccccaggccacagaggagggcgcccggcccccaggctctgtggaggatgctggccagccctggggcaccttctggcccaggcctgtgtccactggagacctggaccgggccctgcctgctgacaccggcctgcagaaggccagcgcagatgctgagctgctgggcctgctgtgccagggcgtggacatccccctgcacgtgcctgaccccaagtaccggcaggacctggtgtcccagggcggccgggaggtgtacccctaccccagccccctgcatgctgtggccctgcagagccccctgtttgtgctgaccaaggagaccccccagagaggaggccccagcttcccccgggagagcccccggggccctgctggcctgaacaccatccagacaggccctgtgctggaggccggccctgcccgggcccgggcctacatcgaccggctgctgcacctgtggggccgggagaccccagccaagggcagcgagggggagcagggccccctgcggcatgctgccagccccagcccccagaggcagggcggctggagcacagatggcggcggccgcctgctggtgtttgcccctggaagagaagatgagggcggccctgcccagagcagaggagctggccggggcggcccccagcagcagggctacatgcccctggagggcccccagcagagcggcagcctgcctgaggagggcagcaagcccagcaacagctgtgtgctgcgggagaccatggtgcaggccagccccagcagcaaggcccagcagaccccatctgcccaggactatggccggggcaacatcatcagccccagcaggatgctggacaagagccccagccctgccagcggccactttgcccaccccagctttgctgccagcctgaagatgggcccccccaagagcaaggccgagaagatcaagaggagccccatggacaaggtgctgcgctttgcccggcagcccctgctgctgctggacaggcctgagggcgcccacgccgccccccagcccagcctggagtgggaccctgcccactggcccaccggccggggcggcctgcagaggaggcctgccctggcctgggaggcccctggccgcagctgcagcgagagcaccctgtaccccatgcctgtgctggtgcccctggccgtggccccccaggagagccacaggaccagcgcccaggccctcttcccctttgaggccagcctgctgacctctgtggcccggaggaagcaccggcgctggcagagcacagtggagatcagcgcccgggcccggctggccagctgcccagagagcaacctgggcccccccaggcctgtggccaggagagctgggggccccctggcccggggccggcccagcctggtgcggcaggatgcctacaccaggagtgacagcgagcccagcaagcacagcgcagaatgtgacccccgcttccccagcgtcatccctgagaccagcgagggggagagcagtgaccacaccaccaacagatttggagaccgggagagcagcagcagtgatgaggagggcggggcccagagccgggactgtgacctggccctgggctacgtggccgccggccatgctgagctggcctggacccaggaggcccctgtgagcagcggccccctgctgagccctgtgcccaagctgtgccgcatcaaggccagcaaggccctgaagaagaagatccgccgcttccagcccacagccctgaaggtgatgaccatggtgtag

SEQ ID NO: 149257 - DNA, 843 bp, Artificial Sequence
  Description of Artificial Sequence: Synthetic coding sequence
atgtggacccctgggggccccccaggcagcgctggctgggacagaagaaggctgggcgcccggctgcgggccgcctttgctggcctgcaggagctgcagggcctgcgggccacccagcaggagcgggtgcggggggccctggccctgcagcccccaccagccccagctgccccctgtggcccccacggcctgcacggccctgagcagcagctggaggccgccctggccgccctgcaggagcagctgagccggctgcggcagcaggacatcggcctgaagacccacctggaccagctggacctgcagatcagcaagctgcagctggatgtgggcacagccagcggggaggccctggacagcgacagccggcccagcagcggcttctatgagatgtctgatggcggcagctgcagcctgagcaccagctgtgcctctgtgtgcagcgaccacatcagccccagcctgggcagcctgctgcctgtggcccaggcccacaaggcccggcccagcatgggagactggaggcccaggtctgtggatgagaccaccgtgcctgcctggaggccccaggccacagaggagggcgcccggcccccaggctctgtggaggatgctggccagccctggggcaccttctggcccaggcctgtgtccacagagctgtgcaatgcccctggagagctggacatgcacgcccctcctgctggctgcaccagcagcagcctgactggagtgggcagcggcctgcggggcaaatgtggcctgtgtggctgccagctgcccttctgcagcgtgaacaccagcagcaagaccaagagcagcggcatcagccggcagcagtag

SEQ ID NO: 149258 - DNA, 1890 bp, Artificial Sequence
  Description of Artificial Sequence: Synthetic coding sequence
atgatccgggccttctccttccctgtgtccccagagcggggccgcctgcggggctggctggagggcagcctggccggcctgtgtgagctgcactggctgcgggagcggcaggagtacagagtgcagcaggccctgcggctggcccagcccggcatgggcggcgctgaggccgaggatgaagaagatgctgatgaagatgaagatgctgctgctgccaggagagctgctgctgccctggaggagcagctggaggccctgcccggcctggtgtgggacctgggccagcagctgggggacctgagcctggagagcggcggcctggagcaggagagcggccgcagcagcggcttctatgaggaccccagcagcactggaggccctgacagcccccccagcaccttctgtggggacagcggcttcagcggcagcagcagctatggccgcctgggccccagcgagccccggggcatctatgccagcgagcggcccaagagcctgggagatgccagccccagcgcccctgaggtggtgggcgcccgggctgctgtgcccaggagcttcagcgccccctaccccacagctgggggcagcgctggccctgaggcctgcagcagcgctgagcggcgggcccgggccggccccttcctgacccccagccccctgcatgctgtggccatgaggagcccccggccctgtggccggcccccaacagacagcccagatgctgggggcgccggccggcccctggatggctacatcagcgccctgctgcggaggagaagaagaagaggagctggccagcccaggaccagccctgggggcgcagatggcggcccccggcggcagaacagcgtgcggcagaggcccccagatgccagccccagccctggcagcgcccggcctgcccgggagcccagcctggagcgggtgggcggccaccccaccagccctgctgccctgagccgggcctgggccagctcctgggagagcgaggccgcccctgagcctgctgcccctcctgctgcccccagccccccagacagccctgctgagggccgcctggtgaaggcccagtacatccctggggcccaggccgccacccggggcctgcccggccgggccgcccggaggaagcccccacccctgacccggggccgctctgtggagcagagccccccccgggagcggcccagggctgctggccggcggggccgcatggccgaggccagcggccggcggggcagcccccgggccaggaaggccagccgcagccagagcgagaccagcctgctgggccgggccagcgctgtgcccagcggcccccccaagtaccccacagctgagcgggaggagccccggcccccccggccccggcggggccctgcccccaccctggccgcccaggccgccggcagctgccgccgctggaggagcacagctgagattgatgctgctgatggccggcgggtgcggccccgggccccagctgcccgggtgcccggccctggccccagccccagcgccccccagaggcggctgctgtatggctgtgccggcagtgacagtgaatgttctgctggccgcctgggccccctgggccggcggggccctgctgggggcgtgggcggcggctatggagagagcgagagcagcgccagcgagggggagagccctgccttcagcagcgccagcagtgacagtgatggcagcggcggcctggtgtggccccagcagctggtggccgccacagctgccagcggcggcggggccggggccggggccccagctggccctgccaaggtgtttgtgaagatcaaggccagccacgccctgaagaagaagatcctgcgcttccgcagcggcagcctgaaggtgatgaccaccgtgtag

SEQ ID NO: 149259 - DNA, 2025 bp, Artificial Sequence
  Description of Artificial Sequence: Synthetic coding sequence
atgaacagcggggccatgaggatccacagcaagggccacttccagggcggcatccaggtgaagaatgagaagaaccggcccagcctgaagagcctgaagacagacaacagacctgagaagagcaagtgcaagcccctgtggggcaaggtgttctacctggacctgcccagcgtgaccatcagcgagaagctgcagaaggacatcaaggacctgggcggccgggtggaggagttcctgagcaaggacatctcctacctgatcagcaacaagaaggaggccaagtttgcccagaccctgggccgcatcagccctgtgcccagccctgagagcgcctacacagctgagaccaccagcccccaccccagccatgatggcagcagcttcaagagcccagacacagtgtgcctgagccggggcaagctgctggtggagaaggccatcaaggaccatgacttcatccccagcaacagcatcctgagcaatgccctgtcctggggcgtgaagatcctgcacattgatgacatccgctactacatcgagcagaagaagaaggagctgtacctgctgaagaagagcagcacctctgtgagagatggcggcaagagggtgggcagcggggcccagaagaccaggacaggccgcctgaagaagccctttgtgaaggtggaggacatgagccagctgtaccggcccttctacctgcagctgaccaacatgcccttcatcaactacagcatccagaagccctgcagcccctttgatgtggacaagcccagctccatgcagaagcagacccaggtgaagctgcgcatccagacagatggagacaagtatggaggcaccagcatccagctgcagctgaaggagaagaagaagaagggctactgtgagtgctgcctgcagaagtatgaggacctggagacccacctgctgtctgagcagcacaggaactttgcccagagcaaccagtaccaggtggtggatgacatcgtgtccaagctggtgtttgattttgtggagtatgagaaggacacccccaagaagaagaggatcaagtacagcgtgggcagcctgagccctgtgtctgcctctgtgctgaagaagacagagcagaaggagaaggtggagctgcagcacatcagccagaaggactgccaggaggatgacaccaccgtgaaggagcagaacttcctgtacaaggagacccaggagacagagaagaagctgctcttcatcagcgagcccatcccccaccccagcaatgagctgcggggcctgaatgagaagatgagcaacaagtgcagcatgctgagcacagcagaagatgacatccggcagaacttcacccagctgcccctgcacaagaacaagcaggagtgcatcctggacatcagcgagcacaccctgtctgaaaatgacctggaggagctgcgggtggaccactacaagtgcaacatccaggcctctgtgcacgtgtctgacttcagcacagacaacagcggcagccagcccaagcagaagagtgacacagtgctcttccctgccaaggacctgaaggagaaggacctgcacagcatcttcacccatgattctggcctcatcaccatcaacagcagccaggagcacctgactgtgcaggccaaggcccccttccacaccccacctgaggagcccaatgaatgtgacttcaagaacatggacagcctgcccagcggcaagatccacaggaaggtgaagatcatcctgggcaggaacaggaaggagaacctggagcccaatgctgagtttgacaagaggacagagttcatcacccaggaggagaaccgcatctgcagcagccctgtgcagagcctgctggacctcttccagaccagcgaggagaagtctgagttcctgggcttcaccagctacacagagaagagcggcatctgcaatgtgctggacatctgggaggaggagaacagcgacaacctgctgacagccttcttcagcagccccagcaccagcaccttcaccggcttctag

SEQ ID NO: 149260 - DNA, 654 bp, Artificial Sequence
  Description of Artificial Sequence: Synthetic coding sequence
atgaacagcggggccatgaggatccacagcaagggccacttccagggcggcatccaggtgaagaatgagaagaaccggcccagcctgaagagcctgaagacagacaacagacctgagaagagcaagtgcaagcccctgtggggcaaggtgttctacctggacctgcccagcgtgaccatcagcgagaagctgcagaaggacatcaaggacctgggcggccgggtggaggagttcctgagcaaggacatctcctacctgatcagcaacaagaaggaggccaagtttgcccagaccctgggccgcatcagccctgtgcccagccctgagagcgcctacacagctgagaccaccagcccccaccccagccatgatggcagcagcttcaagagcccagacacagtgtgcctgagccggggcaagctgctggtggagaaggccatcaaggaccatgacttcatccccagcaacagcatcctgagcaatgccctgtcctggggcgtgaagatcctgcacattgatgacatccgctactacatcgagcagaagaagaaggagctgtacctgctgaagaagagcagcacctctgtgagagatggcggcaagagggtgggcagcggggcccagaagaccaggaaggccctgcagagcatctag

SEQ ID NO: 149261 - DNA, 1848 bp, Artificial Sequence
  Description of Artificial Sequence: Synthetic coding sequence
atgtctgagcccgggaaaggagatgactgcctggagctggagagctccatggccgagagccggctgcgggccccagacctgggcgtgagccgctgcctgggcaagtgccagaagaacagccctggggccaggaagcaccccttcagcggcaagagcttctacctggacctgcctgctgggaagaacctgcagttcctgactggagccatccagcagctgggcggcgtgattgagggcttcctgagcaaggaggtgtcctacatcgtgagcagccggcgggaggtgaaggccgagagcagcggcaagagccaccggggctgccccagccccagccccagcgaggtgcgggtggagaccagcgccatggtggaccccaagggcagccacccccggcccagcaggaagcctgtggacagcgtgcccctgagccggggcaaggagctgctgcagaaggccatccggaaccagggcagcatcagcggcggcggcagcggcggcagcagcagcctgctgaccaatgcccgctcctggggcgtgcgcatcctgcacgtggatgagatgatgatgcacgtgcagcagctgagcctggccagcctgtgtgtgaagaagcagcagcccaagaagccagagggcacctgcccagctgctgagagcaggaccaggaaggtggcccggctgaaggcccccttcctgaagattgaagatgagagcaggaagttccggcccttccaccaccagttcaagagcttccctgagatctccttcctgggccccaaggatgccagcccctttgaggcccccaccaccctgggctccatgcaccacacccgggagagcaaggatggagagcccagccccaggtctgctgcccacaccatgcccaggaggaagaagggctactgtgagtgctgccaggaggcctttgaggagctgcacgtgcacctgcagagcgcccagcacaggagctttgccctggaggcccacctgtatgcagaggtggaccgcatcatcgcccagctgagccacagctttgctgacatccccttccaggccggcctgccccgctggagcggcagccctgccagtgactgtgaccccctgtgcccagagaccctgcacccccaccagcccagccacccccgggccgccagcccccgcatcaggaaggaggacagctgccaggcctctgtgacccagggccgggctgctggccagcagcgctggacagagagcctggatggagtgatgggccccccagccagccacacctgtgtgtctgccaccaccctgctgcctgccctgcccaagggcagccgggagcagggctgcctgtgcccctgcccagccagcttcacccagagccacctggtgaccagcctggccctgctgcccggggagtggagccctgctgaggacatgcccctgcaccccagccaggagaacagctttgccccagctgacatccctgtgaagggccccctgctcttccctgaggcccggccctggctgatgtctgcccgctgctgggtgcggcccttcccctttgtgacctggggctgcctgatcccccatgacaccacccccctgcacgaggaggtgagcccctgcccctgcctgcggctgggctacctgtacctgctgctgacccagagcctgtggtgccgggtgcgggtgcccagcctgagcacagctggccccatccccaggaccagccacccctgcaccctggccttccccagctacctgaatgaccatgacctgggccacctgtgccaggccaagccccagggctggaacaccccccagcccttcctgcactgcggcttcctggccgtggacagcggctag

SEQ ID NO: 149262 - DNA, 1296 bp, Artificial Sequence
  Description of Artificial Sequence: Synthetic coding sequence
atgtctgagcccgggaaaggagatgactgcctggagctggagagctccatggccgagagccggctgcgggccccagacctgggcgtgagccgctgcctgggcaagtgccagaagaacagccctggggccaggaagcaccccttcagcggcaagagcttctacctggacctgcctgctgggaagaacctgcagttcctgactggagccatccagcagctgggcggcgtgattgagggcttcctgagcaaggaggtgtcctacatcgtgagcagccggcgggaggtgaaggccgagagcagcggcaagagccaccggggctgccccagccccagccccagcgaggtgcgggtggagaccagcgccatggtggaccccaagggcagccacccccggcccagcaggaagcctgtggacagcgtgcccctgagccggggcaaggagctgctgcagaaggccatccggaaccagggcagcatcagcggcggcggcagcggcggcagcagcagcctgctgaccaatgcccgctcctggggcgtgcgcatcctgcacgtggatgagatgatgatgcacgtgcagcagctgagcctggccagcctgtgtgtgaagaagcagcagcccaagaagccagagggcacctgcccagctgctgagagcaggaccaggaaggtggcccggctgaaggcccccttcctgaagattgaagatgagagcaggaagttccggcccttccaccaccagttcaagagcttccctgagatctccttcctgggccccaaggatgccagcccctttgaggcccccaccaccctgggctccatgcaccacacccgggagagcaaggatggagagcccagccccaggtctgctgcccacaccatgcccaggaggaagaagggctactgtgagtgctgccaggaggcctttgaggagctgcacgtgcacctgcagagcgcccagcacaggagctttgccctggaggcccacctgtatgcagaggtggaccgcatcatcgcccagctgagccacagctttgctgacatccccttccaggccggcctgccccgctggagcggcagccctgccagtgactgtgaccccctgtgcccagagaccctgcacccccaccagcccagccacccccgggccgccagcccccgcatcaggaaggaggacagctgccaggcctctgtgacccagggccgggctgctggccagcagcgctggacagagagcctggatggagtgatgggccccccagccagccacacctgccaccggccctgccgcctgccctag

SEQ ID NO: 149263 - DNA, 474 bp, Artificial Sequence
  Description of Artificial Sequence: Synthetic coding sequence
atgtctgagcccgggaaaggagatgactgcctggagctggagagctccatggccgagagccggctgcgggccccagacctgggcgtgagccgctgcctgggcaagtgccagaagaacagccctggggccaggaagcaccccttcagcggcaagagcttctacctggacctgcctgctgggaagaacctgcagttcctgactggagccatccagcagctgggcggcgtgattgagggcttcctgagcaaggaggtgtcctacatcgtgagcagccggcgggaggtgaaggccgagagcagcggcaagagccaccggggctgccccagccccagccccagcgaggtgcgggtggagaccagcgccatggtggaccccaagggcagccacccccggcccagcaggaagcctgtggacagcgtgcccctgagccggggcaaggagctgctgcagaaggccatccggaaccagaagtag

SEQ ID NO: 149264 - DNA, 570 bp, Artificial Sequence
  Description of Artificial Sequence: Synthetic coding sequence
atggtgggcggcggccagccctgtggccccaacatgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgaagggctgcagcatgtatgtggccctcttcccctgcaatgaatgtgccaagctgatcatccaggccggcatcaaggaggtgatcttcatgtctgacaagtaccatgacagtgatgaggccacagctgcccggctgctcttcaacatggccggcgtgaccttcaggaagttcatccccaagtgcagcaagatcgtgattgactttgacagcatcaacagccggcccagccagaagctgcagtag

SEQ ID NO: 149265 - DNA, 537 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgaagggctgcagcatgtatgtggccctcttcccctgcaatgaatgtgccaagctgatcatccaggccggcatcaaggaggtgatcttcatgtctgacaagtaccatgacagtgatgaggccacagctgcccggctgctcttcaacatggccggcgtgaccttcaggaagttcatccccaagtgcagcaagatcgtcatcgactttgacagcatcaacagccggcccagccagaagctgcagtag

SEQ ID NO: 149266 - DNA, 510 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgaagggctgcagcatgtatgtggccctcttcccctgcaatgaatgtgccaagctgatcatccaggccggcatcaaggaggtgatcttcatgtctgacaagtaccatgacagtgatgaggccacagctgcccggctgctcttcaacatggccggcgtgaccttcaggaagttcatccccaagtgcagcaagatcgtcatcgactttgacagcatctag

SEQ ID NO: 149267 - DNA, 222 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaactag

SEQ ID NO: 149268 - DNA, 180 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctag

SEQ ID NO: 149269 - DNA, 72 bp, Artificial Sequence
  Description of Artificial Sequence: Synthetic coding sequence
atgtctgaggtgtcctgcaagaagagagatgactacctggagtggccagagtacttcatggctgtggcctag

SEQ ID NO: 149270 - DNA, 363 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgaagggctgcagcatgtatgtggccctcttcccctgcaatgaatgtgccaagctgatcatccaggcctag

SEQ ID NO: 149271 - DNA, 537 bp, Artificial Sequence; identical to SEQ ID NO: 149265
  Description of Artificial Sequence: Synthetic coding sequence

SEQ ID NO: 149272 - DNA, 360 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgaagggctgcagcatgtatgtggccctcttcccctgcaatgaatgtgccaagctgatcatccagtag

SEQ ID NO: 149273 - DNA, 297 bp, Artificial Sequence
  Description of Artificial Sequence: Synthetic coding sequence
atgtctgaggtgtcctgcaagaagagagatgactacctggagtggccagagtacttcatggctgtggccttcctgagcgcccagaggagcaaggaccccaacagccaggtgggcgcctgcatcgtgaacagcgagaacaagatcgtgggcatcggctacaacggcatgcccaacggctgcagtgatgatgtgctgccctggaggagaacagctgagaacaagctggacaccaagtacccctacgtgtgccacgccgagctgaatgccatcatgaacaagaacagcacagatgtgtag

SEQ ID NO: 149274 - DNA, 780 bp, Artificial Sequence
  Description of Artificial Sequence: Synthetic coding sequence
atgaacaagctgaagagcagccagaaggacaaggtgcggcagttcatgatcttcacccagagcagcgagaagacagctgtgtcctgcctgagccagaatgactggaagctggatgtggccacagacaacttcttccagaaccctgagctgtacatccgggagagcgtgaagggcagcctggacaggaagaagctggagcagctgtacaaccgctacaaggacccccaggatgagaacaagattggaattgatggcatccagcagttctgtgatgacctggccctggaccctgccagcatctctgtgctgatcatcgcctggaagttccgggccgccacccagtgtgagttcagcaagcaggagttcatggatggcatgacagagctgggctgtgacagcattgagaagctgaaggcccagatccccaagatggagcaggagctgaaggagcccggccgcttcaaggacttctaccagttcaccttcaactttgccaagaaccctggccagaagggcctggacctggagatggccatcgcctactggaacctggtgctgaatggccgcttcaagttcctggacctgtggaacaagttcctgctggagcaccacaagaggagcatccccaaggacacctggaacctgctgctggacttcagcaccatgattgctgatgacatgagcaactatgatgaggagggcgcctggcctgtgctgattgatgactttgtggagtttgcccggccccagattgctggcaccaagagcaccaccgtgtag

SEQ ID NO: 149275 - DNA, 660 bp, Artificial Sequence
  Description of Artificial Sequence: Synthetic coding sequence
atgaacaagctgaagagcagccagaaggacaaggtgcggcagttcatgatcttcacccagagcagcgagaagacagctgtgtcctgcctgagccagaatgactggaagctggatgtggccacagacaacttcttccagaaccctgagctgtacatccgggagagcgtgaagggcagcctggacaggaagaagctggagcagctgtacaaccgctacaaggacccccaggatgagaacaagattggaattgatggcatgacagagctgggctgtgacagcattgagaagctgaaggcccagatccccaagatggagcaggagctgaaggagcccggccgcttcaaggacttctaccagttcaccttcaactttgccaagaaccctggccagaagggcctggacctggagatggccatcgcctactggaacctggtgctgaatggccgcttcaagttcctggacctgtggaacaagttcctgctggagcaccacaagaggagcatccccaaggacacctggaacctgctgctggacttcagcaccatgattgctgatgacatgagcaactatgatgaggagggcgcctggcctgtgctgattgatgactttgtggagtttgcccggccccagattgctggcaccaagagcaccaccgtgtag

SEQ ID NO: 149276 - DNA, 387 bp, Artificial Sequence
  Description of Artificial Sequence: Synthetic coding sequence
atgatcttcacccagagcagcgagaagacagctgtgtcctgcctgagccagaatgactggaagctggatgtggccacagacaacttcttccagaaccctgagctgtacatccgggagagcgtgaagggcagcctggacaggaagaagctggagcagctgtacaaccgctacaaggacccccaggatgagaacaagattggaattgatggcatccagcagttctgtgatgacctggccctggaccctgccagcatctctgtgctgatcatcgcctggaagttccgggccgccacccagtgtgagttcagcaagcaggagttcatggatggcatgacagagctgggctgtgacagcattgagaagctgaaggcccagatccccaagtag

SEQ ID NO: 149277 - DNA, 879 bp, Artificial Sequence
  Description of Artificial Sequence: Synthetic coding sequence
atgcacagtgatgctgctgctgtgaacttccagctgaacagccacctgagcaccctggccaacatccacaagatctaccacaccctgaacaagctgaacctgacagaggacatcggccaggatgaccaccagacaggcagcctgcggagctgcagcagcagtgactgcttcaacaaggtgatgccacccaggaagaagagaagacctgccagcggagatgacctgagcgccaagaagagcagacatgacagcatgtacagaaaatatgacagcacccgcatcaagacagaggaggaggccttcagcagcaagcgctgcctggagtggttctatgaatatgccggcacagatgatgtggtgggccctgagggcatggagaagttctgtgaggacatcggcgtggagccagaaaatgtggtgatgctggtgctggcctggaagctggatgcccagaacatgggctacttcaccctgcaggagtggctgaagggcatgaccagcctgcagtgtgacaccacagagaagctgaggaacaccctggactacctgcgctccttcctgaatgacagcaccaacttcaagctgatctaccgctatgcctttgattttgcccgggagaaggaccagaggagcctggacatcaacacagccaagtgcatgctgggcctgctgctgggcaagatctggcccctcttccctgtgttccaccagttcctggagcagagcaagtacaaggtgatcaacaaggaccagtggtgcaatgtgctggagttcagcaggaccatcaacctggacctgagcaactatgatgaagatggagcctggcctgtgctgctggatgaatttgtggagtggtacaaggacaagcagatgtcctag

SEQ ID NO: 149278 - DNA, 699 bp, Artificial Sequence
  Description of Artificial Sequence: Synthetic coding sequence
atgccacccaggaagaagagaagacctgccagcggagatgacctgagcgccaagaagagcagacatgacagcatgtacagaaaatatgacagcacccgcatcaagacagaggaggaggccttcagcagcaagcgctgcctggagtggttctatgaatatgccggcacagatgatgtggtgggccctgagggcatggagaagttctgtgaggacatcggcgtggagccagaaaatgtggtgatgctggtgctggcctggaagctggatgcccagaacatgggctacttcaccctgcaggagtggctgaagggcatgaccagcctgcagtgtgacaccacagagaagctgaggaacaccctggactacctgcgctccttcctgaatgacagcaccaacttcaagctgatctaccgctatgcctttgattttgcccgggagaaggaccagaggagcctggacatcaacacagccaagtgcatgctgggcctgctgctgggcaagatctggcccctcttccctgtgttccaccagttcctggagcagagcaagtacaaggtgatcaacaaggaccagtggtgcaatgtgctggagttcagcaggaccatcaacctggacctgagcaactatgatgaagatggagcctggcctgtgctgctggatgaatttgtggagtggtacaaggacaagcagatgtcctag

SEQ ID NO: 149279 - DNA, 774 bp, Artificial Sequence
  Description of Artificial Sequence: Synthetic coding sequence
atgcacagtgatgctgctgctgtgaacttccagctgaacagccacctgagcaccctggccaacatccacaagatctaccacaccctgaacaagctgaacctgacagaggacatcggccaggatgaccaccagacaggcagcctgcggagctgcagcagcagtgactgcttcaacaaggtgatgccacccaggaagaagagaagacctgccagcggagatgacctgagcgccaagaagagcagacatgacagcatgtacagaaaatatgacagcacccgcatcaagacagaggaggaggccttcagcagcaagcgctgcctggagtggttctatgaatatgccggcacagatgatgtggtgggccctgagggcatggagaagttctgtgaggacatcggcgtggagccagaaaatgtggtgatgctggtgctggcctggaagctggatgcccagaacatgggctacttcaccctgcaggagtggctgaagggcatgaccagcctgcagtgtgacaccacagagaagctgaggaacaccctggactacctgcgctccttcctgaatgacagcaccaacttcaagctgatctaccgctatgcctttgattttgcccggcagagcaagtacaaggtgatcaacaaggaccagtggtgcaatgtgctggagttcagcaggaccatcaacctggacctgagcaactatgatgaagatggagcctggcctgtgctgctggatgaatttgtggagtggtacaaggacaagcagatgtcctag

SEQ ID NO: 149280 - DNA, 1011 bp, Artificial Sequence
  Description of Artificial Sequence: Synthetic coding sequence
atggaggtggaggccgccctgggctgcagcggccagggccggggctgcggcggcgtggccccagctggccggggccgggagcgggccagcgagcggggcaccagggtgcgcatcagcaagggcctgtctggagctgggggctctgtgaggaaggctgacttccagctgaacagccacctgagcaccctggccaacatccacaagatctaccacaccctgaacaagctgaacctgacagaggacatcggccaggatgaccaccagacaggcagcctgcggagctgcagcagcagtgactgcttcaacaaggtgatgccacccaggaagaagagaagacctgccagcggagatgacctgagcgccaagaagagcagacatgacagcatgtacagaaaatatgacagcacccgcatcaagacagaggaggaggccttcagcagcaagcgctgcctggagtggttctatgaatatgccggcacagatgatgtggtgggccctgagggcatggagaagttctgtgaggacatcggcgtggagccagaaaatgtggtgatgctggtgctggcctggaagctggatgcccagaacatgggctacttcaccctgcaggagtggctgaagggcatgaccagcctgcagtgtgacaccacagagaagctgaggaacaccctggactacctgcgctccttcctgaatgacagcaccaacttcaagctgatctaccgctatgcctttgattttgcccgggagaaggaccagaggagcctggacatcaacacagccaagtgcatgctgggcctgctgctgggcaagatctggcccctcttccctgtgttccaccagttcctggagcagagcaagtacaaggtgatcaacaaggaccagtggtgcaatgtgctggagttcagcaggaccatcaacctggacctgagcaactatgatgaagatggagcctggcctgtgctgctggatgaatttgtggagtggtacaaggacaagcagatgtcctag

SEQ ID NO: 149281 - DNA, 1854 bp, Artificial Sequence
  Description of Artificial Sequence: Synthetic coding sequence
atggctgctgtggccgccggcggcctggtgggcaagggccgggacatcagcctggccgccctgcagagacatgacccctacatcaacagaattgtggatgtggccagccaggtggccctgtacaccttcggccaccgggccaatgagtgggagaagacagatgtggagggcaccctgtttgtgtacaccaggtctgccagccccaagcacggcttcaccatcatgaaccggctgtccatggagaacagaacagagcccatcaccaaggacctggacttccagctgcaggaccccttcctgctgtacagaaatgcccggctgagcatctacggcatctggttctatgacaaggaggagtgccagagaattgctgagctgatgaagaacctgacccagtatgagcagctgaaggcccaccagggcaccggggccggcatcagccctgtgatcctgaacagcggggagggcaaggaggtggacatcctgaggatgctgatcaaggccaaggatgagtacaccaagtgcaagacctgcagcgagcccaagaagatcaccagcagcagcgccatctatgacaaccccaacctgatcaagcccatccctgtgaagcccagcgagaaccagcagcagaggatcccccagcccaaccagaccctggaccctgagccccagcacctgagcctgacagccctgtttgggaagcaggacaaggccacctgccaggagaccgtggagcccccccagaccctgcaccagcagcagcagcagcagcagcagcagcaggagaagctgcccatccggcagggcgtggtgcgcagcctgtcctatgaggagccccggcggcacagcccccccatcgagaagcagctgtgcccagccatccagaagctgatggtgcgctctgctgacctgcaccccctgtctgagctgcctgagaaccggccctgtgaaaatggcagcacccacagcgctggggagttcttcaccggccctgtgcagcccggcagcccccacaacatcggcaccagcagaggagtgcagaatgccagcaggacccagaacctgtttgagaagctgcagagcaccccaggagctgccaacaagtgtgaccccagcaccccagccccagccagcagcgctgccctgaacagaagccgggcccccacctctgtgacccctgtggcccctgggaagggcctggcccagcccccccaggcctacttcaacggcagcctgcccccccagacagtgggccaccaggcccacggccgggagcagagcaccctgccccggcagaccctgcccatcagcggcagccagacaggcagcagcggggtcatcagcccccaggagctgctgaagaagctgcagatcgtgcagcaggagcagcagctgcacgccagcaacagacctgccctggccgccaagtttcctgtgctggcccagagcagcggcaccgggaagcccctggagagctggatcaacaagacccccaacacagagcagcagacccccctcttccaggtgatcagcccccagaggatcccagccacagctgcccccagcctgctgatgagccccatggtgtttgcccagcccacctctgtgccccccaaggagcgggagagcggcctgctgcctgtgggcggccaggagcccccagctgctgccaccagcctgctgctgcccatccagagccctgagcccagcgtcatcaccagcagccccctgaccaagctgcagctgcaggaggccctgctgtacctgatccagaatgatgacaacttcctgaacatcatctatgaggcctacctgttctccatgacccaggccgccatgaagaagaccatgtag

SEQ ID NO: 149282 - DNA, 1548 bp, Artificial Sequence
  Description of Artificial Sequence: Synthetic coding sequence
atgcagatcaaggtgtccatctacggcatctggttctatgacaaggaggagtgccagagaattgctgagctgatgaagaacctgacccagtatgagcagctgaaggcccaccagggcaccggggccggcatcagccctgtgatcctgaacagcggggagggcaaggaggtggacatcctgaggatgctgatcaaggccaaggatgagtacaccaagtgcaagacctgcagcgagcccaagaagatcaccagcagcagcgccatctatgacaaccccaacctgatcaagcccatccctgtgaagcccagcgagaaccagcagcagaggatcccccagcccaaccagaccctggaccctgagccccagcacctgagcctgacagccctgtttgggaagcaggacaaggccacctgccaggagaccgtggagcccccccagaccctgcaccagcagcagcagcagcagcagcagcagcaggagaagctgcccatccggcagggcgtggtgcgcagcctgtcctatgaggagccccggcggcacagcccccccatcgagaagcagctgtgcccagccatccagaagctgatggtgcgctctgctgacctgcaccccctgtctgagctgcctgagaaccggccctgtgaaaatggcagcacccacagcgctggggagttcttcaccggccctgtgcagcccggcagcccccacaacatcggcaccagcagaggagtgcagaatgccagcaggacccagaacctgtttgagaagctgcagagcaccccaggagctgccaacaagtgtgaccccagcaccccagccccagccagcagcgctgccctgaacagaagccgggcccccacctctgtgacccctgtggcccctgggaagggcctggcccagcccccccaggcctacttcaacggcagcctgcccccccagacagtgggccaccaggcccacggccgggagcagagcaccctgccccggcagaccctgcccatcagcggcagccagacaggcagcagcggggtcatcagcccccaggagctgctgaagaagctgcagatcgtgcagcaggagcagcagctgcacgccagcaacagacctgccctggccgccaagtttcctgtgctggcccagagcagcggcaccgggaagcccctggagagctggatcaacaagacccccaacacagagcagcagacccccctcttccaggtgatcagcccccagaggatcccagccacagctgcccccagcctgctgatgagccccatggtgtttgcccagcccacctctgtgccccccaaggagcgggagagcggcctgctgcctgtgggcggccaggagcccccagctgctgccaccagcctgctgctgcccatccagagccctgagcccagcgtcatcaccagcagccccctgaccaagctgcagctgcaggaggccctgctgtacctgatccagaatgatgacaacttcctgaacatcatctatgaggcctacctgttctccatgacccaggccgccatgaagaagaccatgtag

SEQ ID NO: 149283 - DNA, 1263 bp, Artificial Sequence
  Description of Artificial Sequence: Synthetic coding sequence
atggagaccaagagggtggagatccctggctctgtgctggatgacttctgcagccgcttcatcctgcacatccccagcgaggagcgggacaatgccatccgggtgtgcttccagatcgagctggcccactggttctacctggacttctacatgcagaacaccccaggcctgccccagtgtggcatccgggactttgccaaggctgtgttcagccactgccccttcctgctgccccagggagaagatgtggagaaggtgctggatgagtggaaggagtacaagatgggcgtgcccacctacggggccatcatcctggatgagaccctggagaatgtgctgctggtgcagggctacctggccaagagcggctggggcttccccaagggcaaggtgaacaaggaggaggcccctcatgactgtgccgcccgggaggtgtttgaggagactggatttgacatcaaggactacatctgcaaggatgactacatcgagctgcgcatcaatgaccagctggcccggctgtacatcatccctggcatccccaaggacaccaagttcaaccccaagacccggcgggagatcagaaatattgagtggttcagcattgagaagctgccctgccacagaaatgacatgacccccaagagcaagctgggcctggcccccaacaagttcttcatggccatccccttcatccggcccctgcgggactggctgagcagaagatttggagacagcagtgacagcgacaatggcttcagcagcacaggcagcaccccagccaagcccaccgtggagaagctgagcaggaccaagttccgccacagccagcagctgttcccagatggcagccctggggaccagtgggtgaagcaccggcagcccctgcagcagaagccctacaacaaccacagcgagatgtctgacctgctgaagggcaagaaccagagcatgagaggaaatggaaggaagcagtaccaggacagccccaaccagaagaagaggaccaacggcctgcagcctgccaagcagcagaacagcctgatgaagtgtgagaagaagctgcaccccaggaagctgcaggacaactttgaaacagatgctgtgtatgacctgcccagcagcagcgaggaccagctgctggagcacgccgagggccagcctgtggcctgcaatggccactgcaagttccccttcagcagccgggccttcctgtccttcaagtttgaccacaatgccatcatgaagatcctggacctgtag

SEQ ID NO: 149284 - DNA, 1158 bp, Artificial Sequence
  Description of Artificial Sequence: Synthetic coding sequence
atggagaccaagagggtggagatccctggctctgtgctggatgacttctgcagccgcttcatcctgcacatccccagcgaggagcgggacaatgccatccgggtgtgcttccagatcgagctggcccactggttctacctggacttctacatgcagaacaccccaggcctgccccagtgtggcatccgggactttgccaaggctgtgttcagccactgccccttcctgctgccccagggagaagatgtggagaaggtgctggatgagtggaaggagtacaagatgggcgtgcccacctacggggccatcatcctggatgagaccctggagaatgtgctgctggtgcagggctacctggccaagagcggctggggcttccccaagggcaaggtgaacaaggaggaggcccctcatgactgtgccgcccgggaggtgtttgaggagactggatttgacatcaaggactacatctgcaaggatgactacatcgagctgcgcatcaatgaccagctggcccggctgtacatcatccctggcatccccaaggacaccaagttcaaccccaagacccggcgggagatcagaaatattgagtggttcagcattgagaagctgccctgccacagaaatgacatgacccccaagagcaagctgggcctggcccccaacaagttcttcatggccatccccttcatccggcccctgcgggactggctgagcagaagatttggagacagcagtgacagcgacaatggcttcagcagcacaggcagcaccccagccaagcccaccgtggagaagctgagcaggaccaagttccgccacagccagcagctgttcccagatggcagccctggggaccagtgggtgaagcaccggcagcccctgcagcagaagccctacaacaaccacagcgagatgtctgacctgctgaagggcaagaagtgtgagaagaagctgcaccccaggaagctgcaggacaactttgaaacagatgctgtgtatgacctgcccagcagcagcgaggaccagctgctggagcacgccgagggccagcctgtggcctgcaatggccactgcaagttccccttcagcagccgggccttcctgtccttcaagtttgaccacaatgccatcatgaagatcctggacctgtag

SEQ ID NO: 149285 - DNA, 630 bp, Artificial Sequence
  Description of Artificial Sequence: Synthetic coding sequence
atgacccccaagagcaagctgggcctggcccccaacaagttcttcatggccatccccttcatccggcccctgcgggactggctgagccgccgctttggagacagcagtgacagcgacaatggcttcagcagcacaggcagcaccccagccaagcccaccgtggagaagctgagcaggaccaagttccgccacagccagcagctgttcccagatggcagccctggggaccagtgggtgaagcaccggcagcccctgcagcagaagccctacaacaaccacagcgagatgtctgacctgctgaagggcaagaaccagagcatgagaggaaatggaaggaagcagtaccaggacagccccaaccagaagaagaggaccaacggcctgcagcctgccaagcagcagaacagcctgatgaagtgtgagaagaagctgcaccccaggaagctgcaggacaactttgaaacagatgctgtgtatgacctgcccagcagcagcgaggaccagctgctggagcacgccgagggccagcctgtggcctgcaatggccactgcaagttccccttcagcagccgggccttcctgtccttcaagtttgaccacaatgccatcatgaagatcctggacctgtag

SEQ ID NO: 149286 - DNA, 1341 bp, Artificial Sequence
  Description of Artificial Sequence: Synthetic coding sequence
atgacagagctgggcatggtggtgctgggcatcgacaccacccacctgtggatgctgcccctgaccccaggctcctggaacagcatgaggagccgccacaagtggaactggccccagggctcctggggcctgggcggccccccaagaagcacagccttcctggagtgctgcaccagcttcctgcccaatgacctgggcttcacagacagctacagccagaaggccttctgtggcatctacagcaaggatggccagatcttcatgtctgcctgccaggaccagaccatccggctgtatgactgccgctatggccgcttcaggaagttcaagagcatcaaggccagagatgtgggctggagcgtgctggatgtggccttcaccccagatggcaaccacttcctgtacagctcctggagcgactacatccacatctgcaacatctacggggagggggacacccacacagccctggacctgcggccagatgagaggagatttgctgtgttcagcattgctgtgtccagtgatggccgggaggtgctgggcggggccaatgatggctgcctgtatgtgtttgaccgggagcagaacagaaggaccctgcagatcgagagccatgaagatgatgtgaatgctgtggcctttgctgacatcagcagccagatcctcttctctggaggagatgatgccatctgcaaggtgtgggacaggaggaccatgagagaagatgaccccaagcctgtgggcgccctggccggccaccaggacggcatcaccttcatcgacagcaaaggagatgcccgctacctgatcagcaacagcaaggaccagaccatcaagctgtgggacatccgccgcttcagcagccgggagggcatggaggccagccggcaggccgccacccagcagaactgggactaccgctggcagcaggtgcccaagaaggcctggaggaagctgaagctgcccggggacagcagcctgatgacctaccggggccacggcgtgctgcacaccctcatccgctgccgcttcagccccatccacagcacaggccagcagttcatctacagcggctgcagcacaggcaaggtggtggtgtatgacctgctgagcggccacatcgtgaagaagctgaccaaccacaaggcctgtgtgagagatgtgtcctggcacccctttgaggagaagatcgtgagcagctcctgggatggcaacctgcggctgtggcagtaccggcaggccgagtacttccaggatgacatgcctgagagtgaagaatgtgccagcgccccagcccctgtgccccagagcagcacccccttcagcagcccccagtag

SEQ ID NO: 149287 - DNA, 1563 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgcggcgggccgcccagaagcacagcttccccaggatgctgcaccagcgggagcggggcctgtgccaccggggcagcttcagcctgggggagcagagcagggtcatcagccacttcctgcccaatgacctgggcttcacagacagctacagccagaaggccttctgtggcatctacagcaaggatggccagatcttcatgtctgcctgccaggaccagaccatccggctgtatgactgccgctatggccgcttcaggaagttcaagagcatcaaggccagagatgtgggctggagcgtgctggatgtggccttcaccccagatggcaaccacttcctgtacagctcctggagcgactacatccacatctgcaacatctacggggagggggacacccacacagccctggacctgcggccagatgagaggagatttgctgtgttcagcattgctgtgtccagtgatggccgggaggtgctgggcggggccaatgatggctgcctgtatgtgtttgaccgggagcagaacagaaggaccctgcagatcgagagccatgaagatgatgtgaatgctgtggcctttgctgacatcagcagccagatcctcttctctggaggagatgatgccatctgcaaggtgtgggacaggaggaccatgagagaagatgaccccaagcctgtgggcgccctggccggccaccaggacggcatcaccttcatcgacagcaaaggagatgcccgctacctgatcagcaacagcaaggaccagaccatcaagctgtgggacatccgccgcttcagcagccgggagggcatggaggccagccggcaggccgccacccagcagaactgggactaccgctggcagcaggtgcccaagaaggcctggaggaagctgaagctgcccggggacagcagcctgatgacctaccggggccacggcgtgctgcacaccctcatccgctgccgcttcagccccatccacagcacaggccagcagttcatctacagcggctgcagcacaggcaaggtggtggtgtatgacctgctgagcggccacatcgtgaagaagctgaccaaccacaaggcctgtgtgagagatgtgtcctggcacccctttgaggagaagatcgtgagcagctcctgggatggcaacctgcggctgtggcagtaccggcaggccgagtacttccaggatgacatgcctgagagtgaagaatgtgccagcgccccagcccctgtgccccagagcagcacccccttcagcagcccccagtag

SEQ ID NO: 149288 - DNA, 1641 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgcggcgggccgcccagaagcacagcttccccaggatgctgcaccagcgggagcggggcctgtgccaccggggcagcttcagcctgggggagcagagcagggtcatcagccacttcctgcccaatgacctgggcttcacagacagctacagccagaaggccttctgtggcatctacagcaaggatggccagatcttcatgtctgcctgccaggaccagaccatccggctgtatgactgccgctatggccgcttcaggaagttcaagagcatcaaggccagagatgtgggctggagcgtgctggatgtggccttcaccccagatggcaaccacttcctgtacagctcctggagcgactacatccacatctgcaacatctacggggagggggacacccacacagccctggacctgcggccagatgagaggagatttgctgtgttcagcattgctgtgtccagtgatggccgggaggtgctgggcggggccaatgatggctgcctgtatgtgtttgaccgggagcagaacagaaggaccctgcagatcgagagccatgaagatgatgtgaatgctgtggcctttgctgacatcagcagccagatcctcttctctggaggagatgatgccatctgcaaggtgtgggacaggaggaccatgagagaagatgaccccaagcctgtgggcgccctggccggccaccaggacggcatcaccttcatcgacagcaaaggagatgcccgctacctgatcagcaacagcaaggaccagaccatcaagctgtgggacatccgccgcttcagcagccgggagggcatggaggccagccggcaggccgccacccagcagaactgggactaccgctggcagcaggtgcccaagaaggcctggaggaagctgaagctgcccggggacagcagcctgatgacctaccggggccacggcgtgctgcacaccctcatccgctgccgcttcagccccatccacagcacaggccagcagttcatctacagcggctgcagcacaggcaaggtggtggtgtatgacctgctgagcggccacatcgtgaagaagctgaccaaccacaaggcctgtgtgagagatgtgtcctggcacccctttgaggagaagatcgtgagcagctcctgggatggcaacctgcggctgtggcagtaccggcaggccgagtacttccaggatgacatgcctgagagtgaagaatgtgccagcgccccagcccctgtgccccagagcagcacccccttcagcagcccccagtag

SEQ ID NO: 149289 - DNA, 369 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgtag

SEQ ID NO: 149290 - DNA, 222 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctgtag

SEQ ID NO: 149291 - DNA, 282 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccctag

SEQ ID NO: 149292 - DNA, 327 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccccctgtggatgccaccccagacacccgggagctggagttcaatgaatag

SEQ ID NO: 149293 - DNA, 1641 bp, Artificial Sequence; identical to SEQ ID NO: 149288
  Description of Artificial Sequence: Synthetic coding sequence

SEQ ID NO: 149294 - DNA, 273 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggccctgctggacagcgaggaggagaatgaccgggcctgggatggccgcctgggggaccgctacaacccccctgtggatgccaccccagacacccgggagctggagttcaatgagatcaagacccaggtggagctggcctag

SEQ ID NO: 149295 - DNA, 93 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctcctag

SEQ ID NO: 149296 - DNA, 429 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgcggcgggccgcccagaagcacagcttccccaggatgctgcaccagcgggagcggggcctgtag

SEQ ID NO: 149297 - DNA, 204 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccagaggccttctgaggtgggcgccggccgccgctgcagcaagttcaccatccacagcggccccctgggcctgtag

SEQ ID NO: 149298 - DNA, 321 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggcccagctggacccagaggaagaggatgacagagctgggcatggtggtgctgggcatcgacaccacccacctgtggatgctgcccctgaccccaggctcctggaacagcatgaggagccgccacaagtggaactggccccagggctcctggggcctgggcggctag

SEQ ID NO: 149299 - DNA, 387 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgcggcgggccgcccagaagcacagcttccccaggatgctgcaccagcgggagcggggcctgtgccaccggggcagcttcagcctgggggagcagagctag

SEQ ID NO: 149300 - DNA, 465 bp, Artificial Sequence
  Description of Artificial Sequence: Synthetic coding sequence
atgggcagcaggaacagcagcagcgctggcagcggcagcggggaccccagcgagggcctgcccaggagaggagctggcctgcggcgctctgaggaggaggaggaggaggatgaagatgtggacctggcccaggtgctggcctacctgctgcggcggggccaggtgcggctggtgcagggcggcggggccgccaacctgcagttcatccaggccctgctggacagcgaggaggagaatgaccgggcctgggatggccgcctgggggaccgctacaacccccctgtggatgccaccccagacacccgggagctggagttcaatgagatcaagacccaggtggagctggccaccggccagctgggcctgcggcgggccgcccagaagcacagcttccccaggatgctgcaccagcgggagcggggcctgtgccaccggggcagcttcagcctgggggagcagagctag

SEQ ID NO: 149301 - DNA, 2829 bp, Artificial Sequence
  Description of Artificial Sequence: Synthetic coding sequence
atgaagagaagagctggcctgggcggctccatgaggtctgtggtgggcttcctgagccagaggggcctgcacggggaccccctgctgacccaggacttccagaggcggcggctgcggggctgcaggaacctgtacaagaaggacctgctgggccacttcggctgtgtgaatgccatcgagttcagcaacaacggcggccagtggctggtgtctggaggagatgaccggcgggtgctgctgtggcacatggagcaggccatccacagccgggtgaagcccatccagctgaagggggagcaccacagcaacatcttctgcctggccttcaacagcggcaacaccaaggtgttcagcggcggcaatgatgagcaggtgatcctgcatgatgtggagagcagcgagaccctggatgtgtttgcccatgaagatgctgtgtatggcctgtctgtgtcccctgtgaatgacaacatctttgccagcagcagtgatgatggccgggtgctgatctgggacatccgggagagcccccatggagagcccttctgcctggccaactaccccagcgccttccacagcgtgatgttcaaccctgtggagccccggctgctggccacagccaacagcaaggagggcgtgggcctgtgggacatcaggaagccccagagcagcctgctgcgctatggaggcaacctgagcctgcagagcgccatgtctgtgcgcttcaacagcaatggcacccagctgctggccctgcggcggcggctgccccctgtgctgtatgacatccacagccggctgcctgtgttccagtttgacaaccagggctacttcaacagctgcaccatgaagagctgctgctttgctggggaccgggaccagtacatcctgagcggcagtgatgacttcaacctgtacatgtggaggatcccagctgaccctgaggccggcggcatcggccgggtggtgaatggagccttcatggtgctgaagggccacaggagcatcgtgaaccaggtgcgcttcaacccccacacctacatgatctgcagcagtggagtggagaagatcatcaagatctggagcccctacaagcagcccggctgcacaggagacctggatggaagaattgaagatgacagccgctgcctgtacacccatgaggagtacatcagcctggtgctgaacagcggcagcggcctgagccatgactatgccaaccagagcgtgcaggaggaccccaggatgatggccttctttgacagcctggtgcggcgggagattgagggctggagcagtgacagcgacagcgacctgtctgagagcaccatcctgcagctgcacgccggcgtgtctgagaggagcggctacacagattctgagagcagcgccagcctgcccaggagccccccacccaccgtggatgagagcgctgacaatgccttccacctgggccccctgcgggtgaccaccaccaacacagtggccagcaccccacccacccccacctgtgaagatgctgccagccggcagcagaggctgagcgccctgcggcgctaccaggacaagaggctgctggccctgagcaatgaaagtgacagtgaagaaaatgtgtgtgaggtggagctggacacagacctcttcccccggcccaggagccccagcccagaagatgagagcagcagcagcagcagcagcagcagcagtgaagatgaggaggagctgaatgaaagaagagccagcacctggcagagaaatgccatgagaagacggcagaagaccacccgggaggacaagcccagcgcccccatcaagcccaccaacacctacatcggggaggacaactatgactacccccagatcaaggtggatgacctgagcagcagccccaccagcagccctgagaggagcaccagcaccctggagatccagcccagccgggccagccccaccagtgacattgaatctgtggagaggaagatctacaaggcctacaagtggctgcgctacagctacatctcctacagcaacaacaaggatggagagaccagcctggtgactggagaggctgatgagggccgggccggcaccagccacaaggacaacccagcccccagcagcagcaaggaggcctgcctgaacatcgccatggcccagaggaaccaggacctgcccccagagggctgcagcaaggacaccttcaaggaggagacccccaggacccccagcaatggacctggccacgagcacagcagccacgcctgggccgaggtgcctgagggcaccagccaggacaccggcaacagcggctctgtggagcacccctttgagaccaagaagctgaatggcaaggccctgagcagcagagctgaggagccccccagcccccctgtgcccaaggccagcggcagcaccctgaacagcggcagcggcaactgccccaggacccagagtgatgacagcgaggagaggagcctggagaccatctgtgccaaccacaacaacggccgcctgcaccccaggcctccccacccccacaacaacggccagaacctgggggagctggaggtggtggcctacagcagccctggccacagcgacacagaccgggacaacagcagcctgaccggcaccctgctgcacaaggactgctgcggcagcgagatggcctgtgagaccccaaatgccggcacccgggaggaccccacagacaccccagccacagacagcagcagagctgtgcacggccacagcggcctgaagaggcagagaattgagctggaggacacagattctgagaacagcagcagcgagaagaagctgaagacctag

SEQ ID NO: 149302 - DNA, 2583 bp, Artificial Sequence
  Description of Artificial Sequence: Synthetic coding sequence
atggagcaggccatccacagccgggtgaagcccatccagctgaagggggagcaccacagcaacatcttctgcctggccttcaacagcggcaacaccaaggtgttcagcggcggcaatgatgagcaggtgatcctgcatgatgtggagagcagcgagaccctggatgtgtttgcccatgaagatgctgtgtatggcctgtctgtgtcccctgtgaatgacaacatctttgccagcagcagtgatgatggccgggtgctgatctgggacatccgggagagcccccatggagagcccttctgcctggccaactaccccagcgccttccacagcgtgatgttcaaccctgtggagccccggctgctggccacagccaacagcaaggagggcgtgggcctgtgggacatcaggaagccccagagcagcctgctgcgctatggaggcaacctgagcctgcagagcgccatgtctgtgcgcttcaacagcaatggcacccagctgctggccctgcggcggcggctgccccctgtgctgtatgacatccacagccggctgcctgtgttccagtttgacaaccagggctacttcaacagctgcaccatgaagagctgctgctttgctggggaccgggaccagtacatcctgagcggcagtgatgacttcaacctgtacatgtggaggatcccagctgaccctgaggccggcggcatcggccgggtggtgaatggagccttcatggtgctgaagggccacaggagcatcgtgaaccaggtgcgcttcaacccccacacctacatgatctgcagcagtggagtggagaagatcatcaagatctggagcccctacaagcagcccggctgcacaggagacctggatggaagaattgaagatgacagccgctgcctgtacacccatgaggagtacatcagcctggtgctgaacagcggcagcggcctgagccatgactatgccaaccagagcgtgcaggaggaccccaggatgatggccttctttgacagcctggtgcggcgggagattgagggctggagcagtgacagcgacagcgacctgtctgagagcaccatcctgcagctgcacgccggcgtgtctgagaggagcggctacacagattctgagagcagcgccagcctgcccaggagccccccacccaccgtggatgagagcgctgacaatgccttccacctgggccccctgcgggtgaccaccaccaacacagtggccagcaccccacccacccccacctgtgaagatgctgccagccggcagcagaggctgagcgccctgcggcgctaccaggacaagaggctgctggccctgagcaatgaaagtgacagtgaagaaaatgtgtgtgaggtggagctggacacagacctcttcccccggcccaggagccccagcccagaagatgagagcagcagcagcagcagcagcagcagcagtgaagatgaggaggagctgaatgaaagaagagccagcacctggcagagaaatgccatgagaagacggcagaagaccacccgggaggacaagcccagcgcccccatcaagcccaccaacacctacatcggggaggacaactatgactacccccagatcaaggtggatgacctgagcagcagccccaccagcagccctgagaggagcaccagcaccctggagatccagcccagccgggccagccccaccagtgacattgaatctgtggagaggaagatctacaaggcctacaagtggctgcgctacagctacatctcctacagcaacaacaaggatggagagaccagcctggtgactggagaggctgatgagggccgggccggcaccagccacaaggacaacccagcccccagcagcagcaaggaggcctgcctgaacatcgccatggcccagaggaaccaggacctgcccccagagggctgcagcaaggacaccttcaaggaggagacccccaggacccccagcaatggacctggccacgagcacagcagccacgcctgggccgaggtgcctgagggcaccagccaggacaccggcaacagcggctctgtggagcacccctttgagaccaagaagctgaatggcaaggccctgagcagcagagctgaggagccccccagcccccctgtgcccaaggccagcggcagcaccctgaacagcggcagcggcaactgccccaggacccagagtgatgacagcgaggagaggagcctggagaccatctgtgccaaccacaacaacggccgcctgcaccccaggcctccccacccccacaacaacggccagaacctgggggagctggaggtggtggcctacagcagccctggccacagcgacacagaccgggacaacagcagcctgaccggcaccctgctgcacaaggactgctgcggcagcgagatggcctgtgagaccccaaatgccggcacccgggaggaccccacagacaccccagccacagacagcagcagagctgtgcacggccacagcggcctgaagaggcagagaattgagctggaggacacagattctgagaacagcagcagcgagaagaagctgaagacctag

SEQ ID NO: 149303 - DNA, 633 bp, Artificial Sequence
  Description of Artificial Sequence: Synthetic coding sequence
atggagcaggccatccacagccgggtgaagcccatccagctgaagggggagcaccacagcaacatcttctgcctggccttcaacagcggcaacaccaaggtgttcagcggcggcaatgatgagcaggtgatcctgcatgatgtggagagcgagaccctggatgtgtttgcccatgaagatgctgtgtatggcctgtctgtgtcccctgtgaatgacaacatctttgccagcagcagtgatgatggccgggtgctgatctgggacatccgggagagcccccacggggagcccttctgcctggccaactaccccagcgccttccacagcgtgatgttcaaccctgtggagccccggctgctggccacagccaacagcaaggagggcgtgggcctgtgggacatcaggaagccccagagcagcctgctgcgctatggaggcaacctgagcctgcagagcgccatgtctgtgcgcttcaacagcaatggcacccagctgctggccctgcggcggcggctgccccctgtgctgtatgacatccacagccggctgcccgtcttccagtttgacaaccagggctacttcaacagctgcaccatgaagagctgctgctttgctggggaccgggaccagtag

SEQ ID NO: 149304 - DNA, 2583 bp, Artificial Sequence; identical to SEQ ID NO: 149302
  Description of Artificial Sequence: Synthetic coding sequence

SEQ ID NO: 149305 - DNA, 357 bp, Artificial Sequence
  Description of Artificial Sequence: Synthetic coding sequence
atgcccttcctggagctggacaccaacctgcctgccaacagagtgcctgctggcctggagaagaggctgtgtgccgctgctgccagcatcctgggcaagccagctgacagagtgaatgtgacagtgcggcccggcctggccatggccctgagcggcagcacagagccctgtgcccagctgagcatcagcagcattggagtggtgggcacagctgaggacaacagaagccacagcgcccacttctttgagttcctgaccaaggagctggccctgggccaggaccgcatcctgatccgcttcttccccctggagagctggcagatcggcaagattggaacagtgatgaccttcctgtag

SEQ ID NO: 149306 - DNA, 357 bp, Artificial Sequence; identical to SEQ ID NO: 149305
  Description of Artificial Sequence: Synthetic coding sequence

SEQ ID NO: 149307 - DNA, 399 bp, Artificial Sequence
  Description of Artificial Sequence: Synthetic coding sequence
atgcagctgttcctgctggccgtgtctgtgcccctgcctgccatgcccttcctggagctggacaccaacctgcctgccaacagagtgcctgctggcctggagaagaggctgtgtgccgctgctgccagcatcctgggcaagccagctgacagagtgaatgtgacagtgcggcccggcctggccatggccctgagcggcagcacagagccctgtgcccagctgagcatcagcagcattggagtggtgggcacagctgaggacaacagaagccacagcgcccacttctttgagttcctgaccaaggagctggccctgggccaggaccgcatcctgatccgcttcttccccctggagagctggcagatcggcaagattggaacagtgatgaccttcctgtag

SEQ ID NO: 149308 - DNA, 348 bp, Artificial Sequence
  Description of Artificial Sequence: Synthetic coding sequence
atgcccatgtttattgtgaacaccaacgtgccccgggcctctgtgcctgatggcttcctgtctgagctgacccagcagctggcccaggccaccgggaagccaccccagtacatcgctgtgcacgtggtgcctgaccagctgatggccttcggcggcagcagcgagccctgtgccctgtgcagcctgcacagcatcggcaagattggaggagcccagaacagaagctacagcaagctgctgtgtggcctgctggccgagcggctgcgcatcagcccagacagagtgtacatcaactactatgacatgaatgctgccaacgtgggctggaacaacagcacctttgcctag

SEQ ID NO: 149309 - DNA, 1224 bp, Artificial Sequence
  Description of Artificial Sequence: Synthetic coding sequence
atgaacaacagcggggctgatgaaattggcaagctgtttgtgggcggcctggactggagcaccacccaggagaccctgcggagctacttcagccagtatggagaggtggtggactgtgtgatcatgaaggacaagaccaccaaccagagccggggctttggatttgtgaagttcaaggaccccaactgtgtgggcaccgtgctggccagccggccccacaccctggatggcaggaacatcgaccccaagccctgcaccccccggggcatgcagcctgagaggacccggcccaaggagggctggcagaagggccccaggagtgacaacagcaagagcaacaagatctttgtgggcggcatcccccacaactgtggggagacagagctgcgggagtacttcaagaagtttggagtggtgacagaggtggtgatgatctatgatgctgagaagcagaggccccggggcttcggcttcatcacctttgaagatgagcagagcgtggaccaggccgtgaacatgcacttccatgacatcatgggcaagaaggtggaggtgaagagagctgagccccgggacagcaagagccaggcccctggccagcccggggccagccagtggggcagccgggtggtgcccaatgctgccaacggctgggccggccagcccccacccacctggcagcagggctacggcccccagggcatgtgggtgcctgctggccaggccatcggcggctacggccccccacctgctggccgcggggcccctcctcctcctccacccttcaccagctacatcgtgtccaccccacctgggggcttccccccaccccagggcttcccccagggctacggggccccaccccagttctcctttggctacggccccccacctcctcctccagaccagtttgcccctcctggggtgcccccacctccagccacccctggggccgcccccctggccttccccccaccacccagccaggccgccccagacatgagcaagcccccaacagcccagcctgacttcccctacggccagtatgccggctacggccaggacctgagcggcttcggccagggcttcagtgaccccagccagcagccccccagctatggaggccccagcgtgcccggcagcggcggccccccagctgggggcagcggcttcggccggggccagaaccacaacgtgcagggcttccacccctacagaagatag

SEQ ID NO: 149310 - DNA, 2223 bp, Artificial Sequence
  Description of Artificial Sequence: Synthetic coding sequence
atggccgccttcagcgagatgggcgtgatgcctgagatcgcccaggccgtggaggagatggactggctgctgcccacagacatccaggccgagagcatccccctcatcctgggcggcggagatgtgctgatggctgctgagaccggcagcggcaagacaggagccttcagcatccctgtgatccagatcgtgtatgagaccctgaaggaccagcaggagggcaagaagggcaagaccaccatcaagacaggagcctctgtgctgaacaagtggcagatgaacccctatgaccggggcagcgcctttgccatcggcagtgatggcctgtgctgccagagccgggaggtgaaggagtggcacggctgccgggccaccaagggcctgatgaagggcaagcactactatgaggtgtcctgccacgaccagggcctgtgccgggtgggctggagcaccatgcaggccagcctggacctgggcacagacaagtttggatttggatttggaggcaccgggaagaagagccacaacaagcagtttgacaactacggggaggagttcaccatgcatgacaccatcggctgctacctggacatcgacaagggccacgtgaagttcagcaagaatggcaaggacctgggcctggcctttgagatccccccccacatgaagaaccaggccctcttccctgcctgtgtgctgaagaatgctgagctgaagttcaactttggagaggaggagttcaagttcccccccaaggatggctttgtggccctgagcaaggccccagatggctacatcgtgaagagccagcacagcggaaatgcccaggtgacccagaccaagttcctgcccaatgcccccaaggccctgattgtggagcccagccgggagctggccgagcagaccctgaacaacatcaagcagttcaagaagtacatcgacaaccccaagctgcgggagctgctgatcatcggcggcgtggccgcccgggaccagctgtctgtgctggagaatggagtggacatcgtggtgggcaccccaggccgcctggatgacctggtgtccacaggcaagctgaacctgagccaggtgcgcttcctggtgctggatgaagcagatggcctgctgagccagggctacagcgacttcatcaacaggatgcacaaccagatcccccaggtgaccagtgatggcaagaggctgcaggtgattgtgtgcagcgccaccctgcacagctttgatgtgaagaagctgtctgagaagatcatgcacttccccacctgggtggacctgaagggggaggacagcgtgcctgacacagtgcaccacgtggtggtgcctgtgaaccccaagacagaccggctgtgggagcggctgggcaagagccacatcagaacagatgatgtgcacgccaaggacaacaccaggcctggggccaacagccctgagatgtggagcgaggccatcaagatcctgaagggggagtatgctgtgcgggccatcaaggagcacaagatggaccaggccatcatcttctgcaggaccaagattgactgtgacaacctggagcagtacttcatccagcagggcggcggccctgacaagaagggccaccagttcagctgtgtgtgcctgcacggggacaggaagccccatgagaggaagcagaacctggagcgcttcaagaagggagatgtgcgcttcctgatctgcacagatgtggccgcccggggcatcgacatccacggcgtgccctacgtgatcaacgtgaccctgcctgatgagaagcagaactacgtgcacagaattggccgggtgggccgggcagagaggatgggcctggccatcagcctggtggccacagagaaggagaaggtgtggtaccacgtgtgcagcagccggggcaagggctgctacaacacccggctgaaggaggatggcggctgcaccatctggtacaatgagatgcagctgctgtctgaaattgaggagcacctgaactgcaccatcagccaggtggagccagacatcaaggtgcctgtggatgaatttgatggcaaggtgacctacggccagaagagagctgctgggggcggcagctacaagggccacgtggacatcctggcccccaccgtgcaggagctggccgccctggagaaggaggcccagaccagcttcctgcacctgggctacctgcccaaccagctgttccgcaccttctag

SEQ ID NO: 149311 - DNA, 51 bp, Artificial Sequence
  Description of Artificial Sequence: Synthetic coding sequence
atggccgccttcagcgagatgggcgtgatgcctgagatcgcccaggcctag

SEQ ID NO: 149312 - DNA, 1869 bp, Artificial Sequence
  Description of Artificial Sequence: Synthetic coding sequence
atggccgccttcagcgagatgggcgtgatgcctgagatcgcccaggccgtggaggagatggactggctgctgcccacagacatccaggccgagagcatccccctcatcctgggcggcggagatgtgctgatggctgctgagaccggcagcggcaagacaggagccttcagcatccctgtgatccagatcgtgtatgagaccctgaaggaccagcaggagggcaagaagggcaagaccaccatcaagacaggagcctctgtgctgaacaagtggcagatgaacccctatgaccgggaggtgaaggagtggcacggctgccgggccaccaagggcctgatgaagggcaagcactactatgaggtgtcctgccacgaccagggcctgtgccgggtgggctggagcaccatgcaggccagcctggacctgggcacagacaagtttggatttggatttggaggcaccgggaagaagagccacaacaagcagtttgacaactacggggaggagttcaccatgcatgacaccatcggctgctacctggacatcgacaagggccacgtgaagttcagcaagaatggcaaggacctgggcctggcctttgagatccccccccacatgaagaaccaggccctcttccctgcctgtgtgctgaagaatgctgagctgaagttcaactttggagaggaggagttcaagttcccccccaaggatggctttgtggccctgagcaaggccccagatggctacatcgtgaagagccagcacagcggaaatgcccaggtgacccagaccaagttcctgcccaatgcccccaaggccctgattgtggagcccagccgggagctggccgagcagaccctgaacaacatcaagcagttcaagaagtacatcgacaaccccaagctgcgggagctgctgatcatcggcggcgtggccgcccgggaccagctgtctgtgctggagaatggagtggacatcgtggtgggcaccccaggccgcctggatgacctggtgtccacaggcaagctgaacctgagccaggtgcgcttcctggtgctggatgaagcagatggcctgctgagccagggctacagcgacttcatcaacaggatgcacaaccagatcccccaggtgaccagtgatggcaagaggctgcaggtgattgtgtgcagcgccaccctgcacagctttgatgtgaagaagctgtctgagaagatcatgcacttccccacctgggtggacctgaagggggaggacagcgtgcctgacacagtgcaccacgtggtggtgcctgtgaaccccaagacagaccggctgtgggagcggctgggcaagagccacatcagaacagatgatgtgcacgccaaggacaacaccaggcctggggccaacagccctgagatgtggagcgaggccatcaagatcctgaagggggagtatgctgtgcgggccatcaaggagcacaagatggaccaggccatcatcttctgcaggaccaagattgactgtgacaacctggagcagtacttcatccagcagggcggcggccctgacaagaagggccaccagttcagctgtgtgtgcctgcacggggacaggaagccccatgagaggaagcagaacctggagcgcttcaagaagggagatgtgcgcttcctgatctgcacagatgtggccgcccggggcatcgacatccacggcgtgccctacgtgatcaacgtgaccctgcctgatgagaagcagaactacgtgcacagaattggccgggtgggccgggcagagaggatgggcctggccatcagcctggtggccacagagaaggagaaggtgtggtaccacatggtgcagagagatgctgtgaccatctag

SEQ ID NO: 149313 - DNA, 2628 bp, Artificial Sequence
  Description of Artificial Sequence: Synthetic coding sequence
atgggcaagacagccaacagccctggcagcggggcccggccagaccctgtgcgctccttcaaccgctggaagaagaagcacagccaccggcagaacaagaagaagcagctgaggaagcagctgaagaagccagagtggcaggtggagcgggagagcatcagccggctgatgcagaactatgagaagatcaacgtgaatgagatcacccgcttcagtgacttccccctgagcaagaagaccctgaagggcctgcaggaggcccagtaccgcctggtgacagagatccagaagcagaccatcggcctggccctgcagggcaaggatgtgctgggcgccgccaagacaggcagcggcaagaccctggccttcctggtgcctgtgctggaggccctgtaccgcctgcagtggaccagcacagatggcctgggcgtgctgatcatcagccccacccgggagctggcctaccagacctttgaggtgctgaggaaggtgggcaagaaccacgacttctctgctggcctcatcatcggcggcaaggacctgaagcatgaagctgagcgcatcaacaacatcaacatcctggtgtgcaccccaggccgcctgctgcagcacatggatgagaccgtgtccttccacgccacagacctgcagatgctggtgctggatgaggccgaccgcatcctggacatgggctttgctgacaccatgaatgctgtgattgagaacctgcccaagaagaggcagaccctgctcttcagcgccacccagaccaagtctgtgaaggacctggcccggctgagcctgaagaacccagaatatgtgtgggtgcatgagaaggccaagtacagcaccccagccaccctggagcagaactacatcgtgtgtgagctgcagcagaagatctctgtgctgtacagcttcctgcggagccacctgaagaagaagagcatcgtgttcttcagcagctgcaaggaggtgcagtacctgtacagagtcttctgccgcctgcggcctggggtgtccatcctggccctgcacggccggcagcagcagatgaggaggatggaggtgtacaatgaatttgtgaggaagagagctgctgtgctgtttgccacagacattgctgcccggggcctggacttccctgctgtgaactgggtgctgcagtttgactgcccagaagatgccaacacctacatccacagagctggccgcacagcccgctacaaggaggatggagaggccctgctgatcctgctgcccagcgagaaggccatggtgcagcagctgctgcagaagaaggtgcctgtgaaggagatcaagatcaaccctgagaagctgattgatgtgcagaagaagctggagagcatcctggcccaggaccaggacctgaaggagcgggcccagcgctgctttgtgtcctatgtgcgctctgtgtacctgatgaaggacaaggaggtgtttgatgtgtccaagctgcccatcccagaatatgccctgagcctgggcctggccgtggccccccgggtgcgcttcctgcagaagatgcagaagcagcccaccaaggagctggtgcgcagccaggccgacaaggtgattgagccccgggcccccagcctgaccaatgatgaggtggaggagttccgggcctacttcaatgagaagatgagcatcctgcagaagggcggcaagaggctggagggcacagagcaccggcaggacaatgacacaggaaatgaggagcaggaggaggaggaggatgatgaggaggagatggaggagaagctggccaaggccaagggcagccaggcccccagcctgcccaacaccagcgaggcccagaagatcaaggaggtgcccacccagttcctggacagagatgaggaggaggaggatgctgacttcctgaaggtgaagaggcacaacgtgtttggcctggacctgaaggatgagaagaccctgcagaagaaggagcccagcaagagcagcatcaagaagaagatgaccaaggtggccgaggccaagaaggtgatgaagaggaacttcaaggtgaacaagaagatcaccttcacagatgaaggagagctggtgcagcagtggccccagatgcagaagagcgccatcaaggatgctgaagaagatgatgacacaggaggcatcaacctgcacaaggccaaggagcggctgcaggaggaggacaagtttgacaaggaggagtacaggaagaagatcaaggccaagcaccgggagaagaggctgaaggagcgggaggcccggcgggaggccaacaagaggcaggccaaggccaaggatgaggaggaggccttcctggactggagcgatgatgatgatgatgatgatgatggctttgaccccagcaccctgcctgaccctgacaagtaccgcagcagtgaagattctgattctgaggacatggagaacaagatcagtgacaccaagaagaagcagggcatgaagaagaggagcaacagcgaggtggaggatgtgggccccaccagccacaacaggaagaaggcccgctgggacaccctggagcccctggacaccggcctgagcctggccgaggatgaggagctggtgctgcacctgctgcggagccagagctag

SEQ ID NO: 149314 - DNA, 2346 bp, Artificial Sequence
  Description of Artificial Sequence: Synthetic coding sequence
atgggcaagacagccaacagccctggcagcggggcccggccagaccctgtgcgctccttcaaccgctggaagaagaagcacagccaccggcagaacaagaagaagcagctgaggaagcagctgaagaagccagagtggcaggtggagcgggagagcatcagccggctgatgcagaactatgagaagatcaacgtgaatgagatcacccgcttcagtgacttccccctgagcaagaagaccctgaagggcctgcaggaggcccagtaccgcctggtgacagagatccagaagcagaccatcggcctggccctgcagggcaaggatgtgctgggcgccgccaagacaggcagcggcaagaccctggccttcctggtgcctgtgaatgaggccgaccgcatcctggacatgggctttgctgacaccatgaatgctgtgattgagaacctgcccaagaagaggcagaccctgctcttcagcgccacccagaccaagtctgtgaaggacctggcccggctgagcctgaagaacccagaatatgtgtgggtgcatgagaaggccaagtacagcaccccagccaccctggagcagaactacatcgtgtgtgagctgcagcagaagatctctgtgctgtacagcttcctgcggagccacctgaagaagaagagcatcgtgttcttcagcagctgcaaggaggtgcagtacctgtacagagtcttctgccgcctgcggcctggggtgtccatcctggccctgcacggccggcagcagcagatgaggaggatggaggtgtacaatgaatttgtgaggaagagagctgctgtgctgtttgccacagacattgctgcccggggcctggacttccctgctgtgaactgggtgctgcagtttgactgcccagaagatgccaacacctacatccacagagctggccgcacagcccgctacaaggaggatggagaggccctgctgatcctgctgcccagcgagaaggccatggtgcagcagctgctgcagaagaaggtgcctgtgaaggagatcaagatcaaccctgagaagctgattgatgtgcagaagaagctggagagcatcctggcccaggaccaggacctgaaggagcgggcccagcgctgctttgtgtcctatgtgcgctctgtgtacctgatgaaggacaaggaggtgtttgatgtgtccaagctgcccatcccagaatatgccctgagcctgggcctggccgtggccccccgggtgcgcttcctgcagaagatgcagaagcagcccaccaaggagctggtgcgcagccaggccgacaaggtgattgagccccgggcccccagcctgaccaatgatgaggtggaggagttccgggcctacttcaatgagaagatgagcatcctgcagaagggcggcaagaggctggagggcacagagcaccggcaggacaatgacacaggaaatgaggagcaggaggaggaggaggatgatgaggaggagatggaggagaagctggccaaggccaagggcagccaggcccccagcctgcccaacaccagcgaggcccagaagatcaaggaggtgcccacccagttcctggacagagatgaggaggaggaggatgctgacttcctgaaggtgaagaggcacaacgtgtttggcctggacctgaaggatgagaagaccctgcagaagaaggagcccagcaagagcagcatcaagaagaagatgaccaaggtggccgaggccaagaaggtgatgaagaggaacttcaaggtgaacaagaagatcaccttcacagatgaaggagagctggtgcagcagtggccccagatgcagaagagcgccatcaaggatgctgaagaagatgatgacacaggaggcatcaacctgcacaaggccaaggagcggctgcaggaggaggacaagtttgacaaggaggagtacaggaagaagatcaaggccaagcaccgggagaagaggctgaaggagcgggaggcccggcgggaggccaacaagaggcaggccaaggccaaggatgaggaggaggccttcctggactggagcgatgatgatgatgatgatgatgatggctttgaccccagcaccctgcctgaccctgacaagtaccgcagcagtgaagattctgattctgaggacatggagaacaagatcagtgacaccaagaagaagcagggcatgaagaagaggagcaacagcgaggtggaggatgtgggccccaccagccacaacaggaagaaggcccgctgggacaccctggagcccctggacaccggcctgagcctggccgaggatgaggagctggtgctgcacctgctgcggagccagagctag

SEQ ID NO: 149315 - DNA, 1959 bp, Artificial Sequence
  Description of Artificial Sequence: Synthetic coding sequence
atgagaggaggcggctttggagaccgggaccgggaccgggaccggggcggctttggagcccggggcggcggcggcctgccccccaagaagtttggaaatcctggagagcggctgaggaagaagaagtgggacctgtctgagctgcccaagtttgagaagaacttctacgtggagcaccctgaggtggcccggctgaccccctatgaggtggatgagctgcggaggaagaaggagatcaccgtgagaggaggagatgtgtgccccaagcctgtgtttgccttccaccacgccaacttcccccagtatgtgatggatgtgctgatggaccagcacttcacagagcccacccccatccagtgccagggcttccccctggccctgagcggccgggacatggtgggcatcgcccagacaggcagcggcaagaccctggcctacctgctgcctgccatcgtgcacatcaaccaccagccctacctggagagaggagatggccccatctgcctggtgctggcccccacccgggagctggcccagcaggtgcagcaggtggctgatgattatggcaagtgcagccggctgaagagcacctgcatctacggcggggcccccaagggcccccagatccgggacctggagcggggcgtggagatctgcatcgccaccccaggccgcctgattgacttcctggagagcggcaagaccaacctgcggcgctgcacctacctggtgctggatgaggccgacaggatgctggacatgggctttgagccccagatcaggaagatcgtggaccagatccggccagaccggcagaccctgatgtggagcgccacctggcccaaggaggtgcggcagctggccgaggacttcctgcgggactacacccagatcaacgtgggcaacctggagctgagcgccaaccacaacatcctgcagatcgtggatgtgtgcatggagagcgagaaggaccacaagctgatccagctgatggaggagatcatggccgagaaggagaacaagaccatcatctttgtggagaccaagaggcgctgtgatgacctgaccaggaggatgagaagagatggctggccagccatgtgcatccacggggacaagagccagcctgagcgggactgggtgctgaatgagttccgcagcggcaaggcccccatcctgattgccacagatgtggccagccggggcctgggctttgatgtggaggatgtgaagtttgtgatcaactatgactaccccaacagcagtgaagattatgtgcacagaattggaagaacagcccggagcaccaacaagggcacagcctacaccttcttcaccccaggcaacctgaagcaggcccgggagctgatcaaggtgctggaggaggccaaccaggccatcaaccccaagctgatgcagctggtggaccacagaggaggcggcggcggcggcggcggccgcagccgctaccgcaccaccagcagcgccaacaaccccaacctgatgtaccaggatgaatgtgaccggcggctgcggggcgtgaaggatggcggcagaagagacagcgccagctacagagacagaagtgaaacagaccgggccggctacgccaacggcagcggctacggcagccccaacagcgcctttggagcccaggccggccagtacacctacggccagggcacctatggagctgctgcctacggcaccagcagctacacagcccaggagtatggagctggcacctatggagccagcagcaccaccagcacaggccgcagcagccagagcagcagccagcagttctctggaattggccgcagcggccagcagccccagcccctgatgagccagcagtttgcccagcccccaggggccaccaacatgattggctacatgggccagacagcctaccagtacccacctcctcctcctcctcctccacccagcaggaagtag

SEQ ID NO: 149316 - DNA, 2196 bp, Artificial Sequence
  Description of Artificial Sequence: Synthetic coding sequence
ctgcccactggatttgtggcccccatcctgtgtgtgctgctgcccagccccacccgggaggccgccaccgtggccagcgccaccggggacagcgccagcgagcgggagagcgctgccccagctgctgcccccacagctgaggcccccccacccagcgtggtgaccaggcctgagccccaggccctgcccagccctgccatccgggcccccctgcctgacctgtaccccttcggcaccatgaggggcggcggctttggagaccgggaccgggaccgggacagaggaggctttggagcccggggcggcggcggcctgccccccaagaagtttggaaatcctggagagcggctgaggaagaagaagtgggacctgtctgagctgcccaagtttgagaagaacttctacgtggagcaccctgaggtggcccggctgaccccctatgaggtggatgagctgcggaggaagaaggagatcaccgtgagaggaggagatgtgtgccccaagcctgtgtttgccttccaccacgccaacttcccccagtatgtgatggatgtgctgatggaccagcacttcacagagcccacccccatccagtgccagggcttccccctggccctgagcggccgggacatggtgggcatcgcccagacaggcagcggcaagaccctggcctacctgctgcctgccatcgtgcacatcaaccaccagccctacctggagagaggagatggccccatctgcctggtgctggcccccacccgggagctggcccagcaggtgcagcaggtggctgatgattatggcaagtgcagccggctgaagagcacctgcatctatggaggagcccccaagggcccccagatccgggacctggagcggggcgtggagatctgcatcgccaccccaggccgcctgattgacttcctggagagcggcaagaccaacctgcggcgctgcacctacctggtgctggatgaagctgacaggatgctggacatgggctttgagccccagatcaggaagatcgtggaccagatccggccagaccggcagaccctgatgtggagcgccacctggcccaaggaggtgcggcagctggccgaggacttcctgcgggactacacccagatcaacgtgggcaacctggagctgagcgccaaccacaacatcctgcagatcgtggatgtgtgcatggagagcgagaaggaccacaagctgatccagctgatggaggagatcatggccgagaaggagaacaagaccatcatctttgtggagaccaagagaagatgtgatgacctgaccaggaggatgagaagagatggctggccagccatgtgcatccatggagacaagagccagcctgagcgggactgggtgctgaatgagttccgcagcggcaaggcccccatcctgattgccacagatgtggccagccggggcctggatgtggaggatgtgaagtttgtgatcaactatgactaccccaacagcagcgaggactatgtgcaccgcatcggccgcacagcccggagcaccaacaagggcacagcctacaccttcttcaccccaggcaacctgaagcaggcccgggagctgatcaaggtgctggaggaggccaaccaggccatcaaccccaagctgatgcagctggtggaccaccggggcggcggcggcggcggcggcaaaggaggccgcagccgctaccgcaccaccagcagcgccaacaaccccaacctgatgtaccaggatgaatgtgaccggcggctgcggggcgtgaaggatggcggccggcgggacagcgccagctacagagacagaagtgaaacagacagagctggctacgccaatggaagtggctacggcagccccaacagcgccttcggggcccaggccggccagtacacctacggccagggcacctacggggctgctgcctacggcaccagcagctacacagcccaggagtatggagctggcacctacggggccagcagcaccaccagcacaggccgcagcagccagagcagcagccagcagttcagcggcatcggccgcagcggccagcagccccagcccctgatgagccagcagtttgcccagcccccaggggccaccaacatgattggctacatgggccagacagcctaccagtacccacctcctcctcctcctcctccacccagcaggaagtag

SEQ ID NO: 149317 - DNA, 2190 bp, Artificial Sequence
  Description of Artificial Sequence: Synthetic coding sequence
ctgcccactggatttgtggcccccatcctgtgtgtgctgctgcccagccccacccgggaggccgccaccgtggccagcgccaccggggacagcgccagcgagcgggagagcgctgccccagctgctgcccccacagctgaggcccccccacccagcgtggtgaccaggcctgagccccaggccctgcccagccctgccatccgggcccccctgcctgacctgtaccccttcggcaccatgaggggcggcggctttggagaccgggaccgggaccgggacagaggaggctttggagcccggggcggcggcggcctgccccccaagaagtttggaaatcctggagagcggctgaggaagaagaagtgggacctgtctgagctgcccaagtttgagaagaacttctacgtggagcaccctgaggtggcccggctgaccccctatgaggtggatgagctgcggaggaagaaggagatcaccgtgagaggaggagatgtgtgccccaagcctgtgtttgccttccaccacgccaacttcccccagtatgtgatggatgtgctgatggaccagcacttcacagagcccacccccatccagtgccagggcttccccctggccctgagcggccgggacatggtgggcatcgcccagacaggcagcggcaagaccctggcctacctgctgcctgccatcgtgcacatcaaccaccagccctacctggagagaggagatggccccatctgcctggtgctggcccccacccgggagctggcccagcaggtgcagcaggtggctgatgattatggcaagtgcagccggctgaagagcacctgcatctatggaggagcccccaagggcccccagatccgggacctggagcggggcgtggagatctgcatcgccaccccaggccgcctgattgacttcctggagagcggcaagaccaacctgcggcgctgcacctacctggtgctggatgaagctgacaggatgctggacatgggctttgagccccagatcaggaagatcgtggaccagatccggccagaccggcagaccctgatgtggagcgccacctggcccaaggaggtgcggcagctggccgaggacttcctgcgggactacacccagatcaacgtgggcaacctggagctgagcgccaaccacaacatcctgcagatcgtggatgtgtgcatggagagcgagaaggaccacaagctgatccagctgatggaggagatcatggccgagaaggagaacaagaccatcatctttgtggagaccaagagaagatgtgatgacctgaccaggaggatgagaagagatggctggccagccatgtgcatccatggagacaagagccagcctgagcgggactgggtgctgaatgagttccgcagcggcaaggcccccatcctgattgccacagatgtggccagccggggcctggatgtggaggatgtgaagtttgtgatcaactatgactaccccaacagcagcgaggactatgtgcaccgcatcggccgcacagcccggagcaccaacaagggcacagcctacaccttcttcaccccaggcaacctgaagcaggcccgggagctgatcaaggtgctggaggaggccaaccaggccatcaaccccaagctgatgcagctggtggaccaccggggcggcggcggcggcggcggcggccgcagccgctaccgcaccaccagcagcgccaacaaccccaacctgatgtaccaggatgaatgtgaccggcggctgcggggcgtgaaggatggcggccggcgggacagcgccagctacagagacagaagtgaaacagacagagctggctacgccaatggaagtggctacggcagccccaacagcgccttcggggcccaggccggccagtacacctacggccagggcacctacggggctgctgcctacggcaccagcagctacacagcccaggagtatggagctggcacctacggggccagcagcaccaccagcacaggccgcagcagccagagcagcagccagcagttcagcggcatcggccgcagcggccagcagccccagcccctgatgagccagcagtttgcccagcccccaggggccaccaacatgattggctacatgggccagacagcctaccagtacccacctcctcctcctcctcctccacccagcaggaagtag

SEQ ID NO: 149318 - DNA, 2214 bp, Artificial Sequence
  Description of Artificial Sequence: Synthetic coding sequence
cccaacctgcccactggatttgtggcccccatcctgtgtgtgctgctgcccagccccacccgggaggccgccaccgtggccagcgccaccggggacagcgccagcgagcgggagagcgctgccccagctgctgcccccacagctgaggcccccccacccagcgtggtgaccaggcctgagccccaggccctgcccagccctgccatccgggcccccctgcctgacctgtaccccttcggcaccatgaggggcggcggctttggagaccgggaccgggaccgggacagaggaggctttggagcccggggcggcggcggcctgccccccaagaagtttggaaatcctggagagcggctgaggaagaagaagtgggacctgtctgagctgcccaagtttgagaagaacttctacgtggagcaccctgaggtggcccggctgaccccctatgaggtggatgagctgcggaggaagaaggagatcaccgtgagaggaggagatgtgtgccccaagcctgtgtttgccttccaccacgccaacttcccccagtatgtgatggatgtgctgatggaccagcacttcacagagcccacccccatccagtgccagggcttccccctggccctgagcggccgggacatggtgggcatcgcccagacaggcagcggcaagaccctggcctacctgctgcctgccatcgtgcacatcaaccaccagccctacctggagagaggagatggccccatctgcctggtgctggcccccacccgggagctggcccagcaggtgcagcaggtggctgatgattatggcaagtgcagccggctgaagagcacctgcatctatggaggagcccccaagggcccccagatccgggacctggagcggggcgtggagatctgcatcgccaccccaggccgcctgattgacttcctggagagcggcaagaccaacctgcggcgctgcacctacctggtgctggatgaagctgacaggatgctggacatgggctttgagccccagatcaggaagatcgtggaccagatccggccagaccggcagaccctgatgtggagcgccacctggcccaaggaggtgcggcagctggccgaggacttcctgcgggactacacccagatcaacgtgggcaacctggagctgagcgccaaccacaacatcctgcagatcgtggatgtgtgcatggagagcgagaaggaccacaagctgatccagctgatggaggagatcatggccgagaaggagaacaagaccatcatctttgtggagaccaagagaagatgtgatgacctgaccaggaggatgagaagagatggctggccagccatgtgcatccatggagacaagagccagcctgagcgggactgggtgctgaatgagttccgcagcggcaaggcccccatcctgattgccacagatgtggccagccggggcctggatgtggaggatgtgaagtttgtgatcaactatgactaccccaacagcagcgaggactatgtgcaccgcatcggccgcacagcccggagcaccaacaagggcacagcctacaccttcttcaccccaggcaacctgaagcaggcccgggagctgatcaaggtgctggaggaggccaaccaggccatcaaccccaagctgatgcagctggtggaccaccggggcggcggcggcggcggcggcaaaggaggccgcagccgctaccgcaccaccagcagcgccaacaaccccaacctgatgtaccaggatgaatgtgaccggcggctgcggggcgtgaaggatggcggccggcgggacagcgccagctacagagacagaagtgaaacagacagagctggctacgccaatggaagtggctacggcagccccaacagcgccttcggggcccaggccggccagtacacctacggccagggcacctacggggctgctgcctacggcaccagcagctacacagcccaggagtatggagctggcacctacggggccagcagcaccaccagcacaggccgcagcagccagagcagcagccagcagttcagcggcatcggccgcagcggccagcagccccagcccctgatgagccagcagtttgcccagcccccaggggccaccaacaccctgctgctgctgcccctgctgctgctgcacgtgaatgagaccacccaggtggtggtgaccccagctgacctgatcaccttctag

SEQ ID NO: 149319 - DNA, 546 bp, Artificial Sequence
  Description of Artificial Sequence: Synthetic coding sequence
atgcagctggtggaccaccggggcggcggcggcggcggcggcggccgcagccgctaccgcaccaccagcagcgccaacaaccccaacctgatgtaccaggatgaatgtgaccggcggctgcggggcgtgaaggatggcggccggcgggacagcgccagctacagagacagaagtgaaacagacagagctggctacgccaatggaagtggctacggcagccccaacagcgccttcggggcccaggccggccagtacacctacggccagggcacctacggggctgctgcctacggcaccagcagctacacagcccaggagtatggagctggcacctacggggccagcagcaccaccagcacaggccgcagcagccagagcagcagccagcagttcagcggcatcggccgcagcggccagcagccccagcccctgatgagccagcagtttgcccagcccccaggggccaccaacatgattggctacatgggccagacagcctaccagtacccacctcctcctcctcctcctccacccagcaggaagtag

SEQ ID NO: 149320 - DNA, 2013 bp, Artificial Sequence
  Description of Artificial Sequence: Synthetic coding sequence
atgagccacctgcccatgaagctgctgaggaagaagattgagaagaggaacctgaagctgcggcagaggaacctgaagttccagggcgccagcaacctgaccctgtctgagacccagaatggagatgtgtctgaggagaccatgggcagcaggaaggtgaagaagagcaagcagaagcccatgaatgtgggcctgtctgagacccagaatggaggcatgagccaggaggccgtgggcaacatcaaggtgaccaagagcccccagaagagcacagtgctgaccaatggagaggccgccatgcagagcagcaacagcgagagcaagaagaagaagaagaagaagaggaagatggtgaatgatgctgagccagacaccaagaaggccaagacagaaaataaaggcaagtctgaggaggagagcgctgagaccaccaaggagacagagaacaacgtggagaagccagacaatgatgaagatgaaagtgaggtgcccagcctgcccctgggcctgactggagcctttgaggacaccagctttgccagcctgtgcaacctggtgaatgaaaacaccctgaaggccatcaaggagatgggcttcaccaacatgacagagatccagcacaagagcatccggcccctgctggagggccgggacctgctggccgccgccaagacaggcagcggcaagaccctggccttcctgatcccagctgtggagctgattgtgaagctgcgcttcatgcccagaaatggcaccggggtgctgatcctgagccccacccgggagctggccatgcagaccttcggcgtgctgaaggagctgatgacccaccacgtgcacacctacggcctcatcatgggcggcagcaacagatctgctgaggcccagaagctgggcaatggcatcaacatcatcgtggccaccccaggccgcctgctggaccacatgcagaacaccccaggcttcatgtacaagaacctgcagtgcctggtgattgatgaagctgaccgcatcctggatgtgggctttgaggaggagctgaagcagatcatcaagctgctgcccacccggcggcagaccatgctgttcagcgccacccagaccaggaaggtggaggacctggcccgcatcagcctgaagaaggagcccctgtatgtgggcgtggatgatgacaaggccaatgccaccgtggatggcctggagcagggctacgtggtgtgccccagcgagaagcgcttcctgctgctcttcaccttcctgaagaagaacaggaagaagaagctgatggtgttcttcagcagctgcatgtctgtgaagtaccactatgagctgctgaactacatcgacctgcctgtgctggccatccacggcaagcagaagcagaacaagaggaccaccaccttcttccagttctgcaatgctgacagcggcaccctgctgtgcacagatgtggccgcccggggcctggacatccctgaggtggactggatcgtgcagtatgaccccccagatgaccccaaggagtacatccaccgggtgggccgcacagcccggggcctgaatggccggggccacgccctgctgatcctgcggcctgaggagctgggcttcctgcgctacctgaagcagagcaaggtgcccctgtctgaatttgacttctcctggagcaagatcagtgacatccagagccagctggagaagctgattgagaagaactacttcctgcacaagagcgcccaggaggcctacaagagctacatccgggcctatgacagccacagcctgaagcagatcttcaacgtgaacaacctgaacctgccccaggtggccctgagctttggcttcaaggtgcccccatttgtggacctgaatgtgaacagcaatgaaggcaagcagaagaagaggggcggcggcggcggcttcggctaccagaagaccaagaaggtggagaagagcaagatcttcaagcacatcagcaagaagagcagtgacagccggcagttcagccactag

SEQ ID NO: 149321 - DNA, 1230 bp, Artificial Sequence
  Description of Artificial Sequence: Synthetic coding sequence
atggagcaggagcagacctttggagtgctgaaggagctgatgacccaccacgtgcacacctacggcctcatcatgggcggcagcaacagatctgctgaggcccagaagctgggcaatggcatcaacatcatcgtggccaccccaggccgcctgctggaccacatgcagaacaccccaggcttcatgtacaagaacctgcagtgcctggtgattgatgaggccgaccgcatcctggatgtgggctttgaggaggagctgaagcagatcatcaagctgctgcccacccggcggcagaccatgctgttcagcgccacccagaccaggaaggtggaggacctggcccgcatcagcctgaagaaggagcccctgtatgtgggcgtggatgatgacaaggccaatgccaccgtggatggcctggagcagggctacgtggtgtgccccagcgagaagcgcttcctgctgctcttcaccttcctgaagaagaacaggaagaagaagctgatggtgttcttcagcagctgcatgtctgtgaagtaccactatgagctgctgaactacatcgacctgcctgtgctggccatccacggcaagcagaagcagaacaagaggaccaccaccttcttccagttctgcaatgctgacagcggcaccctgctgtgcacagatgtggccgcccggggcctggacatccctgaggtggactggatcgtgcagtatgaccccccagatgaccccaaggagtacatccaccgggtgggccgcacagcccggggcctgaatggccggggccacgccctgctgatcctgcggcctgaggagctgggcttcctgcgctacctgaagcagagcaaggtgcccctgtctgaatttgacttctcctggagcaagatcagtgacatccagagccagctggagaagctgattgagaagaactacttcctgcacaagagcgcccaggaggcctacaagagctacatccgggcctatgacagccacagcctgaagcagatcttcaacgtgaacaacctgaacctgccccaggtggccctgagctttggcttcaaggtgcccccatttgtggacctgaatgtgaacagcaatgaaggcaagcagaagaagagaggaggcggcggcggcttcggctaccagaagaccaagaaggtggagaagagcaagatcttcaagcacatcagcaagaagagcagtgacagccggcagttcagccactag

SEQ ID NO: 149322 - DNA, 2475 bp, Artificial Sequence
  Description of Artificial Sequence: Synthetic coding sequence
atggctgctgcctttgaggccagcggggccctggccgctgtggccacagccatgcctgctgagcacgtggccgtgcaggtgcctgcccctgagcccaccccaggccctgtgcgcatcctgaggacagcccaggacctgagcagccccaggaccaggactggagatgtgctgctggccgagcctgctgactttgagagcctgctgctgagcaggcctgtgctggagggcctgcgggccgccggctttgagcggcccagccctgtgcagctgaaggccatccccctgggccgctgtggcctggacctgattgtgcaggccaagagcggcaccgggaagacctgtgtgttcagcaccatcgccctggacagcctggtgctggagaacctgagcacccagatcctgatcctggcccccacccgggagattgctgtgcagatccacagcgtcatcacagccatcggcatcaagatggagggcctggagtgccacgtgttcatcggcggcacccccctgagccaggacaagacccggctgaagaagtgccacatcgctgtgggcagccctggccgcatcaagcagctgattgagctggactacctgaaccctggcagcatccgcctcttcatcctggatgaagctgacaagctgctggaggagggcagcttccaggagcagatcaactggatctacagcagcctgcctgccagcaagcagatgctggccgtgtctgccacctacccagagttcctggccaatgccctgaccaagtacatgagggaccccacctttgtgcggctgaacagcagtgaccccagcctcatcggcctgaagcagtactacaaggtggtgaacagctaccccctggcccacaaggtgtttgaggagaagacccagcacctgcaggagctgttcagccgcatccccttcaaccaggccctggtgttcagcaacctgcacagccgggcccagcacctggccgacatcctgagcagcaagggcttccctgctgagtgcatcagcggcaacatgaaccagaaccagaggctggatgccatggccaagctgaagcacttccactgccgggtgctgatcagcacagacctgaccagccggggcattgatgctgagaaggtgaacctggtggtgaacctggatgtgcccctggactgggagacctacatgcacagaattggccgggccggccgcttcggcaccctgggcctgactgtgacctactgctgccgcggggaggaggagaacatgatgatgagaattgcccagaagtgcaacatcaacctgctgcccctgcctgaccccatccccagcggcctgatggaggagtgtgtggactgggatgtggaggtgaaggctgctgtgcacacctacggcatcgcctctgtgcccaaccagcccctgaagaagcagatccagaagattgaaagaaccctgcagatccagaaggcccatggagaccacatggccagcagcaggaacaacagcgtgtctggcctgtctgtgaagagcaagaacaacaccaagcagaagctgcctgtgaagagccacagtgaatgtggcatcatcgagaaggccaccagccccaaggagctgggctgtgaccggcagagcgaggagcagatgaagaacagcgtgcagacccctgtggagaacagcaccaacagccagcaccaggtgaaggaggccctgcctgtgtccctgccccagatcccctgcctgagcagcttcaagatccaccagccctacaccctgacctttgctgagctggtggaggactatgagcactacatcaaggagggcctggagaagcctgtggagatcatccgccactacacaggccctggggaccagacagtgaacccccagaatggatttgtgaggaacaaggtgattgagcagagggtgcctgtgctggccagcagcagccagagcggggacagcgagagtgacagcgacagctacagcagcaggaccagcagccagagcaagggcaacaagagctacctggagggcagcagtgacaaccagctgaaggacagcgagagcacccctgtggatgaccgcatcagcctggagcagcccccaaatggaagtgacacccccaaccctgagaagtaccaggagagccctggcatccagatgaagacccggctgaaggagggcgccagccagagggccaagcagagcagaagaaacctgccccggcgcagcagcttccggctgcagacagaggcccaggaggatgactggtatgactgccaccgggagatccggctgtccttcagtgacacctaccaggactatgaggagtactggagggcctactaccgggcctggcaggagtactatgctgctgccagccacagctactactggaatgcccagaggcaccccagctggatggccgcctaccacatgaacaccatctacctgcaggagatgatgcacagcaaccagtag

SEQ ID NO: 149323 - DNA, 417 bp, Artificial Sequence
  Description of Artificial Sequence: Synthetic coding sequence
atggctgctgcctttgaggccagcggggccctggccgctgtggccacagccatgcctgctgagcacgtggccgtgcaggtgcctgcccctgagcccaccccaggccctgtgcgcatcctgaggacagcccaggacctgagcagccccaggaccaggactggagatgtgctgctggccgagcctgctgactttgagagcctgctgctgagcaggcctgtgctggagggcctgcgggccgccggctttgagcggcccagccctgtgcagctgaaggccatccccctgggccgctgtggcctggacctgattgtgcaggccaagagcggcaccgggaagacctgtgtgttcagcaccatcgccctggacagcctggtgctggagaacctgagcacccaggccgagctgagcaacagctag

SEQ ID NO: 149324 - DNA, 2352 bp, Artificial Sequence
  Description of Artificial Sequence: Synthetic coding sequence
atgcctgggaagctgcggagtgatgctggcctggagagtgacacagccatgaagaagggggagaccctgaggaagcagacagaggagaaggagaagaaggagaagcccaagagtgacaagacagaggagattgctgaggaggaggagaccgtcttccccaaggccaagcaggtgaagaagaaggccgagcccagcgaggtggacatgaacagccccaagagcaagaaggccaagaagaaggaggagcccagccagaatgacatcagccccaagaccaagagcctgaggaagaagaaggagcccatcgagaagaaggtggtgagcagcaagaccaagaaggtgaccaagaatgaggagcccagcgaggaggagattgatgcccccaagcccaagaagatgaagaaggagaaggagatgaatggagagacccgggagaagagccccaagctgaagaatggcttcccccaccctgagccagactgcaaccccagcgaggccgccagcgaggagagcaacagcgagattgagcaggagatccctgtggagcagaaggagggcgccttcagcaacttccccatcagcgaggagaccatcaagctgctgaagggccggggcgtgaccttcctgttccccatccaggccaagaccttccaccacgtgtacagcggcaaggacctgattgcccaggccaggacaggcaccgggaagaccttctcctttgccatccccctgattgagaagctgcatggagagctgcaggacaggaagaggggccgggccccccaggtgctggtgctggcccccacccgggagctggccaaccaggtgtccaaggacttcagtgacatcaccaagaagctgtctgtggcctgcttctatggaggcaccccctacggcggccagtttgagaggatgagaaatggaattgacatcctggtgggcaccccaggccgcatcaaggaccacatccagaatggcaagctggacctgaccaagctgaagcacgtggtgctggatgaggtggaccagatgctggacatgggctttgctgaccaggtggaggagatcctgtctgtggcctacaagaaggacagcgaggacaacccccagaccctgctcttcagcgccacctgcccccactgggtgttcaacgtggccaagaagtacatgaagagcacctatgagcaggtggacctgattggcaagaagacccagaagacagccatcaccgtggagcacctggccatcaagtgccactggacccagagagctgctgtgattggagatgtgatccgggtgtacagcggccaccagggccgcaccatcatcttctgtgagaccaagaaggaggcccaggagctgagccagaacagcgccatcaagcaggatgcccagagcctgcacggggacatcccccagaagcagcgggagatcaccctgaagggcttcagaaatggcagctttggagtgctggtggccaccaacgtggccgcccggggcctggacatccctgaggtggacctggtgatccagagcagcccccccaaggatgtggagagctacatccacaggagcggccgcacaggccgggccggccgcactggagtgtgcatctgcttctaccagcacaaggaggagtaccagctggtgcaggtggagcagaaggccggcatcaagttcaagagaattggagtgcccagcgccacagagatcatcaaggccagcagcaaggatgccatccggctgctggacagcgtgcccccaacagccatcagccacttcaagcagagcgctgagaagctgattgaggagaagggagctgtggaggccctggccgccgccctggcccacatcagcggggccacctctgtggaccagaggagcctcatcaacagcaatgtgggctttgtgaccatgatcctgcagtgcagcattgagatgcccaacatctcctatgcctggaaggagctgaaggagcagctgggggaggagattgacagcaaggtgaagggcatggtgttcctgaagggcaagctgggcgtgtgctttgatgtgcccacagcctctgtgacagagatccaggagaagtggcatgacagccgccgctggcagctgtctgtggccacagagcagcctgagctggagggcccccgggagggctatggaggcttccggggccagcgggagggcagccggggcttccggggccagagagatggcaacagacgcttccggggccagcgggagggcagccggggcccccggggccagaggtctgggggcggcaacaagagcaacagaagccagaacaagggccagaagaggagcttcagcaaggccttcggccagtag

SEQ ID NO: 149325 - DNA, 249 bp, Artificial Sequence
  Description of Artificial Sequence: Synthetic coding sequence
atgcctgggaagctgcggagtgatgctggcctggagagtgacacagccatgaagaagggggagaccctgaggaagcagacagaggagaaggagaagaaggagaagcccaagagtgacaagacagaggagattgctgaggaggaggagaccgtcttccccaaggccaagcaggtgaagaagaaggccgagcccagcgaggtggacatgaacagccccaagagcaagaagaagaagaagaagaagaagtag

SEQ ID NO: 149326 - DNA, 2463 bp, Artificial Sequence
  Description of Artificial Sequence: Synthetic coding sequence
atggccggggagctggccgacaagaaggacagagatgccagccccagcaaggaggagaggaagaggagcaggaccccagaccgggagcgggaccgggaccgggacaggaagagcagccccagcaaggacaggaagaggcacaggagccgggacagaagaagaggaggcagccgcagccgcagccgcagccgcagcaagtctgctgagcgggagcggcggcacaaggagcgggagcgggacaaggagcgggacaggaacaagaaggaccgggaccgggacaaggatggccaccggcgggacaaggacaggaagaggagcagcctgagccctggccggggcaaggacttcaagagcaggaaggaccgggacagcaagaaggatgaagaagatgagcacggggacaagaagcccaaggcccagcccctgagcctggaggagctgctggccaagaagaaggccgaggaggaggccgaggccaagcccaagttcctgagcaaggccgagcgggaggccgaggccctgaagaggcggcagcaggaggtggaggagcggcagaggatgctggaggaggagaggaagaagaggaagcagttccaggacctgggcaggaagatgctggaggacccccaggagcgggagcggcgggagcggcgggagaggatggagcgggagaccaatggaaatgaagatgaggagggccggcagaagatccgggaggagaaggacaagagcaaggagctgcacgccatcaaggagcgctacctgggcggcatcaagaagagaagaaggaccaggcacctgaatgacaggaagtttgtgtttgagtgggatgccagcgaggacaccagcattgactacaaccccctgtacaaggagcggcaccaggtgcagctgctgggccggggcttcatcgccggcatcgacctgaagcagcagaagcgggagcagagccgcttctacggggacctgatggagaagaggaggaccctggaggagaaggagcaggaggaggcccggctgaggaagctgaggaagaaggaggccaagcagcgctgggatgacagacactggagccagaagaagctggatgagatgacagaccgggactggaggatcttccgggaggactacagcatcaccaccaagggcggcaagatccccaaccccatccgctcctggaaggacagcagcctgcccccccacatcctggaggtgattgacaagtgtggctacaaggagcccacccccatccagaggcaggccatccccatcggcctgcagaacagagacatcatcggcgtggccgagactggaagtggcaagacagctgccttcctgatccccctgctggtgtggatcaccaccctgcccaagattgaccgcatcgaggagagtgaccagggcccctatgccatcatcctggcccccacccgggagctggcccagcagatcgaggaggagaccatcaagtttgggaagcccctgggcatcagaacagtggccgtgattggaggcatcagccgggaggaccagggcttccggctgaggatgggctgtgaaattgtgattgccaccccaggccgcctgattgatgtgctggagaaccgctacctggtgctgagccgctgcacctacgtggtgctggatgaagctgacaggatgattgacatgggctttgagccagatgtgcagaagatcctggagcacatgcctgtgagcaaccagaagccagacacagatgaagcagaagatcctgagaagatgctggccaactttgagagcggcaagcacaagtaccggcagacagtgatgttcaccgccaccatgcccccagctgtggagcggctggcccggagctacctgcggcggcctgctgtggtgtacatcggcagcgctgggaagccccatgagcgggtggagcagaaggtgttcctgatgtctgagagcgagaagaggaagaagctgctggccatcctggagcagggctttgatcctcccatcatcatctttgtgaaccagaagaagggctgtgatgtgctggccaagagcctggagaagatgggctacaatgcctgcaccctgcatggaggcaagggccaggagcagcgggagtttgccctgagcaacctgaaggccggggccaaggacatcctggtggccacagatgtggccggccggggcatcgacatccaggatgtgtccatggtggtgaactatgacatggccaagaacatcgaggactacatccaccgcatcggccgcacaggccgggccggcaagtctggagtggccatcaccttcctgaccaaggaggacagcgctgtgttctatgagctgaagcaggccatcctggagagccctgtgagcagctgccccccagagctggccaaccacccagatgcccagcacaagccaggcaccatcctgaccaagaagagaagagaggagaccatctttgcctag

SEQ ID NO: 149327 - DNA, 417 bp, Artificial Sequence
  Description of Artificial Sequence: Synthetic coding sequence
atggccggggagctggccgacaagaaggacagagatgccagccccagcaaggaggagaggaagaggagcaggaccccagaccgggagcgggaccgggaccgggacaggaagagcagccccagcaaggacaggaagaggcacaggagccgggacagaagaagaggaggcagccgcagccgcagccgcagccgcagcaagtctgctgagcgggagcggcggcacaaggagcgggagcgggacaaggagcgggacaggaacaagaaggaccgggaccgggacaaggatggccaccggcgggacaaggacaggaagaggagcagcctgagccctggccggggcaaggacttcaagagcaggaaggaccgggacagcaagaaggatgaagaagatgagcacggggacaagaagcccaagtag

SEQ ID NO: 149328 - DNA, 549 bp, Artificial Sequence
  Description of Artificial Sequence: Synthetic coding sequence
atggccggggagctggccgacaagaaggacagagatgccagccccagcaaggaggagaggaagaggagcaggaccccagaccgggagcgggaccgggaccgggacaggaagagcagccccagcaaggacaggaagaggcacaggagccgggacagaagaagaggaggcagccgcagccgcagccgcagccgcagcaagtctgctgagcgggagcggcggcacaaggagcgggagcgggacaaggagcgggacaggaacaagaaggaccgggaccgggacaaggatggccaccggcgggacaaggacaggaagaggagcagcctgagccctggccggggcaaggacttcaagagcaggaaggaccgggacagcaagaaggatgaagaagatgagcacggggacaagaagcccaaggcccagcccctgagcctggaggagctgctggccaagaagaaggccgaggaggaggccgaggccaagcccaagttcctgagcaaggccgagcgggaggccgaggccctgaagaggcggcagcaggaggtggagtag

SEQ ID NO: 149329 - DNA, 2580 bp, Artificial Sequence
  Description of Artificial Sequence: Synthetic coding sequence
atgaagctgaaggacaccaagagccggcccaagcagagcagctgtgggaagttccagaccaagggcatcaaggtggtgggcaagtggaaggaggtgaagattgaccccaacatgtttgctgatggccagatggatgacctggtgtgctttgaggagctgacagactaccagctggtgtccccagccaagaaccccagcagcctcttcagcaaggaggcccccaagaggaaggcccaggccgtgtctgaggaggaggaggaggaggagggcaagagcagcagccccaagaagaagatcaagctgaagaagagcaagaatgtggccacagagggcaccagcacccagaaggagtttgaggtgaaggaccctgagctggaggcccagggagatgacatggtgtgtgatgatcctgaggccggggagatgaccagcgagaacctggtgcagacagcccccaagaagaagaagaacaagggcaagaagggcctggagcccagccagagcacagctgccaaggtgcccaagaaggccaagacctggatccctgaggtgcatgaccagaaggcagatgtgtctgcctggaaggacctgtttgtgcccaggcctgtgctgcgggccctgtccttcctgggcttcagcgcccccacccccatccaggccctgaccctggccccagccatccgggacaagctggacatcctgggcgctgctgagactggaagtggcaagaccctggcctttgccatccccatgattcatgctgtgctgcagtggcagaagagaaatgctgcccccccacccagcaacacagaggcccctcctggagagaccaggacagaagctggagctgagaccaggagccctgggaaggccgaggccgagagtgatgccctgcctgatgacaccgtcatcgagagcgaggccctgcccagcgacattgctgctgaggcccgggccaagacaggaggcaccgtgtctgaccaggccctgctgtttggagatgatgatgctggggagggccccagcagcctcatccgggagaagcctgtgcccaagcagaatgaaaatgaggaggagaacctggacaaggagcagacaggcaacctgaagcaggagctggatgacaagagcgccacctgcaaggcctaccccaagaggcccctgctgggcctggtgctgacccccacccgggagctggccgtgcaggtgaagcagcacattgatgctgtggcccgcttcaccggcatcaagacagccatcctggtgggcggcatgagcacccagaagcagcagaggatgctgaacagaagacctgagatcgtggtggccaccccaggccgcctgtgggagctgatcaaggagaagcactaccacctgaggaacctgcggcagctgcgctgcctggtggtggatgaagctgacaggatggtggagaagggccactttgctgagctgagccagctgctggagatgctgaatgacagccagtacaaccccaagaggcagaccctggtgttttctgccaccctgaccctggtgcaccaggccccagcccgcatcctgcacaagaagcacaccaagaagatggacaagacagccaagctggacctgctgatgcagaagattggcatgaggggcaagcccaaggtgattgacctgaccagaaatgaggccaccgtggagaccctgacagagaccaagatccactgtgaaacagatgagaaggacttctacctgtactacttcctgatgcagtacccaggccgcagcctggtgtttgccaacagcatcagctgcatcaagaggctgagcggcctgctgaaggtgctggacatcatgcccctgaccctgcacgcctgcatgcaccagaagcagaggctgaggaacctggagcagtttgcccggctggaggactgtgtgctgctggccacagatgtggccgcccggggcctggacatccccaaggtgcagcacgtgatccactaccaggtgcccaggaccagcgagatctacgtgcacaggagcggccgcacagcccgggccaccaatgaaggcctgagcctgatgctgattggaccagaagatgtgatcaacttcaagaagatctacaagaccctgaagaaggatgaggacatccccctcttccctgtgcagaccaagtacatggatgtggtgaaggagcgcatccggctggcccggcagatcgagaagtctgagtacagaaacttccaggcctgcctgcacaacagctggattgagcaggccgctgctgccctggagattgagctggaggaggacatgtacaagggcggcaaggctgaccagcaggaggagcggcggcggcagaagcagatgaaggtgctgaagaaggagctgcggcacctgctgagccagcccctcttcacagagagccagaagaccaagtaccccacccagagcggcaagccacccctgctggtgtctgcccccagcaagtctgagagcgccctgagctgcctgagcaagcagaagaagaagaagaccaagaagcccaaggagccccagcctgagcagccccagcccagcaccagcgccaactag

SEQ ID NO: 149330 - DNA, 2415 bp, Artificial Sequence
  Description of Artificial Sequence: Synthetic coding sequence
atgaagctgaaggacaccaagagccggcccaagcagagcagctgtgggaagttccagaccaagggcatcaaggtggtgggcaagtggaaggaggtgaagattgaccccaacatgtttgctgatggccagatggatgacctggtgtgctttgaggagctgacagactaccagctggtgtccccagccaagaaccccagcagcctcttcagcaaggaggcccccaagaggaaggcccaggccgtgtctgaggaggaggaggaggaggagggcaagagcagcagccccaagaagaagatcaagctgaagaagagcaagaatgtggccacagagggcaccagcacccagaaggagtttgaggtgaaggaccctgagctggaggcccagggagatgacatggtgtgtgatgatcctgaggccggggagatgaccagcgagaacctggtgcagacagcccccaagaagaagaagaacaagggcaagaagggcctggagcccagccagagcacagctgccatccgggacaagctggacatcctgggcgctgctgagaccggcagcggcaagaccctggcctttgccatccccatgattcatgctgtgctgcagtggcagaagagaaatgctgcccccccacccagcaacacagaggcccctcctggagagaccaggacagaggccggggctgagaccaggagccctgggaaggccgaggccgagagtgatgccctgcctgatgacacagtgattgaaagtgaggccctgcccagcgacattgctgctgaggcccgggccaagacaggaggcaccgtgtctgaccaggccctgctgtttggagatgatgatgctggggagggccccagcagcctcatccgggagaagcctgtgcccaagcagaatgaaaatgaggaggagaacctggacaaggagcagacaggcaacctgaagcaggagctggatgacaagagcgccacctgcaaggcctaccccaagaggcccctgctgggcctggtgctgacccccacccgggagctggccgtgcaggtgaagcagcacattgatgctgtggcccgcttcaccggcatcaagacagccatcctggtgggcggcatgagcacccagaagcagcagaggatgctgaacagaagacctgagatcgtggtggccaccccaggccgcctgtgggagctgatcaaggagaagcactaccacctgaggaacctgcggcagctgcgctgcctggtggtggatgaggccgacaggatggtggagaagggccactttgctgagctgagccagctgctggagatgctgaatgacagccagtacaaccccaagaggcagaccctggtgttcagcgccaccctgaccctggtgcaccaggccccagcccgcatcctgcacaagaagcacaccaagaagatggacaagacagccaagctggacctgctgatgcagaagattggcatgaggggcaagcccaaggtgattgacctgaccagaaatgaggccaccgtggagaccctgacagagaccaagatccactgtgaaacagatgagaaggacttctacctgtactacttcctgatgcagtacccaggccgcagcctggtgtttgccaacagcatcagctgcatcaagaggctgagcggcctgctgaaggtgctggacatcatgcccctgaccctgcacgcctgcatgcaccagaagcagaggctgaggaacctggagcagtttgcccggctggaggactgtgtgctgctggccacagatgtggccgcccggggcctggacatccccaaggtgcagcacgtgatccactaccaggtgcccaggaccagcgagatctacgtgcacaggagcggccgcacagcccgggccaccaatgaaggcctgagcctgatgctgattggaccagaagatgtgatcaacttcaagaagatctacaagaccctgaagaaggatgaggacatccccctcttccctgtgcagaccaagtacatggatgtggtgaaggagcgcatccggctggcccggcagatcgagaagtctgagtacagaaacttccaggcctgcctgcacaacagctggattgagcaggccgccgccgccctggagattgagctggaggaggacatgtacaagggcggcaaggctgaccagcaggaggagcggcggcggcagaagcagatgaaggtgctgaagaaggagctgcggcacctgctgagccagcccctcttcacagagagccagaagaccaagtaccccacccagagcggcaagccacccctgctggtgtctgcccccagcaagtctgagagcgccctgagctgcctgagcaagcagaagaagaagaagaccaagaagcccaaggagccccagcctgagcagccccagcccagcaccagcgccaactag

SEQ ID NO: 149331 - DNA, 2292 bp, Artificial Sequence
  Description of Artificial Sequence: Synthetic coding sequence
atggatgacctggtgtgctttgaggagctgacagactaccagctggtgtccccagccaagaaccccagcagcctcttcagcaaggaggcccccaagaggaaggcccaggccgtgtctgaggaggaggaggaggaggagggcaagagcagcagccccaagaagaagatcaagctgaagaagagcaagaatgtggccacagagggcaccagcacccagaaggagtttgaggtgaaggaccctgagctggaggcccagggagatgacatggtgtgtgatgatcctgaggccggggagatgaccagcgagaacctggtgcagacagcccccaagaagaagaagaacaagggcaagaagggcctggagcccagccagagcacagctgccaaggtgcccaagaaggccaagacctggatccctgaggtgcatgaccagaaggcagatgtgtctgcctggaaggacctgtttgtgcccaggcctgtgctgcgggccctgtccttcctgggcttcagcgcccccacccccatccaggccctgaccctggccccagccatccgggacaagctggacatcctgggcgctgctgagaccggcagcggcaagaccctggcctttgccatccccatgattcatgctgtgctgcagtggcagaagagaaatgctgcccccccacccagcaacacagaggcccctcctggagagaccaggacagaggccggggctgagaccaggagccctgggaaggccgaggccgagagtgatgccctgcctgatgacacagtgattgaaagtgaggccctgcccagcgacattgctgctgaggcccgggccaagacaggaggcaccgtgtctgaccaggccctgctgtttggagatgatgatgctggggagggccccagcagcctcatccgggagaagcctgtgcccaagcagaatgaaaatgaggaggagaacctggacaaggagcagacaggcaacctgaagcaggagctggatgacaagagcgccacctgcaaggcctaccccaagaggcccctgctgggcctggtgctgacccccacccgggagctggccgtgcaggtgaagcagcacattgatgctgtggcccgcttcaccggcatcaagacagccatcctggtgggcggcatgagcacccagaagcagcagaggatgctgaacagaagacctgagatcgtggtggccaccccaggccgcctgtgggagctgatcaaggagaagcactaccacctgaggaacctgcggcagctgcgctgcctggtggtggatgaggccgacaggatggtggagaagggccactttgctgagctgagccagctgctggagatgctgaatgacagccagtacaaccccaagaggcagaccctggtgttcagcgccaccctgaccctggtgcaccaggccccagcccgcatcctgcacaagaagcacaccaagaagatggacaagacagccaagctggacctgctgatgcagaagattggcatgaggggcaagcccaaggtgattgacctgaccagaaatgaggccaccgtggagaccctgacagagaccaagatccactgtgaaacagatgagaaggacttctacctgtactacttcctgatgcagtacccaggccgcagcctggtgtttgccaacagcatcagctgcatcaagaggctgagcggcctgctgaaggtgctggacatcatgcccctgaccctgcacgcctgcatgcaccagaagcagaggctgaggaacctggagcagtttgcccggctggaggactgtgtgctgctggccacagatgtggccgcccggggcctggacatccccaaggtgcagcacgtgatccactaccaggtgcccaggaccagcgagatctacgtgcacaggagcggccgcacagcccgggccaccaatgaaggcctgagcctgatgctgattggaccagaagatgtgatcaacttcaagaagatctacaagaccctgaagaaggatgaggacatccccctcttccctgtgcagaccaagtacatggatgtggtgaaggagcgcatccggctggcccggcagatcgagaagtctgagtacagaaacttccaggcctgcctgcacaacagctggattgagcaggccgccgccgccctggagattgagctggaggaggacatgtacaagggcggcaaggctgaccagcaggaggagcggcggcggcagaagcagatgaaggtgctgaagaaggagctgcggcacctgctgagccagccccagcccagcaccagcgccaactag

SEQ ID NO: 149332 - DNA, 1458 bp, Artificial Sequence
  Description of Artificial Sequence: Synthetic coding sequence
atgaccaaggccccctgcaaggcctaccccaagaggcccctgctgggcctggtgctgacccccacccgggagctggccgtgcaggtgaagcagcacattgatgctgtggcccgcttcaccggcatcaagacagccatcctggtgggcggcatgagcacccagaagcagcagaggatgctgaacagaagacctgagatcgtggtggccaccccaggccgcctgtgggagctgatcaaggagaagcactaccacctgaggaacctgcggcagctgcgctgcctggtggtggatgaagctgacaggatggtggagaagggccactttgctgagctgagccagctgctggagatgctgaatgacagccagtacaaccccaagaggcagaccctggtgttttctgccaccctgaccctggtgcaccaggccccagcccgcatcctgcacaagaagcacaccaagaagatggacaagacagccaagctggacctgctgatgcagaagattggcatgaggggcaagcccaaggtgattgacctgaccagaaatgaggccaccgtggagaccctgacagagaccaagatccactgtgaaacagatgagaaggacttctacctgtactacttcctgatgcagtacccaggccgcagcctggtgtttgccaacagcatcagctgcatcaagaggctgagcggcctgctgaaggtgctggacatcatgcccctgaccctgcacgcctgcatgcaccagaagcagaggctgaggaacctggagcagtttgcccggctggaggactgtgtgctgctggccacagatgtggccgcccggggcctggacatccccaaggtgcagcacgtgatccactaccaggtgcccaggaccagcgagatctacgtgcacaggagcggccgcacagcccgggccaccaatgaaggcctgagcctgatgctgattggaccagaagatgtgatcaacttcaagaagatctacaagaccctgaagaaggatgaggacatccccctcttccctgtgcagaccaagtacatggatgtggtgaaggagcgcatccggctggcccggcagatcgagaagtctgagtacagaaacttccaggcctgcctgcacaacagctggattgagcaggccgctgctgccctggagattgagctggaggaggacatgtacaagggcggcaaggctgaccagcaggaggagcggcggcggcagaagcagatgaaggtgctgaagaaggagctgcggcacctgctgagccagcccctcttcacagagagccagaagaccaagtaccccacccagagcggcaagccacccctgctggtgtctgcccccagcaagtctgagagcgccctgagctgcctgagcaagcagaagaagaagaagaccaagaagcccaaggagccccagcctgagcagccccagcccagcaccagcgccaactag

SEQ ID NO: 149333 - DNA, 1623 bp, Artificial Sequence
  Description of Artificial Sequence: Synthetic coding sequence
atggccctgaccaggcctgtgcggctcttcagcctggtgacccggctgctgctggccccccggcggggcctgactgtgcgcagcccagatgagcccctgcctgtggtgcgcatccctgtggccctgcagaggcagctggagcagaggcagagcagaagaagaaacctgcccaggcctgtgctggtgcggcccggccccctgctggtgtctgcccggcggcctgagctgaaccagcctgcccggctgaccctgggccgctgggagcgggcccccctggccagccagggctggaagagccggcgggcccggcgggaccacttcagcattgagcgggcccagcaggaggccccagctgtgaggaagctgagcagcaagggcagctttgctgacctgggcctggagccccgggtgctgcacgccctgcaggaggccgcccctgaggtggtgcagcccaccaccgtgcagagcagcaccatccccagcctgctgcggggcagacatgtggtgtgtgccgctgagaccggcagcggcaagaccctgagctacctgctgcccctgctgcagaggctgctgggccagcccagcctggacagcctgcccatcccagccccccggggcctggtgctggtgcccagccgggagctggcccagcaggtgcgggctgtggcccagcccctgggccgcagcctgggcctgctggtgcgggacctggagggcggccacggcatgaggcgcatccggctgcagctgagccggcagcccagcgcagatgtgctggtggccacccctggggccctgtggaaggccctgaagagccgcctcatcagcctggagcagctgtccttcctggtgctggatgaggccgacaccctgctggatgagagcttcctggagctggtggactacatcctggagaagagccacatcgccgagggccctgctgacctggaggaccccttcaaccccaaggcccagctggtgctggtgggcgccaccttccctgagggcgtgggccagctgctgaacaaggtggccagcccagatgctgtgaccaccatcaccagcagcaagctgcactgcatcatgccccacgtgaagcagaccttcctgcggctgaagggagctgacaaggtggccgagctggtgcacatcctgaagcaccgggacagagctgagaggacaggccccagcggcaccgtgctggtgttctgcaacagcagcagcacagtgaactggctgggctacatcctggatgaccacaagatccagcacctgcggctgcagggccagatgcctgccctgatgagggtgggcatcttccagagcttccagaagagcagccgggacatcctgctgtgcacagacatcgccagccggggcctggacagcactggagtggagctggtggtgaactatgacttcccccccaccctgcaggactacatccacagagctggccgggtgggccgggtgggcagcgaggtgcccggcaccgtcatcagctttgtgacccacccctgggatgtgtccctggtgcagaagattgagctggccgccaggagaagaagaagcctgcccggcctggccagctctgtgaaggagcccctgccccaggccacctag

SEQ ID NO: 149334 - DNA, 1989 bp, Artificial Sequence
  Description of Artificial Sequence: Synthetic coding sequence
atgagccacgtggccgtggagaatgccctgggcctggaccagcagtttgctggcctggacctgaacagcagtgacaaccagagcggcggcagcacagccagcaagggccgctacatccccccccacctgaggaaccgggaggccaccaagggcttctatgacaaggacagcagcggctggagcagcagcaaggacaaggatgcctacagcagctttggcagcagaagtgacagccggggcaagagcagcttcttcagtgaccggggcagcggcagccggggccgctttgatgaccggggccgcagtgactatgatggcatcggcagcagaggagacaggagcggctttgggaagtttgagcggggcggcaacagccgctggtgtgacaagagtgatgaagatgactggagcaagcccctgcccccatctgagcggctggagcaggagctgttcagcggcggcaacacaggcatcaactttgagaagtatgatgacatccctgtggaggccactggaaacaactgccccccccacatcgagagcttcagtgatgtggagatgggagagatcatcatgggcaacatcgagctgacccgctacacccggcccacccctgtgcagaagcacgccatccccatcatcaaggagaagagggacctgatggcctgtgcccagacaggcagcggcaagacagctgccttcctgctgcccatcctgagccagatctacagtgatggccctggagaggccctgcgggccatgaaggaaaatggccgctatggccgcaggaagcagtaccccatcagcctggtgctggcccccacccgggagctggccgtgcagatctatgaggaggccaggaagttctcctaccgcagccgggtgcggccctgtgtggtgtatggaggagctgacatcggccagcagatccgggacctggagcggggctgccacctgctggtggccaccccaggccgcctggtggacatgatggagcggggcaagattggcctggacttctgcaagtacctggtgctggatgaagctgacaggatgctggacatgggctttgagccccagatccgccgcatcgtggagcaggacaccatgccacccaagggcgtgcgccacaccatgatgttcagcgccaccttccccaaggagatccagatgctggcccgggacttcctggatgagtacatcttcctggccgtgggccgggtgggcagcaccagcgagaacatcacccagaaggtggtgtgggtggaggagagtgacaagaggagcttcctgctggacctgctgaatgccaccgggaaggacagcctgaccctggtgtttgtggagaccaagaagggagctgacagcctggaggacttcctgtaccacgagggctacgcctgcaccagcatccacggggacaggagccagagggaccgggaggaggccctgcaccagttccgcagcggcaagagccccatcctggtggccacagctgtggccgcccggggcctggacatcagcaatgtgaagcacgtgatcaactttgacctgcccagcgacatcgaggagtatgtgcacagaattggaagaacaggccgggtgggcaacctgggcctggccaccagcttcttcaatgaaagaaacatcaacatcaccaaggacctgctggacctgctggtggaggccaagcaggaggtgcccagctggctggagaacatggcctatgagcaccactacaagggcagcagccggggccgcagcaagagcagccgcttcagcggcggctttggagcccgggactaccggcagagcagcggggccagcagcagcagcttcagcagcagccgggccagcagcagccgcagcggcggcggcggccacggcagcagccggggctttggaggcggcggctatggaggcttctacaacagtgatggctacggcggcaactacaacagccagggcgtggactggtggggcaactag

SEQ ID NO: 149335 - DNA, 420 bp, Artificial Sequence
  Description of Artificial Sequence: Synthetic coding sequence
atgagccacgtggccgtggagaatgccctgggcctggaccagcagtttgctggcctggacctgaacagcagtgacaaccagagcggcggcagcacagccagcaagggccgctacatccccccccacctgaggaaccgggaggccaccaagggcttctatgacaaggacagcagcggctggagcagcagcaaggacaaggatgcctacagcagctttggcagcagaagtgacagccggggcaagagcagcttcttcagtgaccggggcagcggcagccggggccgctttgatgaccggggccgcagtgactatgatggcatcggcagcagaggagacaggagcggctacggcggcttctacaacagtgatggctatggaggcaactacaacagccagggcgtggactggtggggcaactag

SEQ ID NO: 149336 - DNA, 1941 bp, Artificial Sequence
  Description of Artificial Sequence: Synthetic coding sequence
atgagccacgtggccgtggagaatgccctgggcctggaccagcagtttgctggcctggacctgaacagcagtgacaaccagagcggcggcagcacagccagcagcttctatgacaaggacagcagcggctggagcagcagcaaggacaaggatgcctacagcagctttggcagcagaagtgacagccggggcaagagcagcttcttcagtgaccggggcagcggcagccggggccgctttgatgaccggggccgcagtgactatgatggcatcggcagcagaggagacaggagcggctttgggaagtttgagcggggcggcaacagccgctggtgtgacaagagtgatgaagatgactggagcaagcccctgcccccatctgagcggctggagcaggagctgttcagcggcggcaacacaggcatcaactttgagaagtatgatgacatccctgtggaggccactggaaacaactgccccccccacatcgagagcttcagtgatgtggagatgggagagatcatcatgggcaacatcgagctgacccgctacacccggcccacccctgtgcagaagcacgccatccccatcatcaaggagaagagggacctgatggcctgtgcccagacaggcagcggcaagacagctgccttcctgctgcccatcctgagccagatctacagtgatggccctggagaggccctgcgggccatgaaggaaaatggccgctatggccgcaggaagcagtaccccatcagcctggtgctggcccccacccgggagctggccgtgcagatctatgaggaggccaggaagttctcctaccgcagccgggtgcggccctgtgtggtgtatggaggagctgacatcggccagcagatccgggacctggagcggggctgccacctgctggtggccaccccaggccgcctggtggacatgatggagcggggcaagattggcctggacttctgcaagtacctggtgctggatgaagctgacaggatgctggacatgggctttgagccccagatccgccgcatcgtggagcaggacaccatgccacccaagggcgtgcgccacaccatgatgttcagcgccaccttccccaaggagatccagatgctggcccgggacttcctggatgagtacatcttcctggccgtgggccgggtgggcagcaccagcgagaacatcacccagaaggtggtgtgggtggaggagagtgacaagaggagcttcctgctggacctgctgaatgccaccgggaaggacagcctgaccctggtgtttgtggagaccaagaagggagctgacagcctggaggacttcctgtaccacgagggctacgcctgcaccagcatccacggggacaggagccagagggaccgggaggaggccctgcaccagttccgcagcggcaagagccccatcctggtggccacagctgtggccgcccggggcctggacatcagcaatgtgaagcacgtgatcaactttgacctgcccagcgacatcgaggagtatgtgcacagaattggaagaacaggccgggtgggcaacctgggcctggccaccagcttcttcaatgaaagaaacatcaacatcaccaaggacctgctggacctgctggtggaggccaagcaggaggtgcccagctggctggagaacatggcctatgagcaccactacaagggcagcagccggggccgcagcaagagcagccgcttcagcggcggctttggagcccgggactaccggcagagcagcggggccagcagcagcagcttcagcagcagccgggccagcagcagccgcagcggcggcggcggccacggcagcagccggggctttggaggcggcggctatggaggcttctacaacagtgatggctacggcggcaactacaacagccagggcgtggactggtggggcaactag

SEQ ID NO: 149337 - DNA, 927 bp, Artificial Sequence
  Description of Artificial Sequence: Synthetic coding sequence
atgagggagagccgcctcatcagtgacctgggcggctttgctggggtgcgctctgctgctggccgggactggaggcccttctggctgggcggcctgcggcccagccggctggcccagcccggcttccccagcggcggccctgggggcacccgctgcctgcgggcctgtgagcagggctttgctggcctggacctgaacagcagtgacaaccagagcggcggcagcacagccagcaagggccgctacatccccccccacctgaggaaccgggaggccaccaagggcttctatgacaaggacagcagcggctggagcagcagcaaggacaaggatgcctacagcagctttggcagcagaagtgacagccggggcaagagcagcttcttcagtgaccggggcagcggcagccggggccgctttgatgaccggggccgcagtgactatgatggcatcggcagcagaggagacaggagcggctttgggaagtttgagcggggcggcaacagccgctggtgtgacaagagtgatgaagatgactggagcaagcccctgcccccatctgagcggctggagcaggagctgttcagcggcggcaacacaggcatcaactttgagaagtatgatgacatccctgtggaggccactggaaacaactgccccccccacatcgagagcttcagtgatgtggagatgggagagatcatcatgggcaacatcgagctgacccgctacacccggcccacccctgtgcagaagcacgccatccccatcatcaaggagaagagggacctgatggcctgtgcccagacaggcaagtggaaggtgtgggccccccagaccatccccaacctgctgggcatcagcaccaatgaaagagtgggcagcacagacctgcggggcagccagaagatcttcatccccatctag

SEQ ID NO: 149338 - DNA, 1983 bp, Artificial Sequence
  Description of Artificial Sequence: Synthetic coding sequence
atgagccacgtggtggtgaagaatgaccctgagctggaccagcagctggccaacctggacctgaacagcgagaagcagagcggcggggccagcacagccagcaagggccgctacatccccccccacctgaggaaccgggaggccagcaagggcttccatgacaaggacagcagcggctggagctgcagcaaggacaaggatgcctacagcagctttggcagccgggacagccggggcaagccaggctacttcagcgagcggggcagcggcagccggggccgctttgatgaccggggccgcagtgactatgatggcatcggcaaccgggagcggcccggcttcggccgctttgagaggagcggccacagccgctggtgtgacaagtctgtggaggatgactggagcaagcccctgcccccatctgagcggctggagcaggagctgttcagcggcggcaacacaggcatcaactttgagaagtatgatgacatccctgtggaggccaccggcagcaactgccccccccacatcgagaacttcagtgacatcgacatgggagagatcatcatgggcaacatcgagctgacccgctacacccggcccacccctgtgcagaagcacgccatccccatcatcaagggcaagagggacctgatggcctgtgcccagacaggcagcggcaagacagctgccttcctgctgcccatcctgagccagatctacacagatggccctggagaggccctgaaggctgtgaaggaaaatggccgctatggccgcaggaagcagtaccccatcagcctggtgctggcccccacccgggagctggccgtgcagatctatgaggaggccaggaagttctcctaccgcagccgggtgcggccctgtgtggtgtatggaggagctgacatcggccagcagatccgggacctggagcggggctgccacctgctggtggccaccccaggccgcctggtggacatgatggagcggggcaagattggcctggacttctgcaagtacctggtgctggatgaagctgacaggatgctggacatgggctttgagccccagatccgccgcatcgtggagcaggacaccatgccacccaagggcgtgcgccacaccatgatgttcagcgccaccttccccaaggagatccagatgctggcccgggacttcctggatgagtacatcttcctggccgtgggccgggtgggcagcaccagcgagaacatcacccagaaggtggtgtgggtggaggacctggacaagaggagcttcctgctggacatcctgggcgccaccggcagtgacagcctgaccctggtgtttgtggagaccaagaagggagctgacagcctggaggacttcctgtaccacgagggctacgcctgcaccagcatccacggggacaggagccagagggaccgggaggaggccctgcaccagttccgcagcggcaagagccccatcctggtggccacagctgtggccgcccggggcctggacatcagcaatgtgcgccacgtgatcaactttgacctgcccagcgacatcgaggagtatgtgcacagaattggaagaacaggccgggtgggcaacctgggcctggccaccagcttcttcaatgagaagaacatgaacatcaccaaggacctgctggacctgctggtggaggccaagcaggaggtgcccagctggctggagaacatggcctatgagcaccactacaagggcggcagccggggccgcagcaagagcaaccgcttcagcggcggctttggagcccgggactaccggcagagcagcggcagcagcagcagcggctttggagccagccggggcagcagcagccgcagcggcggcggcggctacggcaacagccggggctttggaggcggcggctatggaggcttctacaacagtgatggctacggcggcaactacaacagccagggcgtggactggtggggcaactag

SEQ ID NO: 149339 - DNA, 1983 bp, Artificial Sequence; identical to SEQ ID NO: 149338
  Description of Artificial Sequence: Synthetic coding sequence

SEQ ID NO: 149340 - DNA, 753 bp, Artificial Sequence
  Description of Artificial Sequence: Synthetic coding sequence
atggagatcggccggcccaggaaggacacctggaagctggccaacctggacctgaacagcgagaagcagagcggcggggccagcacagccagcaagggccgctacatccccccccacctgaggaaccgggaggccagcaagggcttccatgacaaggacagcagcggctggagctgcagcaaggacaaggatgcctacagcagctttggcagccgggacagccggggcaagccaggctacttcagcgagcggggcagcggcagccggggccgctttgatgaccggggccgcagtgactatgatggcatcggcaaccgggagaggcctggcttcggccgctttgagaggagcggccacagccgctggtgtgacaagtctgtggaggatgactggagcaagcccctgccccccagcgagcggctggagcaggagctgttcagcggcggcaacacaggcatcaactttgagaagtatgatgacatccctgtggaggccaccggcagcaactgccccccccacatcgagaacttcagtgacatcgacatgggagagatcatcatgggcaacatcgagctgacccgctacacccggcccacccctgtgcagaagcacgccatccccatcatcaagggcaagagggacctgatggcctgtgcccagacaggcagcggcaagacagctgccttcctgctgcccatcctgagccagatctacacagatggccctggagaggccctgaaggctgtgaagtag

SEQ ID NO: 149341 - DNA, 675 bp, Artificial Sequence
  Description of Artificial Sequence: Synthetic coding sequence
atgagccacgtggtggtgaagaatgaccctgagctggaccagcagctggccaacctggacctgaacagcgagaagcagagcggcggggccagcacagccagcaagggccgctacatccccccccacctgaggaaccgggaggccagcaagggcttccatgacaaggacagcagcggctggagctgcagcaaggacaaggatgcctacagcagctttggcagccgggacagccggggcaagccaggctacttcagcgagcggggcagcggcagccggggccgctttgatgaccggggccgcagtgactatgatggcatcggcaaccgggagcggcccggcttcggccgctttgagaggagcggccacagccgctggtgtgacaagtctgtggaggatgactggagcaagcccctgcccccatctgagcggctggagcaggagctgttcagcggcggcaacacaggcatcaactttgagaagtatgatgacatccctgtggaggccaccggcagcaactgccccccccacatcgagaacttcagtgacatcgacatgggagagatcatcatgggcaacatcgagctgacccgctacacccggcccacccctgtgcagaagcacgccatccccatcatcaagggcaagagggacctgatggcctgtgcccagacctag

SEQ ID NO: 149342 - DNA, 1974 bp, Artificial Sequence
  Description of Artificial Sequence: Synthetic coding sequence
atggagatcggccggcccaggaaggacacctggaagctggccaacctggacctgaacagcgagaagcagagcggcggggccagcacagccagcaagggccgctacatccccccccacctgaggaaccgggaggccagcaagggcttccatgacaaggacagcagcggctggagctgcagcaaggacaaggatgcctacagcagctttggcagccgggacagccggggcaagccaggctacttcagcgagcggggcagcggcagccggggccgctttgatgaccggggccgcagtgactatgatggcatcggcaaccgggagaggcctggcttcggccgctttgagaggagcggccacagccgctggtgtgacaagtctgtggaggatgactggagcaagcccctgccccccagcgagcggctggagcaggagctgttcagcggcggcaacacaggcatcaactttgagaagtatgatgacatccctgtggaggccaccggcagcaactgccccccccacatcgagaacttcagtgacatcgacatgggagagatcatcatgggcaacatcgagctgacccgctacacccggcccacccctgtgcagaagcacgccatccccatcatcaagggcaagagggacctgatggcctgtgcccagacaggcagcggcaagacagctgccttcctgctgcccatcctgagccagatctacacagatggccctggagaggccctgaaggctgtgaaggaaaatggccgctatggaagaaggaagcagtaccccatcagcctggtgctggcccccacccgggagctggccgtgcagatctatgaggaggccaggaagttctcctaccgcagccgggtgcggccctgtgtggtgtatggaggagctgacatcggccagcagatccgggacctggagcggggctgccacctgctggtggccaccccaggccgcctggtggacatgatggagcggggcaagattggcctggacttctgcaagtacctggtgctggatgaggccgacaggatgctggacatgggctttgagccccagatcagaagaattgtggagcaggacaccatgccacccaagggcgtgcgccacaccatgatgttttctgccaccttccccaaggagatccagatgctggcccgggacttcctggatgagtacatcttcctggccgtgggccgggtgggcagcaccagcgagaacatcacccagaaggtggtgtgggtggaggacctggacaagaggagcttcctgctggacatcctgggcgccactggaagtgacagcctgaccctggtgtttgtggagaccaagaagggagctgacagcctggaggacttcctgtaccacgagggctacgcctgcaccagcatccatggagacaggagccagagggaccgggaggaggccctgcaccagttccgcagcggcaagagccccatcctggtggccacagctgtggccgcccggggcctggacatcagcaatgtgagacatgtgatcaactttgacctgcccagcgacatcgaggagtatgtgcaccgcatcggccgcacaggccgggtgggcaacctgggcctggccaccagcttcttcaatgagaagaacatgaacatcaccaaggacctgctggacctgctggtggaggccaagcaggaggtgcccagctggctggagaacatggcctatgagcaccactacaagggcggcagccggggccgcagcaagagcaaccgcttcagcggcggctttggagcccgggactaccggcagagcagcggcagcagcagcagcggctttggagccagccggggcagcagcagccgcagcggcggcggcggctacggcaacagccggggctttggaggcggcggctacggcggcttctacaacagtgatggctatggaggcaactacaacagccagggcgtggactggtggggcaactag

SEQ ID NO: 149343 - DNA, 1278 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgctgctaccccctgagccccagccgctggccagagcaggccggcctggccccccgggcctggctgagccacctgtgccccatgaggatgatgcccaggagctccatgatgtgcagaattgccctgcggagcatcctggtgtcctgcctgatgaggtag

SEQ ID NO: 149344 - DNA, 1287 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctacatcgagcagaccaggtag

SEQ ID NO: 149345 - DNA, 1287 bp, Artificial Sequence; identical to SEQ ID NO: 149344
  Description of Artificial Sequence: Synthetic coding sequence

SEQ ID NO: 149346 - DNA, 1278 bp, Artificial Sequence; identical to SEQ ID NO: 149343
  Description of Artificial Sequence: Synthetic coding sequence

SEQ ID NO: 149347 - DNA, 1287 bp, Artificial Sequence; identical to SEQ ID NO: 149344
  Description of Artificial Sequence: Synthetic coding sequence

SEQ ID NO: 149348 - DNA, 1287 bp, Artificial Sequence; identical to SEQ ID NO: 149344
  Description of Artificial Sequence: Synthetic coding sequence

SEQ ID NO: 149349 - DNA, 564 bp, Artificial Sequence
  Description of Artificial Sequence: Synthetic coding sequence
atgggcagcagccacatcggcggcctgagcatcaatgaaagacgctgcagcgccagcctgggcctggtgatggccgagaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttcttcggcggcctgagcatcaagaaggatgaggaggtgctgaagaagaactag

SEQ ID NO: 149350 - DNA, 1287 bp, Artificial Sequence; identical to SEQ ID NO: 149344
  Description of Artificial Sequence: Synthetic coding sequence

SEQ ID NO: 149351 - DNA, 378 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctgtag

SEQ ID NO: 149352 - DNA, 1287 bp, Artificial Sequence; identical to SEQ ID NO: 149344
  Description of Artificial Sequence: Synthetic coding sequence

SEQ ID NO: 149353 - DNA, 564 bp, Artificial Sequence
  Description of Artificial Sequence: Synthetic coding sequence
tgaagtgaggagcgggacatcggcaagcccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctactag

SEQ ID NO: 149354 - DNA, 378 bp, Artificial Sequence; identical to SEQ ID NO: 149351
  Description of Artificial Sequence: Synthetic coding sequence

SEQ ID NO: 149355 - DNA, 1287 bp, Artificial Sequence; identical to SEQ ID NO: 149344
  Description of Artificial Sequence: Synthetic coding sequence

SEQ ID NO: 149356 - DNA, 870 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccagtag

SEQ ID NO: 149357 - DNA, 1287 bp, Artificial Sequence; identical to SEQ ID NO: 149344
  Description of Artificial Sequence: Synthetic coding sequence

SEQ ID NO: 149358 - DNA, 291 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacctag

SEQ ID NO: 149359 - DNA, 378 bp, Artificial Sequence; identical to SEQ ID NO: 149351
  Description of Artificial Sequence: Synthetic coding sequence

SEQ ID NO: 149360 - DNA, 696 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgtag

SEQ ID NO: 149361 - DNA, 399 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtgcttctgtgacagccacttccccaggggggacaatgaggagctgcacctgccctag

SEQ ID NO: 149362 - DNA, 1053 bp, Artificial Sequence
  Description of Artificial Sequence: Synthetic coding sequence
atgtggaccatgagctcctggaccatgaagatgatgcgctggaggcagcagctgggggagatgggcctgcggcccctgcccaggaggatgagccgggcccccatgagccccagcacagccctggcctttgtgaccagctgcagcagccagagctgcagcggccccctgagcacagtggccctgagcatccggcagaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctacatcgagcagaccaggtag

SEQ ID NO: 149363 - DNA, 738 bp, Artificial Sequence
  Description of Artificial Sequence: Synthetic coding sequence
atgtggaccatgagctcctggaccatgaagatgatgcgctggaggcagcagctgggggagatgggcctgcggcccctgcccaggaggatgagccgggcccccatgagccccagcacagccctggcctttgtgaccagctgcagcagccagagctgcagcggccccctgagcacagtggccctgagcatccggcagaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccagtag

SEQ ID NO: 149364 - DNA, 411 bp, Artificial Sequence
  Description of Artificial Sequence: Synthetic coding sequence
atgggcggcggcagaagaccctatgatgtgttcttcagcaaggtgatggccgagaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccactag

SEQ ID NO: 149365 - DNA, 1287 bp, Artificial Sequence; identical to SEQ ID NO: 149344
  Description of Artificial Sequence: Synthetic coding sequence

SEQ ID NO: 149366 - DNA, 594 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtgcttctgtgacagccacttccccaggggggacaatgaggagctgcacctgccctacgtgtctgtgtacttcctgcccaaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtgtag

SEQ ID NO: 149367 - DNA, 570 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccagtag

SEQ ID NO: 149368 - DNA, 1287 bp, Artificial Sequence; identical to SEQ ID NO: 149344
  Description of Artificial Sequence: Synthetic coding sequence

SEQ ID NO: 149369 - DNA, 711 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatcagatag

SEQ ID NO: 149370 - DNA, 564 bp, Artificial Sequence
  Description of Artificial Sequence: Synthetic coding sequence
atgggcagcagccacatcggcggcctgagcatcaatgaaagaagaagaagtgccagcctgggcctggtgatggccgagaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttcttcggcggcctgagcatcaagaaggatgaggaggtgctgaagaagaactag

SEQ ID NO: 149371 - DNA, 399 bp, Artificial Sequence; identical to SEQ ID NO: 149361
  Description of Artificial Sequence: Synthetic coding sequence

SEQ ID NO: 149372 - DNA, 1332 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtacctgggccgggtgctgggccggggcttctggtgtgtgtttgtgtctgtgctggtgatgtgccacacccgggagctggccttccagatcagcaaggagtatgagcgcttcagcaagtacatgcccaacgtgaaggtggccgtgttcttcggcggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttttctgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgccagaagattctgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctacatcgagcagaccaggtag

SEQ ID NO: 149373 - DNA, 870 bp, Artificial Sequence; identical to SEQ ID NO: 149356
  Description of Artificial Sequence: Synthetic coding sequence

SEQ ID NO: 149374 - DNA, 564 bp, Artificial Sequence; identical to SEQ ID NO: 149353
  Description of Artificial Sequence: Synthetic coding sequence

SEQ ID NO: 149375 - DNA, 411 bp, Artificial Sequence; identical to SEQ ID NO: 149364
  Description of Artificial Sequence: Synthetic coding sequence

SEQ ID NO: 149376 - DNA, 411 bp, Artificial Sequence; identical to SEQ ID NO: 149364
  Description of Artificial Sequence: Synthetic coding sequence

SEQ ID NO: 149377 - DNA, 399 bp, Artificial Sequence; identical to SEQ ID NO: 149361
  Description of Artificial Sequence: Synthetic coding sequence

SEQ ID NO: 149378 - DNA, 711 bp, Artificial Sequence; identical to SEQ ID NO: 149369
  Description of Artificial Sequence: Synthetic coding sequence

SEQ ID NO: 149379 - DNA, 378 bp, Artificial Sequence; identical to SEQ ID NO: 149351
  Description of Artificial Sequence: Synthetic coding sequence

SEQ ID NO: 149380 - DNA, 987 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctacatcgagcagaccaggtag

SEQ ID NO: 149381 - DNA, 711 bp, Artificial Sequence; identical to SEQ ID NO: 149369
  Description of Artificial Sequence: Synthetic coding sequence

SEQ ID NO: 149382 - DNA, 564 bp, Artificial Sequence; identical to SEQ ID NO: 149353
  Description of Artificial Sequence: Synthetic coding sequence

SEQ ID NO: 149383 - DNA, 378 bp, Artificial Sequence; identical to SEQ ID NO: 149351
  Description of Artificial Sequence: Synthetic coding sequence

SEQ ID NO: 149384 - DNA, 291 bp, Artificial Sequence; identical to SEQ ID NO: 149358
  Description of Artificial Sequence: Synthetic coding sequence

SEQ ID NO: 149385 - DNA, 378 bp, Artificial Sequence; identical to SEQ ID NO: 149351
  Description of Artificial Sequence: Synthetic coding sequence

SEQ ID NO: 149386 - DNA, 987 bp, Artificial Sequence; identical to SEQ ID NO: 149380
  Description of Artificial Sequence: Synthetic coding sequence

SEQ ID NO: 149387 - DNA, 870 bp, Artificial Sequence; identical to SEQ ID NO: 149356
  Description of Artificial Sequence: Synthetic coding sequence

SEQ ID NO: 149388 - DNA, 738 bp, Artificial Sequence; identical to SEQ ID NO: 149363
  Description of Artificial Sequence: Synthetic coding sequence

SEQ ID NO: 149389 - DNA, 738 bp, Artificial Sequence; identical to SEQ ID NO: 149363
  Description of Artificial Sequence: Synthetic coding sequence

SEQ ID NO: 149390 - DNA, 396 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgtag

SEQ ID NO: 149391 - DNA, 411 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatcagatag

SEQ ID NO: 149392 - DNA, 717 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtag

SEQ ID NO: 149393 - DNA, 564 bp, Artificial Sequence; identical to SEQ ID NO: 149353
  Description of Artificial Sequence: Synthetic coding sequence

SEQ ID NO: 149394 - DNA, 594 bp, Artificial Sequence; identical to SEQ ID NO: 149366
  Description of Artificial Sequence: Synthetic coding sequence

SEQ ID NO: 149395 - DNA, 594 bp, Artificial Sequence; identical to SEQ ID NO: 149366
  Description of Artificial Sequence: Synthetic coding sequence

SEQ ID NO: 149396 - DNA, 411 bp, Artificial Sequence; identical to SEQ ID NO: 149364
  Description of Artificial Sequence: Synthetic coding sequence

SEQ ID NO: 149397 - DNA, 1278 bp, Artificial Sequence; identical to SEQ ID NO: 149343
  Description of Artificial Sequence: Synthetic coding sequence

SEQ ID NO: 149398 - DNA, 1287 bp, Artificial Sequence; identical to SEQ ID NO: 149344
  Description of Artificial Sequence: Synthetic coding sequence

SEQ ID NO: 149399 - DNA, 1287 bp, Artificial Sequence; identical to SEQ ID NO: 149344
  Description of Artificial Sequence: Synthetic coding sequence

SEQ ID NO: 149400 - DNA, 738 bp, Artificial Sequence; identical to SEQ ID NO: 149363
  Description of Artificial Sequence: Synthetic coding sequence

SEQ ID NO: 149401 - DNA, 696 bp, Artificial Sequence; identical to SEQ ID NO: 149360
  Description of Artificial Sequence: Synthetic coding sequence

SEQ ID NO: 149402 - DNA, 594 bp, Artificial Sequence; identical to SEQ ID NO: 149366
  Description of Artificial Sequence: Synthetic coding sequence

SEQ ID NO: 149403 - DNA, 594 bp, Artificial Sequence; identical to SEQ ID NO: 149366
  Description of Artificial Sequence: Synthetic coding sequence

SEQ ID NO: 149404 - DNA, 540 bp, Artificial Sequence
  Description of Artificial Sequence: Synthetic coding sequence
gtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccagtag

SEQ ID NO: 149405 - DNA, 594 bp, Artificial Sequence; identical to SEQ ID NO: 149366
  Description of Artificial Sequence: Synthetic coding sequence

SEQ ID NO: 149406 - DNA, 564 bp, Artificial Sequence; identical to SEQ ID NO: 149353
  Description of Artificial Sequence: Synthetic coding sequence

SEQ ID NO: 149407 - DNA, 195 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactag

SEQ ID NO: 149408 - DNA, 78 bp, Artificial Sequence
  Description of Artificial Sequence: Synthetic coding sequence
tgagccaccctgcagcagctggagcctgtgacaggccaggtgtctgtgctggtgatgtgccacacccgggagctgtag

SEQ ID NO: 149409 - DNA, 66 bp, Artificial Sequence
  Description of Artificial Sequence: Synthetic coding sequence
tgagccaccctgcagcagctggagcctgtgacaggccaggtgtctgtgctggtgatgtgccactag

SEQ ID NO: 149410 - DNA, 870 bp, Artificial Sequence; identical to SEQ ID NO: 149356
  Description of Artificial Sequence: Synthetic coding sequence

SEQ ID NO: 149411 - DNA, 711 bp, Artificial Sequence; identical to SEQ ID NO: 149369
  Description of Artificial Sequence: Synthetic coding sequence

SEQ ID NO: 149412 - DNA, 711 bp, Artificial Sequence; identical to SEQ ID NO: 149369
  Description of Artificial Sequence: Synthetic coding sequence

SEQ ID NO: 149413 - DNA, 978 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcggctgagccgctaccagcagttcaaggacttccagaggcgcatcctggtggccaccaacctgtttggccggggcatggacatcgagcgggtgaacatcgccttcaactatgacatgcctgaggacagcgacacctacctgcaccgctgctaccccctgagccccagccgctggccagagcaggccggcctggccccccgggcctggctgagccacctgtgccccatgaggatgatgcccaggagctccatgatgtgcagaattgccctgcggagcatcctggtgtcctgcctgatgaggtag

SEQ ID NO: 149414 - DNA, 717 bp, Artificial Sequence; identical to SEQ ID NO: 149392
  Description of Artificial Sequence: Synthetic coding sequence

SEQ ID NO: 149415 - DNA, 717 bp, Artificial Sequence; identical to SEQ ID NO: 149392
  Description of Artificial Sequence: Synthetic coding sequence

SEQ ID NO: 149416 - DNA, 870 bp, Artificial Sequence; identical to SEQ ID NO: 149356
  Description of Artificial Sequence: Synthetic coding sequence

SEQ ID NO: 149417 - DNA, 1278 bp, Artificial Sequence; identical to SEQ ID NO: 149343
  Description of Artificial Sequence: Synthetic coding sequence

SEQ ID NO: 149418 - DNA, 411 bp, Artificial Sequence; identical to SEQ ID NO: 149364
  Description of Artificial Sequence: Synthetic coding sequence

SEQ ID NO: 149419 - DNA, 564 bp, Artificial Sequence; identical to SEQ ID NO: 149349
  Description of Artificial Sequence: Synthetic coding sequence

SEQ ID NO: 149420 - DNA, 399 bp, Artificial Sequence; identical to SEQ ID NO: 149361
  Description of Artificial Sequence: Synthetic coding sequence

SEQ ID NO: 149421 - DNA, 870 bp, Artificial Sequence; identical to SEQ ID NO: 149356
  Description of Artificial Sequence: Synthetic coding sequence

SEQ ID NO: 149422 - DNA, 1287 bp, Artificial Sequence; identical to SEQ ID NO: 149344
  Description of Artificial Sequence: Synthetic coding sequence

SEQ ID NO: 149423 - DNA, 564 bp, Artificial Sequence; identical to SEQ ID NO: 149349
  Description of Artificial Sequence: Synthetic coding sequence

SEQ ID NO: 149424 - DNA, 291 bp, Artificial Sequence; identical to SEQ ID NO: 149358
  Description of Artificial Sequence: Synthetic coding sequence

SEQ ID NO: 149425 - DNA, 564 bp, Artificial Sequence; identical to SEQ ID NO: 149349
  Description of Artificial Sequence: Synthetic coding sequence

SEQ ID NO: 149426 - DNA, 594 bp, Artificial Sequence; identical to SEQ ID NO: 149366
  Description of Artificial Sequence: Synthetic coding sequence

SEQ ID NO: 149427 - DNA, 291 bp, Artificial Sequence; identical to SEQ ID NO: 149358
  Description of Artificial Sequence: Synthetic coding sequence

SEQ ID NO: 149428 - DNA, 696 bp, Artificial Sequence; identical to SEQ ID NO: 149360
  Description of Artificial Sequence: Synthetic coding sequence

SEQ ID NO: 149429 - DNA, 696 bp, Artificial Sequence; identical to SEQ ID NO: 149360
  Description of Artificial Sequence: Synthetic coding sequence

SEQ ID NO: 149430 - DNA, 717 bp, Artificial Sequence; identical to SEQ ID NO: 149392
  Description of Artificial Sequence: Synthetic coding sequence

SEQ ID NO: 149431 - DNA, 1287 bp, Artificial Sequence; identical to SEQ ID NO: 149344
  Description of Artificial Sequence: Synthetic coding sequence

SEQ ID NO: 149432 - DNA, 564 bp, Artificial Sequence; identical to SEQ ID NO: 149353
  Description of Artificial Sequence: Synthetic coding sequence

SEQ ID NO: 149433 - DNA, 564 bp, Artificial Sequence; identical to SEQ ID NO: 149349
  Description of Artificial Sequence: Synthetic coding sequence

SEQ ID NO: 149434 - DNA, 717 bp, Artificial Sequence; identical to SEQ ID NO: 149392
  Description of Artificial Sequence: Synthetic coding sequence

SEQ ID NO: 149435 - DNA, 738 bp, Artificial Sequence; identical to SEQ ID NO: 149363
  Description of Artificial Sequence: Synthetic coding sequence

SEQ ID NO: 149436 - DNA, 1278 bp, Artificial Sequence; identical to SEQ ID NO: 149343
  Description of Artificial Sequence: Synthetic coding sequence

SEQ ID NO: 149437 - DNA, 711 bp, Artificial Sequence; identical to SEQ ID NO: 149369
  Description of Artificial Sequence: Synthetic coding sequence

SEQ ID NO: 149438 - DNA, 738 bp, Artificial Sequence; identical to SEQ ID NO: 149363
  Description of Artificial Sequence: Synthetic coding sequence

SEQ ID NO: 149439 - DNA, 1287 bp, Artificial Sequence; identical to SEQ ID NO: 149344
  Description of Artificial Sequence: Synthetic coding sequence

SEQ ID NO: 149440 - DNA, 411 bp, Artificial Sequence; identical to SEQ ID NO: 149364
  Description of Artificial Sequence: Synthetic coding sequence

SEQ ID NO: 149441 - DNA, 987 bp, Artificial Sequence; identical to SEQ ID NO: 149380
  Description of Artificial Sequence: Synthetic coding sequence

SEQ ID NO: 149442 - DNA, 399 bp, Artificial Sequence; identical to SEQ ID NO: 149361
  Description of Artificial Sequence: Synthetic coding sequence

SEQ ID NO: 149443 - DNA, 420 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccagagccatgagcacatgacctctgtgaccctggacaacctgacagctgtgggagatgtgctgagccaggcctggggcagctag

SEQ ID NO: 149444 - DNA, 717 bp, Artificial Sequence; identical to SEQ ID NO: 149392
  Description of Artificial Sequence: Synthetic coding sequence

SEQ ID NO: 149445 - DNA, 564 bp, Artificial Sequence; identical to SEQ ID NO: 149370
  Description of Artificial Sequence: Synthetic coding sequence

SEQ ID NO: 149446 - DNA, 711 bp, Artificial Sequence; identical to SEQ ID NO: 149369
  Description of Artificial Sequence: Synthetic coding sequence

SEQ ID NO: 149447 - DNA, 1278 bp, Artificial Sequence; identical to SEQ ID NO: 149343
  Description of Artificial Sequence: Synthetic coding sequence

SEQ ID NO: 149448 - DNA, 696 bp, Artificial Sequence; identical to SEQ ID NO: 149360
  Description of Artificial Sequence: Synthetic coding sequence

SEQ ID NO: 149449 - DNA, 99 bp, Artificial Sequence
  Description of Artificial Sequence: Synthetic coding sequence
tgagccaccctgcagcagctggagcctgtgacaggccaggtgtgcttctgtgacagccacttccccaggggggacaatgaggagctgcacctgccctag

SEQ ID NO: 149450 - DNA, 399 bp, Artificial Sequence; identical to SEQ ID NO: 149361
  Description of Artificial Sequence: Synthetic coding sequence

SEQ ID NO: 149451 - DNA, 399 bp, Artificial Sequence; identical to SEQ ID NO: 149361
  Description of Artificial Sequence: Synthetic coding sequence

SEQ ID NO: 149452 - DNA, 738 bp, Artificial Sequence; identical to SEQ ID NO: 149363
  Description of Artificial Sequence: Synthetic coding sequence

SEQ ID NO: 149453 - DNA, 696 bp, Artificial Sequence; identical to SEQ ID NO: 149360
  Description of Artificial Sequence: Synthetic coding sequence

SEQ ID NO: 149454 - DNA, 732 bp, Artificial Sequence
  Description of Artificial Sequence: Synthetic coding sequence
atgtggaccatgagctcctggaccatgaagatgatgcgctggaggcagcagctgggggagatgggcctgcggcccctgcccaggaggatgagccgggcccccatgagccccagcacagccctggcctttgtgaccagctgcagcagccagagctgcagcggccccctgagcacagtggccctgagcatccggcagaaggtgtctgtgctggtgatgtgccacacccgggagctggccttccagatcagcaaggagtatgagcgcttcagcaagtacatgcccaacgtgaaggtggccgtgttcttcggcggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttttctgccaccctgagcaaggagatccggcctgtgtgcaggaagttcatgcaggatgtgaacaccctgctgcccagcctgccccccctgcctgcccgctgcctgctgcccttcctggccctcttcctgcggctgccctgccacagcagcgccaagaaggccgcctgtgcccagctgggcgtgatgaccccctag

SEQ ID NO: 149455 - DNA, 1287 bp, Artificial Sequence; identical to SEQ ID NO: 149344
  Description of Artificial Sequence: Synthetic coding sequence

SEQ ID NO: 149456 - DNA, 1278 bp, Artificial Sequence; identical to SEQ ID NO: 149343
  Description of Artificial Sequence: Synthetic coding sequence

SEQ ID NO: 149457 - DNA, 291 bp, Artificial Sequence; identical to SEQ ID NO: 149358
  Description of Artificial Sequence: Synthetic coding sequence

SEQ ID NO: 149458 - DNA, 411 bp, Artificial Sequence; identical to SEQ ID NO: 149364
  Description of Artificial Sequence: Synthetic coding sequence

SEQ ID NO: 149459 - DNA, 564 bp, Artificial Sequence; identical to SEQ ID NO: 149353
  Description of Artificial Sequence: Synthetic coding sequence

SEQ ID NO: 149460 - DNA, 717 bp, Artificial Sequence; identical to SEQ ID NO: 149392
  Description of Artificial Sequence: Synthetic coding sequence

SEQ ID NO: 149461 - DNA, 417 bp, Artificial Sequence
  Description of Artificial Sequence: Synthetic coding sequence
tgagccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtag

SEQ ID NO: 149462 - DNA, 870 bp, Artificial Sequence; identical to SEQ ID NO: 149356
  Description of Artificial Sequence: Synthetic coding sequence

SEQ ID NO: 149463 - DNA, 1287 bp, Artificial Sequence; identical to SEQ ID NO: 149344
  Description of Artificial Sequence: Synthetic coding sequence

SEQ ID NO: 149464 - DNA, 696 bp, Artificial Sequence; identical to SEQ ID NO: 149360
  Description of Artificial Sequence: Synthetic coding sequence

SEQ ID NO: 149465 - DNA, 1287 bp, Artificial Sequence; identical to SEQ ID NO: 149344
  Description of Artificial Sequence: Synthetic coding sequence

SEQ ID NO: 149466 - DNA, 378 bp, Artificial Sequence; identical to SEQ ID NO: 149351
  Description of Artificial Sequence: Synthetic coding sequence

SEQ ID NO: 149467 - DNA, 294 bp, Artificial Sequence
  Description of Artificial Sequence: Synthetic coding sequence
tgagccaccctgcagcagctggagcctgtgacaggccaggtgtgcttctgtgacagccacttccccaggggggacaatgaggagctgcacctgccctacgtgtctgtgtacttcctgcccaaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtgtag

SEQ ID NO: 149468 - DNA, 291 bp, Artificial Sequence; identical to SEQ ID NO: 149358
  Description of Artificial Sequence: Synthetic coding sequence

SEQ ID NO: 149469 - DNA, 291 bp, Artificial Sequence; identical to SEQ ID NO: 149358
  Description of Artificial Sequence: Synthetic coding sequence

SEQ ID NO: 149470 - DNA, 1287 bp, Artificial Sequence; identical to SEQ ID NO: 149344
  Description of Artificial Sequence: Synthetic coding sequence

SEQ ID NO: 149471 - DNA, 732 bp, Artificial Sequence; identical to SEQ ID NO: 149454
  Description of Artificial Sequence: Synthetic coding sequence

SEQ ID NO: 149472 - DNA, 972 bp, Artificial Sequence
  Description of Artificial Sequence: Synthetic coding sequence
atggctgaaaatgatgtggacaatgagctgctggactatgaagatgatgaggtggagacagctgctggaggagatggagctgaggccccagccaagaaggatgtgaagggcagctatgtgtccatccacagcagcggcttccgggacttcctgctgaagccagagctgctgcgggccatcgtggactgtggctttgagcaccccagcgaggtgcagcacgagtgcatcccccaggccatcctgggcatggatgtgctgtgccaggccaagagcggcatgggcaagacagctgtgtttgtgctggccaccctgcagcagctggagcctgtgacaggccaggtgtctgtgctggtgatgtgccacacccgggagctggccttccagatcagcaaggagtatgagcgcttcagcaagtacatgcccaacgtgaaggtggccgtgttctttggaggcctgagcatcaagaaggatgaggaggtgctgaagaagaactgcccccacatcgtggtgggcaccccaggccgcatcctggccctggccaggaacaagagcctgaacctgaagcacatcaagcacttcatcctggatgaatgtgacaagatgctggagcagctggacatgagaagagatgtgcaggagatcttcaggatgacccctcatgagaagcaggtgatgatgttcagcgccaccctgagcaaggagatccggcctgtgtgcaggaagttcatgcaggaccccatggagatctttgtggatgatgagaccaagctgaccctgcacggcctgcagcagtactacgtgaagctgaaggacaatgagaagaacaggaagctgtttgacctgctggatgtgctggagttcaaccaggagatcacctgcaagtctgtgcagcgcttcagcaccaccaacagctgtggctaccagcccatctggcccaggcatggccaccgggccggggagcactgcttctag

SEQ ID NO: 149473 - DNA, 972 bp, Artificial Sequence; identical to SEQ ID NO: 149472
  Description of Artificial Sequence: Synthetic coding sequence

SEQ ID NO: 149474 - DNA, 1332 bp, Artificial Sequence; identical to SEQ ID NO: 149372
  Description of Artificial Sequence: Synthetic coding sequence

SEQ ID NO: 149475 - DNA, 732 bp, Artificial Sequence; identical to SEQ ID NO: 149454
  Description of Artificial Sequence: Synthetic coding sequence

SEQ ID NO: 149476 - DNA, 1332 bp, Artificial Sequence; identical to SEQ ID NO: 149372
  Description of Artificial Sequence: Synthetic coding sequence

SEQ ID NO: 149477 - DNA, 420 bp, Artificial Sequence; identical to SEQ ID NO: 149443
  Description of Artificial Sequence: Synthetic coding sequence

SEQ ID NO: 149478 - DNA, 732 bp, Artificial Sequence; identical to SEQ ID NO: 149454
  Description of Artificial Sequence: Synthetic coding sequence

SEQ ID NO: 149479 - DNA, 732 bp, Artificial Sequence; identical to SEQ ID NO: 149454
  Description of Artificial Sequence: Synthetic coding sequence

SEQ ID NO: 149480 - DNA, 420 bp, Artificial Sequence; identical to SEQ ID NO: 149443
  Description of Artificial Sequence: Synthetic coding sequence

SEQ ID NO: 149481 - DNA, 972 bp, Artificial Sequence; identical to SEQ ID NO: 149472
  Description of Artificial Sequence: Synthetic coding sequence

SEQ ID NO: 149482 - DNA, 1332 bp, Artificial Sequence; identical to SEQ ID NO: 149372
  Description of Artificial Sequence: Synthetic coding sequence

SEQ ID NO: 149483 - DNA, 732 bp, Artificial Sequence; identical to SEQ ID NO: 149454
  Description of Artificial Sequence: Synthetic coding sequence

SEQ ID NO: 149484 - DNA, 1053 bp, Artificial Sequence; identical to SEQ ID NO: 149362
  Description of Artificial Sequence: Synthetic coding sequence

SEQ ID NO: 149485 - DNA, 1332 bp, Artificial Sequence; identical to SEQ ID NO: 149372
  Description of Artificial Sequence: Synthetic coding sequence

SEQ ID NO: 149486 - DNA, 1053 bp, Artificial Sequence; identical to SEQ ID NO: 149362
  Description of Artificial Sequence: Synthetic coding sequence

SEQ ID NO: 149487 - DNA, 732 bp, Artificial Sequence; identical to SEQ ID NO: 149454
  Description of Artificial Sequence: Synthetic coding sequence

SEQ ID NO: 149488 - DNA, 420 bp, Artificial Sequence; identical to SEQ ID NO: 149443
  Description of Artificial Sequence: Synthetic coding sequence

SEQ ID NO: 149489 - DNA, 1053 bp, Artificial Sequence; identical to SEQ ID NO: 149362
  Description of Artificial Sequence: Synthetic coding sequence

SEQ ID NO: 149490 - DNA, 972 bp, Artificial Sequence; identical to SEQ ID NO: 149472
  Description of Artificial Sequence: Synthetic coding sequence

SEQ ID NO: 149491 - DNA, 1053 bp, Artificial Sequence; identical to SEQ ID NO: 149362
  Description of Artificial Sequence: Synthetic coding sequence

SEQ ID NO: 149492 - DNA, 420 bp, Artificial Sequence; identical to SEQ ID NO: 149443
  Description of Artificial Sequence: Synthetic coding sequence

SEQ ID NO: 149493 - DNA, 1332 bp, Artificial Sequence; identical to SEQ ID NO: 149372
  Description of Artificial Sequence: Synthetic coding sequence

SEQ ID NO: 149494 - DNA, 972 bp, Artificial Sequence; identical to SEQ ID NO: 149472
  Description of Artificial Sequence: Synthetic coding sequence

SEQ ID NO: 149495 - DNA, 972 bp, Artificial Sequence; identical to SEQ ID NO: 149472
  Description of Artificial Sequence: Synthetic coding sequence

SEQ ID NO: 149496 - DNA, 1053 bp, Artificial Sequence; identical to SEQ ID NO: 149362
  Description of Artificial Sequence: Synthetic coding sequence

SEQ ID NO: 149497 - DNA, 420 bp, Artificial Sequence; identical to SEQ ID NO: 149443
  Description of Artificial Sequence: Synthetic coding sequence

SEQ ID NO: 149498 - DNA, 1053 bp, Artificial Sequence; identical to SEQ ID NO: 149362
  Description of Artificial Sequence: Synthetic coding sequence

SEQ ID NO: 149499 - DNA, 420 bp, Artificial Sequence; identical to SEQ ID NO: 149443
  Description of Artificial Sequence: Synthetic coding sequence

SEQ ID NO: 149500 - DNA, 1332 bp, Artificial Sequence; identical to SEQ ID NO: 149372
  Description of Artificial Sequence: Synthetic coding sequence

SEQ ID NO: 149501 - DNA, 552 bp, Artificial Sequence
  Description of Artificial Sequence: Synthetic coding sequence
atggagatctttgtggatgatgagaccaagctgaccctgcacggcctgcagcagtactacgtgaagctgaaggacaatgagaagaacaggaagctgtttgacctgctggatgtgctggagttcaaccaggtggtgatctttgtgaagtctgtgcagcgctgcatcgccctggcccagctgctggtggagcagaacttccctgccatcgccatccaccggggcatgccccaggaggagcgctggctgagccgctaccagcagttcaaggacttccagaggcgcatcctggtggccaccaacctgtttggccggggcatggacatcgagcgggtgaacatcgccttcaactatgacatgccagaagattctgacacctacctgcaccgggtggcccgggccggccgcttcggcaccaagggcctggccatcacctttgtgtctgatgaaaatgatgccaagatcctgaatgatgtgcaggacagatttgaggtgaacatcagcgagctgcctgatgaaattgacatcagcagctacatcgagcagaccaggtag

SEQ ID NO: 149502 - DNA, 2073 bp, Artificial Sequence
  Description of Artificial Sequence: Synthetic coding sequence
atgggagatgaggactgggaggccgagatcaacccccacatgagcagctatgtgcccatctttgagaaggaccgctacagcggagaaaatggagacaacttcaacagaacaccagccagcagcagcgagatggatgatggccccagccggcgggaccacttcatgaagagcggctttgccagcggcaggaactttggaaacagagatgctggggagtgcaacaagagggacaacaccagcaccatgggcggctttggagtgggcaagagctttggaaacagaggcttcagcaacagcagatttgaagatggagacagcagcggcttctggagggagagcagcaatgactgtgaggacaaccccaccaggaacagaggcttcagcaagagaggagacaatgacctggaccctgatgagtgcatgcagaggactggaggcctgtttggcagcagaagacctgtgctgagcggcactggaaatggagacaccagccagagccgcagcggcagcggcagcgagcggggcggctacaagggcctgaatgaggaggtgatcaccggcagcggcaagaacagctggaagtctgaggccgagggcggggagagcagtgacacccagggccccaaggtgacctacatccccccacctcctccagaagatgaagattccatctttgcccactaccagacaggcatcaactttgacaagtatgacaccatcctggtggaggtgtctggccatgatgcccccccagccatcctgacctttgaggaggccaacctgtgccagaccctgaacaacaacatcgccaaggccggctacaccaagctgacccctgtgcagaagtacagcatccccatcatcctggccggccgggacctgatggcctgtgcccagacaggcagcggcaagacagctgccttcctgctgcccatcctggcccacatgatgcatgatggcatcacagccagccgcttcaaggagctgcaggagcctgagtgcatcatcgtggcccccacccgggagctggtgaaccagatctacctggaggccaggaagttctcctttggcacctgtgtgcgggctgtggtgatctacggcggcacccagctgggccacagcatccggcagatcgtgcagggctgcaacatcctgtgtgccaccccaggccgcctgatggacatcatcggcaaggagaagattggcctgaagcagatcaagtacctggtgctggatgaggccgacaggatgctggacatgggcttcggccctgagatgaagaagctgatcagctgccccggcatgcccagcaaggagcagaggcagaccctgatgttttctgccaccttccctgaggagatccagaggctggccgctgagttcctgaagagcaactacctgtttgtggccgtgggccaggtgggcggggcctgcagagatgtgcagcagacagtgctgcaggtgggccagttcagcaagcgggagaagctggtggagatcctgaggaacattggagatgagaggaccatggtgtttgtggagaccaagaagaaggctgacttcatcgccaccttcctgtgccaggagaagatcagcaccaccagcatccatggagaccgggagcagcgggagcgggagcaggccctgggggacttccgctttgggaagtgccctgtgctggtggccacctctgtggccgcccggggcctggacattgaaaatgtgcagcacgtgatcaactttgacctgcccagcaccattgatgaatatgtgcaccgcatcggccgcacaggccgctgtggcaacacaggccgggccatctccttctttgacctggagagtgacaaccacctggcccagcccctggtgaaggtgctgacagatgcccagcaggatgtgcctgcctggctggaggagatcgccttcagcacctacatccctggcttcagcggcagcaccagaggaaatgtgtttgcctctgtggacaccaggaagggcaagagcaccctgaacacagctggcttcagcagcagccaggcccccaaccctgtggatgatgagagctgggactag

SEQ ID NO: 149503 - DNA, 2073 bp, Artificial Sequence; identical to SEQ ID NO: 149502
  Description of Artificial Sequence: Synthetic coding sequence

SEQ ID NO: 149504 - DNA, 2175 bp, Artificial Sequence
  Description of Artificial Sequence: Synthetic coding sequence
atgggagatgaggactgggaggccgagatcaacccccacatgagcagctatgtgcccatctttgagaaggaccgctacagcggagaaaatggagacaacttcaacagaacaccagccagcagcagcgagatggatgatggccccagccggcgggaccacttcatgaagagcggctttgccagcggcaggaactttggaaacagagatgctggggagtgcaacaagagggacaacaccagcaccatgggcggctttggagtgggcaagagctttggaaacagaggcttcagcaacagcagatttgaagatggagacagcagcggcttctggagggagagcagcaatgactgtgaggacaaccccaccaggaacagaggcttcagcaagagaggaggctacagagatggcaacaacagcgaggccagcggcccctaccgccggggcggccggggcagcttccggggctgccggggcggcttcggcctgggcagccccaacaatgacctggaccctgatgagtgcatgcagaggactggaggcctgtttggcagcagaagacctgtgctgagcggcactggaaatggagacaccagccagagccgcagcggcagcggcagcgagcggggcggctacaagggcctgaatgaggaggtgatcaccggcagcggcaagaacagctggaagtctgaggccgagggcggggagagcagtgacacccagggccccaaggtgacctacatccccccacctcctccagaagatgaagattccatctttgcccactaccagacaggcatcaactttgacaagtatgacaccatcctggtggaggtgtctggccatgatgcccccccagccatcctgacctttgaggaggccaacctgtgccagaccctgaacaacaacatcgccaaggccggctacaccaagctgacccctgtgcagaagtacagcatccccatcatcctggccggccgggacctgatggcctgtgcccagacaggcagcggcaagacagctgccttcctgctgcccatcctggcccacatgatgcatgatggcatcacagccagccgcttcaaggagctgcaggagcctgagtgcatcatcgtggcccccacccgggagctggtgaaccagatctacctggaggccaggaagttctcctttggcacctgtgtgcgggctgtggtgatctacggcggcacccagctgggccacagcatccggcagatcgtgcagggctgcaacatcctgtgtgccaccccaggccgcctgatggacatcatcggcaaggagaagattggcctgaagcagatcaagtacctggtgctggatgaggccgacaggatgctggacatgggcttcggccctgagatgaagaagctgatcagctgccccggcatgcccagcaaggagcagaggcagaccctgatgttttctgccaccttccctgaggagatccagaggctggccgctgagttcctgaagagcaactacctgtttgtggccgtgggccaggtgggcggggcctgcagagatgtgcagcagacagtgctgcaggtgggccagttcagcaagcgggagaagctggtggagatcctgaggaacattggagatgagaggaccatggtgtttgtggagaccaagaagaaggctgacttcatcgccaccttcctgtgccaggagaagatcagcaccaccagcatccatggagaccgggagcagcgggagcgggagcaggccctgggggacttccgctttgggaagtgccctgtgctggtggccacctctgtggccgcccggggcctggacattgaaaatgtgcagcacgtgatcaactttgacctgcccagcaccattgatgaatatgtgcaccgcatcggccgcacaggccgctgtggcaacacaggccgggccatctccttctttgacctggagagtgacaaccacctggcccagcccctggtgaaggtgctgacagatgcccagcaggatgtgcctgcctggctggaggagatcgccttcagcacctacatccctggcttcagcggcagcaccagaggaaatgtgtttgcctctgtggacaccaggaagggcaagagcaccctgaacacagctggcttcagcagcagccaggcccccaaccctgtggatgatgagagctgggactag

SEQ ID NO: 149505 - DNA, 318 bp, Artificial Sequence
  Description of Artificial Sequence: Synthetic coding sequence
atgggagatgaggactgggaggccgagatcaacccccacatgagcagctatgtgcccatctttgagaaggaccgctacagcggagaaaatggagacaacttcaacagaacaccagccagcagcagcgagatggatgatggccccagccggcgggaccacttcatgaagagcggctttgccagcggcaggaactttggaaacagagatgctggggagtgcaacaagagggacaacaccagcaccatgggcggctttggagtgggcaagagctttggaaacagaggcttcagcaacagcagatttgaagatggagactag

SEQ ID NO: 149506 - DNA, 2115 bp, Artificial Sequence
  Description of Artificial Sequence: Synthetic coding sequence
atgggagatgaggactgggaggccgagatcaacccccacatgagcagctatgtgcccatctttgagaaggaccgctacagcggagaaaatggagacaacttcaacagaacaccagccagcagcagcgagatggatgatggccccagccggcgggaccacttcatgaagagcggctttgccagcggcaggaactttggaaacagagatgctggggagtgcaacaagagggacaacaccagcaccatgggcggctttggagtgggcaagagctttggaaacagaggcttcagcaacagcagatttgaagatggagacagcagcggcttctggaggggctacagagatggcaacaacagcgaggccagcggcccctaccgccggggcggccggggcagcttccggggctgccggggcggcttcggcctgggcagccccaacaatgacctggaccctgatgagtgcatgcagaggactggaggcctgtttggcagcagaagacctgtgctgagcggcactggaaatggagacaccagccagagccgcagcggcagcggcagcgagcggggcggctacaagggcctgaatgaggaggtgatcaccggcagcggcaagaacagctggaagtctgaggccgagggcggggagagcagtgacacccagggccccaaggtgacctacatccccccacctcctccagaagatgaagattccatctttgcccactaccagacaggcatcaactttgacaagtatgacaccatcctggtggaggtgtctggccatgatgcccccccagccatcctgacctttgaggaggccaacctgtgccagaccctgaacaacaacatcgccaaggccggctacaccaagctgacccctgtgcagaagtacagcatccccatcatcctggccggccgggacctgatggcctgtgcccagacaggcagcggcaagacagctgccttcctgctgcccatcctggcccacatgatgcatgatggcatcacagccagccgcttcaaggagctgcaggagcctgagtgcatcatcgtggcccccacccgggagctggtgaaccagatctacctggaggccaggaagttctcctttggcacctgtgtgcgggctgtggtgatctacggcggcacccagctgggccacagcatccggcagatcgtgcagggctgcaacatcctgtgtgccaccccaggccgcctgatggacatcatcggcaaggagaagattggcctgaagcagatcaagtacctggtgctggatgaggccgacaggatgctggacatgggcttcggccctgagatgaagaagctgatcagctgccccggcatgcccagcaaggagcagaggcagaccctgatgttttctgccaccttccctgaggagatccagaggctggccgctgagttcctgaagagcaactacctgtttgtggccgtgggccaggtgggcggggcctgcagagatgtgcagcagacagtgctgcaggtgggccagttcagcaagcgggagaagctggtggagatcctgaggaacattggagatgagaggaccatggtgtttgtggagaccaagaagaaggctgacttcatcgccaccttcctgtgccaggagaagatcagcaccaccagcatccatggagaccgggagcagcgggagcgggagcaggccctgggggacttccgctttgggaagtgccctgtgctggtggccacctctgtggccgcccggggcctggacattgaaaatgtgcagcacgtgatcaactttgacctgcccagcaccattgatgaatatgtgcaccgcatcggccgcacaggccgctgtggcaacacaggccgggccatctccttctttgacctggagagtgacaaccacctggcccagcccctggtgaaggtgctgacagatgcccagcaggatgtgcctgcctggctggaggagatcgccttcagcacctacatccctggcttcagcggcagcaccagaggaaatgtgtttgcctctgtggacaccaggaagggcaagagcaccctgaacacagctggcttcagcagcagccaggcccccaaccctgtggatgatgagagctgggactag

SEQ ID NO: 149507 - DNA, 480 bp, Artificial Sequence
  Description of Artificial Sequence: Synthetic coding sequence
atgggagatgaggactgggaggccgagatcaacccccacatgagcagctatgtgcccatctttgagaaggaccgctacagcggagaaaatggagacaacttcaacagaacaccagccagcagcagcgagatggatgatggccccagccggcgggaccacttcatgaagagcggctttgccagcggcaggaactttggaaacagagatgctggggagtgcaacaagagggacaacaccagcaccatgggcggctttggagtgggcaagagctttggaaacagaggcttcagcaacagcagatttgaagatggagacagcagcggcttctggagggagagcagcaatgactgtgaggacaaccccaccaggaacagaggcttcagcaagagaggaggctacagagatggcaacaacagcgaggccagcggcccctaccgccggggcggccggggcagcttccggggctgccggggcggctag

SEQ ID NO: 149508 - DNA, 1728 bp, Artificial Sequence
  Description of Artificial Sequence: Synthetic coding sequence
atgggcagcaggaacctcttcctgaccaacagccctgagagcagcaatgactgtgaggacaaccccaccaggaacagaggcttcagcaagagaggagacaatgacctggaccctgatgagtgcatgcagaggactggaggcctgtttggcagccggcggcctgtgctgtctggaactggaaatggagacaccagccagagccgcagcggcagcggcagcgagcgggacagctggaagtctgaggccgagggcggggagagcagtgacacccagggccccaaggtgacctacatccccccacctcctccagaagatgaggacagcatctttgcccactaccagacaggcatcaactttgacaagtatgacaccatcctggtggaggtgtctggccatgatgcccccccagccatcctgacctttgaggaggccaacctgtgccagaccctgaacaacaacatcgccaaggccggctacaccaagctgacccctgtgcagaagtacagcatccccatcatcctggccggccgggacctgatggcctgtgcccagacaggcagcggcaagacagctgccttcctgctgcccatcctggcccacatgatgcatgatggcatcacagccagccgcttcaaggagctgcaggagcctgagtgcatcatcgtggcccccacccgggagctggtgaaccagatctacctggaggccaggaagttctcctttggcacctgtgtgcgggctgtggtgatctatggaggcacccagctgggccacagcatccggcagatcgtgcagggctgcaacatcctgtgtgccaccccaggccgcctgatggacatcatcggcaaggagaagattggcctgaagcagatcaagtacctggtgctggatgaagctgacaggatgctggacatgggctttggacctgagatgaagaagctgatcagctgccccggcatgcccagcaaggagcagaggcagaccctgatgttcagcgccaccttccctgaggagatccagaggctggccgctgagttcctgaagagcaactacctgtttgtggccgtgggccaggtgggcggggcctgcagagatgtgcagcagacagtgctgcaggtgggccagttcagcaagcgggagaagctggtggagatcctgagaaatattggagatgagaggaccatggtgtttgtggagaccaagaagaaggctgacttcatcgccaccttcctgtgccaggagaagatcagcaccaccagcatccacggggaccgggagcagcgggagcgggagcaggccctgggggacttccgctttggaaaatgtcctgtgctggtggccacctctgtggccgcccggggcctggacattgaaaatgtgcagcacgtgatcaactttgacctgcccagcaccattgatgaatatgtgcacagaattggaagaacaggccgctgtggcaacacaggccgggccatctccttctttgacctggagagtgacaaccacctggcccagcccctggtgaaggtgctgacagatgcccagcaggatgtgcctgcctggctggaggagatcgccttcagcacctacatccctggcttcagcggcagcaccagaggaaatgtgtttgcctctgtggacaccaggaagggcaagagcaccctgaacacagctggcttcagcagcagccaggcccccaaccctgtggatgatgagagctgggactag

SEQ ID NO: 149509 - DNA, 1869 bp, Artificial Sequence
  Description of Artificial Sequence: Synthetic coding sequence
atggaggagagcgagcctgagaggaagagggccaggacagatgaggtgcctgctgggggcagccgctctgaggccgaggatgaagatgatgaagattatgtgccctacgtgcccctgcggcagaggcggcagctgctgctgcagaagctgctgcagaggaggaggaaaggagctgctgaggaggagcagcaggacagcggcagcgagcccagaggagatgaagatgacatccccctgggcccccagagcaatgtgtccctgctggaccagcaccagcacctgaaggagaaggccgaggccaggaaggagagcgccaaggagaagcagctgaaggaggaggagaagatcctggagagcgtggccgagggccgggccctgatgtctgtgaaggagatggccaagggcatcacctatgatgaccccatcaagacctcctggaccccacccaggtatgtgctgtccatgtctgaggagagacatgagcgggtgaggaagaagtaccacatcctggtggagggagatggcatccccccacccatcaagagcttcaaggagatgaagtttcctgctgccatcctgcggggcctgaagaagaagggcatccaccaccccacccccatccagatccagggcatccccaccatcctgagcggccgggacatgattggcatcgccttcaccggcagcggcaagaccctggtgttcaccctgcccgtcatcatgttctgcctggagcaggagaagaggctgcccttcagcaagcgggagggcccctacggcctcatcatctgccccagccgggagctggcccggcagacccacggcatcctggagtactactgccgcctgctgcaggaggacagcagccccctgctgcgctgtgccctgtgcatcggcggcatgtctgtgaaggagcagatggagaccatcagacatggagtgcacatgatggtggccaccccaggccgcctgatggacctgctgcagaagaagatggtgtccctggacatctgccgctacctggccctggatgaggccgacaggatgattgacatgggctttgaaggagacatccgcaccatcttctcctacttcaagggccagaggcagaccctgctcttcagcgccaccatgcccaagaagatccagaactttgccaagagcgccctggtgaagcctgtgaccatcaacgtgggccgggccggggccgccagcctggatgtgatccaggaggtggagtatgtgaaggaggaggccaagatggtgtacctgctggagtgcctgcagaagaccccacctcctgtgctgatctttgctgagaagaaggcagatgtggatgccatccacgagtacctgctgctgaagggcgtggaggccgtggccatccatggaggcaaggaccaggaggagaggaccaaggccatcgaggccttccgggagggcaagaaggatgtgctggtggccacagatgtggccagcaagggcctggacttccctgccatccagcacgtgatcaactatgacatgcctgaggagattgagaactacgtgcaccgcatcggccgcacaggccgcagcggcaacacaggaattgccaccaccttcatcaacaaggcctgtgatgaatctgtgctgatggacctgaaggccctgctgctggaggccaagcagaaggtgccccctgtgctgcaggtgctgcactgtggagatgagagcatgctggacatcggcggggagcggggctgtgccttctgtggcggcctgggccaccgcatcacagactgccccaagctggaggccatgcagaccaagcaggtgagcaacattggaaggaaggactacctggcccacagctccatggacttctag

SEQ ID NO: 149510 - DNA, 1881 bp, Artificial Sequence
  Description of Artificial Sequence: Synthetic coding sequence
atgcaccagatcaggaagtctgagtacacccagcccacccccatccagtgccagggcgtgcctgtggccctgagcggccgggacatgattggcatcgccaagacaggcagcggcaagacagctgccttcatctggcccatgctgatccacatcatggaccagaaggagctggagcctggagatggccccatcgctgtgattgtgtgccccacccgggagctgtgccagcagatccacgccgagtgcaagagatttgggaaggcctacaacctgcggtctgtggccgtgtatggaggcggctccatgtgggagcaggccaaggccctgcaggagggcgctgagatcgtggtgtgcaccccaggccgcctgattgaccacgtgaagaagaaggccaccaacctgcagagggtgtcctacctggtgtttgatgaagctgacaggatgtttgacatgggctttgagtaccaggtgcgcagcatcgccagccacgtgcggccagaccggcagaccctgctcttcagcgccaccttcaggaagaagattgagaagctggcccgggacatcctgattgaccccatccgggtggtgcagggcgacatcggggaggccaatgaagatgtgacccagatcgtggagatcctgcacagcggccccagcaagtggaactggctgacccggcggctggtggagttcaccagcagcggctctgtgctgctgtttgtgaccaagaaggccaatgctgaggagctggccaacaacctgaagcaggagggccacaacctgggcctgctgcatggagacatggaccagagcgagaggaacaaggtgatcagtgacttcaagaagaaggacatccctgtgctggtggccacagatgtggccgcccggggcctggacatccccagcatcaagacagtcatcaactatgatgtggcccgggacatcgacaccctgctgacccccaaggacagcaactttgctggggacctggtgaggaacctggagggcgccaaccagcacgtgtccaaggagctgctggacctggccatgcagaatgcctggttcaggaagagccgcttcaagggcggcaagggcaagaagctgaacatcggcggcggcggcctgggctaccgggagaggcctggcctgggcagcgagaacatggaccggggcaacaacaacgtgatgagcaactatgaggcctacaagcccagcactggagccatgggagaccggctgacagccatgaaggccgccttccagagccagtacaagagccactttgtggccgccagcctgagcaaccagaaggccggcagcagcgctgctggggccagcggctggaccagcgctggcagcctgaacagcgtgcccaccaacagcgcccagcagggccacaacagcccagacagccctgtgaccagcgctgccaagggcatccctggctttggaaacacaggcaacatcagcggggcccctgtgacctaccccagcgctggggcccagggcgtgaacaacacagccagcggcaacaacagccgggagggcactggaggcagcaatggcaagcgggagcgctacacagaaaatagaggcagcagccgccacagccacggggagactggaaacagacacagcgacagccccaggcatggagatggcggcagacatggagatggctaccgccaccctgagagcagcagccgccacacagatggccaccgccacggggagaacagacatggaggcagcgctggccgccacggggagaacagaggagccaatgatggaagaaatggagagagcaggaaggaggccttcaaccgggagagcaagatggagcccccacccaagaggaagaagagccgctgggacagctag

SEQ ID NO: 149511 - DNA, 2817 bp, Artificial Sequence
  Description of Artificial Sequence: Synthetic coding sequence
atgaactggaacaagggcggccctggcaccaagaggggcttcggctttggaggctttgccatctctgctgggaagaaggaggagcccaagctgccccagcagagccacagcgcctttggagccaccagcagcagcagcggctttgggaagagcgccccaccccagctgcccagcttctacaagattggcagcaagagggccaactttgatgaggagaatgcctactttgaagatgaggaggaggacagcagcaatgtggacctgccctacatcccagctgagaacagccccacccggcagcagttccacagcaagcctgtggacagcgacagtgatgatgaccccctggaggccttcatggccgaggtggaggaccaggccgcccgggacatgaagaggctggaggagaaggacaaggagaggaagaatgtgaagggcatcagagatgacatcgaggaggaggatgaccaggaggcctacttccgctacatggccgagaaccccacagctggggtggtgcaggaggaggaggaggacaacctggagtatgacagtgatggcaaccccatcgcccccaccaagaagatcatcgaccccctgccccccatcgaccacagcgagattgactaccccccatttgagaagaacttctacaatgaacatgaggagatcaccaacctgaccccccagcagctgattgacctgcggcacaagctgaacctgcgggtgtctggggccgccccacccaggcctggcagcagctttgcccacttcggctttgatgagcagctgatgcaccagatcaggaagtctgagtacacccagcccacccccatccagtgccagggcgtgcctgtggccctgagcggccgggacatgattggcatcgccaagacaggcagcggcaagacagctgccttcatctggcccatgctgatccacatcatggaccagaaggagctggagcctggagatggccccatcgctgtgattgtgtgccccacccgggagctgtgccagcagatccacgccgagtgcaagagatttgggaaggcctacaacctgcggtctgtggccgtgtatggaggcggctccatgtgggagcaggccaaggccctgcaggagggcgctgagatcgtggtgtgcaccccaggccgcctgattgaccacgtgaagaagaaggccaccaacctgcagagggtgtcctacctggtgtttgatgaagctgacaggatgtttgacatgggctttgagtaccaggtgcgcagcatcgccagccacgtgcggccagaccggcagaccctgctcttcagcgccaccttcaggaagaagattgagaagctggcccgggacatcctgattgaccccatccgggtggtgcagggcgacatcggggaggccaatgaagatgtgacccagatcgtggagatcctgcacagcggccccagcaagtggaactggctgacccggcggctggtggagttcaccagcagcggctctgtgctgctgtttgtgaccaagaaggccaatgctgaggagctggccaacaacctgaagcaggagggccacaacctgggcctgctgcatggagacatggaccagagcgagaggaacaaggtgatcagtgacttcaagaagaaggacatccctgtgctggtggccacagatgtggccgcccggggcctggacatccccagcatcaagacagtcatcaactatgatgtggcccgggacatcgacacccacacccaccgcatcggccgcacaggccgggccggggagaagggcgtggcctacaccctgctgacccccaaggacagcaactttgctggggacctggtgaggaacctggagggcgccaaccagcacgtgtccaaggagctgctggacctggccatgcagaatgcctggttcaggaagagccgcttcaagggcggcaagggcaagaagctgaacattggaggcggcggcctgggctaccgggagcggcccggcctgggcagcgagaacatggaccggggcaacaacaacgtgatgagcaactatgaggcctacaagcccagcactggagccatgggagaccggctgacagccatgaaggccgccttccagagccagtacaagagccactttgtggccgccagcctgagcaaccagaaggccggcagcagcgctgctggggccagcggctggaccagcgctggcagcctgaacagcgtgcccaccaacagcgcccagcagggccacaacagcccagacagccctgtgaccagcgctgccaagggcatccctggcttcggcaacacaggcaacatcagcggggcccctgtgacctaccccagcgctggggcccagggcgtgaacaacacagccagcggcaacaacagccgggagggcaccggcggcagcaatggcaagcgggagcgctacacagagaacagaggcagcagccgccacagccatggagagaccggcaacagacacagcgacagccccaggcatggagatggcggcagacatggagatggctaccgccaccctgagagcagcagccgccacacagatggccacagacatggagaaaatagacatggaggcagcgctggaagacatggagaaaatagaggagccaatgatggaagaaatggagagagcaggaaggaggccttcaaccgggagagcaagatggagcccaagatggagcccaaggtggacagcagcaagatggacaaggtggacagcaagacagacaagacagcagatggctttgctgtgcctgagccccccaagaggaagaagagccgctgggacagctag

SEQ ID NO: 149512 - DNA, 2817 bp, Artificial Sequence; identical to SEQ ID NO: 149511
  Description of Artificial Sequence: Synthetic coding sequence

SEQ ID NO: 149513 - DNA, 2817 bp, Artificial Sequence; identical to SEQ ID NO: 149511
  Description of Artificial Sequence: Synthetic coding sequence

SEQ ID NO: 149514 - DNA, 2817 bp, Artificial Sequence; identical to SEQ ID NO: 149511
  Description of Artificial Sequence: Synthetic coding sequence

SEQ ID NO: 149515 - DNA, 1947 bp, Artificial Sequence
  Description of Artificial Sequence: Synthetic coding sequence
atgagccaccacggcggggcccccaaggccagcacctgggtggtggccagccgccgcagcagcacagtgtcccgggcccctgagaggaggcctgctgaggagctgaacagaacaggccctgagggctacagcgtgggccggggcggccgctggaggggcaccagcaggcctcctgaggccgtggccgccggccacgaggagctgcccctgtgctttgccctgaagagccactttgtgggcgctgtgattggccggggcggcagcaagatcaagaacatccagagcaccaccaacaccaccatccagatcatccaggagcagcctgagagcctggtgaagatcttcggcagcaaggccatgcagaccaaggccaaggccgtcatcgacaactttgtgaagaagctggaggagaactacaacagtgaatgtggcatcgacacagccttccagcccagcgtgggcaaggatggcagcacagacaacaacgtggtggccggggaccggcccctgattgactgggaccagatccgggaggagggcctgaagtggcagaagaccaagtgggccgacctgccccccatcaagaagaacttctacaaggagagcacagccaccagcgccatgagcaaggtggaggccgacagctggaggaaagaaaacttcaacatcacctgggatgacctgaaggatggagagaagaggcccatccccaaccccacctgcacctttgatgatgccttccagtgctacccagaggtgatggagaacatcaagaaggccggcttccagaagcccacccccatccagagccaggcctggcccatcgtgctgcagggcatcgacctgattggagtggcccagacaggcaccgggaagaccctgtgctacctgatgcctggcttcatccacctggtgctgcagcccagcctgaagggccagaggaacagacctggcatgctggtgctgacccccacccgggagctggccctgcaggtggagggggagtgctgcaagtacagctacaagggcctgcggtctgtgtgtgtgtatggaggcggcaacagagatgagcagatcgaggagctgaagaagggcgtggacatcatcatcgccaccccaggccgcctgaatgacctgcagatgagcaactttgtgaacctgaagaacatcacctacctggtgctggatgaggccgacaagatgctggacatgggctttgagccccagatcatgaagatcctgctggatgtgcggccagaccggcagacagtgatgaccagcgccacctggccccacagcgtgcaccggctggcccagagctacctgaaggagcccatgattgtgtatgtgggcaccctggacctggtggccgtgtcctctgtgaagcagaacatcatcgtgaccacagaggaggagaagtggagccacatgcagaccttcctgcagagcatgagcagcacagacaaggtgattgtgtttgtgtccaggaaggctgtggccgaccacctgagcagtgacctgatcctgggcaacatctctgtggagagcctgcacggggaccgggagcagagggaccgggagaaggccctggagaacttcaagacaggcaaggtgcgcatcctgattgccacagacctggccagccggggcctggatgtgcatgatgtgacccacgtgtacaactttgacttccccaggaacatcgaggagtatgtgcacagaattggaagaacaggccgggccggccgcactggagtgtccatcaccaccctgaccagaaatgactggagggtggccagcgagctgatcaacatcctggagcgggccaaccagagcatccctgaggagctggtgtccatggccgagcgcttcaaggcccaccagcagaagcgggagatggagaggaagatggagcggccccagggccggcccaagaagttccactag

SEQ ID NO: 149516 - DNA, 588 bp, Artificial Sequence
  Description of Artificial Sequence: Synthetic coding sequence
atgagccaccacggcggggcccccaaggccagcacctgggtggtggccagccgccgcagcagcacagtgtcccgggcccctgagaggaggcctgctgaggagctgaacagaacaggccctgagggctacagcgtgggccggggcggccgctggaggggcaccagcaggcctcctgaggccgtggccgccggccacgaggagctgcccctgtgctttgccctgaagagccactttgtgggcgctgtgattggccggggcggcagcaagatcaagaacatccagagcaccaccaacaccaccatccagatcatccaggagcagcctgagagcctggtgaagatcttcggcagcaaggccatgcagaccaaggccaaggccgtcatcgacaactttgtgaagaagctggaggagaactacaacagtgaatgtggcatcgacacagccttccagcccagcgtgggcaaggatggcagcacagacaacaacgtggtggccggggaccggcccctgattgactgggaccagatccgggaggagggcctgaagtggcagaagaccaagtgggccggcaagaagatcctgatctag

SEQ ID NO: 149517 - DNA, 675 bp, Artificial Sequence
  Description of Artificial Sequence: Synthetic coding sequence
atggagagcggggcctacggggccgccaaggccggcggcagctttgacctgcggcgcttcctgacccagccccaggtggtggcccgggctgtgtgcctggtgtttgccctgattgtgttcagctgcatctacggggagggctacagcaatgcccacgagagcaagcagatgtactgtgtgttcaacagaaatgaagatgcctgccgctatggcagcgccatcggcgtgctggccttcctggccagcgccttcttcctggtggtggatgcctacttcccccagatcagcaatgccacagacaggaagtacctggtgattggagacctgctcttcagcgccctgtggaccttcctgtggtttgtgggcttctgcttcctgaccaaccagtgggccgtgaccaaccccaaggatgtgctggtgggcgctgacagcgtgcgggccgccatcaccttctccttcttcagcatcttctcctggggcgtgctggccagcctggcctaccagcgctacaaggccggcgtggatgacttcatccagaactacgtggaccccaccccagaccccaacacagcctatgccagctacccaggggcctctgtggacaactaccagcagccccccttcacccagaatgctgagaccacagagggctaccagcccccacctgtgtactag

SEQ ID NO: 149518 - DNA, 1635 bp, Artificial Sequence
  Description of Artificial Sequence: Synthetic coding sequence
atgagcggctacagcagtgaccgggaccggggccgggaccggggctttggagcccccaggtttggaggcagccgggccggccccctgagcggcaagaagtttggaaatcctggagagaagctggtgaagaagaagtggaacctggatgagctgcccaagtttgagaagaacttctaccaggagcacccagacctggccaggagaacagcccaggaggtggagacctaccgctacctgctgcctgccatcgtgcacatcaaccaccagcccttcctggagagaggagatggccccatctgcctggtgctggcccccacccgggagctggcccagcaggtgcagcaggtggccgctgagtactgccgggcctgccgcctgaagagcacctgcatctacggcggggcccccaagggcccccagatccgggacctggagcggggcgtggagatctgcatcgccaccccaggccgcctgattgacttcctggagtgtgggaagaccaacctgcggaggaccacctacctggtgctggatgaggccgacaggatgctggacatgggctttgagccccagatcaggaagatcgtggaccagatccggccagaccggcagaccctgatgtggagcgccacctggcccaaggaggtgcggcagctggccgaggacttcctgaaggactacatccacatcaacatcggggccctggagctgagcgccaaccacaacatcctgcagatcgtggatgtgtgccatgatgtggagaaggatgagaagctgatccggctgatggaggagatcatgtctgagaaggagaacaagaccatcgtgtttgtggagaccaagaggcgctgtgatgagctgaccaggaagatgagaagagatggctggccagccatgggcatccacggggacaagagccagcaggagcgggactgggtgctgaatgagttcaagcacggcaaggcccccatcctgattgccacagatgtggccagccggggcctggatgtggaggatgtgaagtttgtgatcaactatgactaccccaacagcagcgaggactacatccacagaattggaagaacagcccggagcaccaagacaggaacagcctacaccttcttcacccccaacaacatcaagcaggtgtctgacctgatctctgtgctgcgggaggccaaccaggccatcaaccccaagctgctgcagctggtggaggaccggggcagcggccgcagccggggccggggcggcatgaaggatgacagaagagaccgctacagcgctgggaagagaggaggcttcaacaccttccgggaccgggagaactatgaccggggctacagcagcctgctgaagagggactttggagccaagacccagaatggagtgtacagcgctgccaactacaccaacggcagctttggcagcaactttgtgtctgctggcatccagaccagcttcagaacaggcaaccccaccggcacctaccagaatggctatgacagcacccagcagtatggcagcaatgtgcccaacatgcacaacggcatgaaccagcaggcctatgcctacccagccacagctgctgcccccatgattggctaccccatgcccaccggctacagccagtag

SEQ ID NO: 149519 - DNA, 1845 bp, Artificial Sequence
  Description of Artificial Sequence: Synthetic coding sequence
atgagcggctacagcagtgaccgggaccggggccgggaccggggctttggagcccccaggtttggaggcagccgggccggccccctgagcggcaagaagtttggaaatcctggagagaagctggtgaagaagaagtggaacctggatgagctgcccaagtttgagaagaacttctaccaggagcacccagacctggccaggagaacagcccaggaggtggagacctacagaagaagcaaggagatcaccgtgcggggccacaactgccccaagcctgtgctgaacttctatgaggccaacttccctgccaacgtgatggatgtgattgcccggcagaacttcacagagcccacagccatccaggcccagggctggcctgtggccctgagcggcctggacatggtgggcgtggcccagacaggcagcggcaagaccctgagctacctgctgcctgccatcgtgcacatcaaccaccagcccttcctggagagaggagatggccccatctgcctggtgctggcccccacccgggagctggcccagcaggtgcagcaggtggccgctgagtactgccgggcctgccgcctgaagagcacctgcatctacggcggggcccccaagggcccccagatccgggacctggagcggggcgtggagatctgcatcgccaccccaggccgcctgattgacttcctggagtgtgggaagaccaacctgcggaggaccacctacctggtgctggatgaggccgacaggatgctggacatgggctttgagccccagatcaggaagatcgtggaccagatccggccagaccggcagaccctgatgtggagcgccacctggcccaaggaggtgcggcagctggccgaggacttcctgaaggactacatccacatcaacatcggggccctggagctgagcgccaaccacaacatcctgcagatcgtggatgtgtgccatgatgtggagaaggatgagaagctgatccggctgatggaggagatcatgtctgagaaggagaacaagaccatcgtgtttgtggagaccaagaggcgctgtgatgagctgaccaggaagatgagaagagatggctggccagccatgggcatccacggggacaagagccagcaggagcgggactgggtgctgaatgagttcaagcacggcaaggcccccatcctgattgccacagatgtggccagccggggcctggatgtggaggatgtgaagtttgtgatcaactatgactaccccaacagcagcgaggactacatccacagaattggaagaacagcccggagcaccaagacaggaacagcctacaccttcttcacccccaacaacatcaagcaggtgtctgacctgatctctgtgctgcgggaggccaaccaggccatcaaccccaagctgctgcagctggtggaggaccggggcagcggccgcagccggggccggggcggcatgaaggatgacagaagagaccgctacagcgctgggaagagaggaggcttcaacaccttccgggaccgggagaactatgaccggggctacagcagcctgctgaagagggactttggagccaagacccagaatggagtgtacagcgctgccaactacaccaacggcagctttggcagcaactttgtgtctgctggcatccagaccagcttcagaacaggcaaccccaccggcacctaccagaatggctatgacagcacccagcagtatggcagcaatgtgcccaacatgcacaacggcatgaaccagcaggcctatgcctacccagccacagctgctgcccccatgattggctaccccatgcccaccggctacagccagtag

SEQ ID NO: 149520 - DNA, 1800 bp, Artificial Sequence
  Description of Artificial Sequence: Synthetic coding sequence
atggatgtgcatgacctcttccggcggctgggcgctggggccaagtttgacacccggcgcttcagcgcagatgctgcccgcttccagatcggcaagaggaaatatgactttgacagcagcgaggtgctgcagggcctggacttctttggaaacaagaagtctgtgcctggggtgtgtggggccagccagacccaccagaagccccagaatggagagaagaaggaggagagcctgacagagaggaagcgggagcagagcaagaagaagaggaagaccatgaccagcgagatcgccagccaggaggagggcgccaccatccagtggatgagctctgtggaggccaagattgaggacaagaaggtgcagcgggagagcaagctgaccagcggcaagctggagaacctgaggaaggagaagatcaacttcctgaggaacaagcacaagatccacgtgcagggcacagacctgcctgaccccatcgccaccttccagcagctggaccaggagtacaagatcaacagccggctgctgcagaacatcctggatgctggcttccagatgcccacccccatccagatgcaggccatccctgtgatgctgcacggccgggagctgctggccagcgcccccactggaagtggcaagaccctggccttcagcatccccatcctgatgcagctgaagcagcctgccaacaagggcttccgggccctgatcatcagccccacccgggagctggccagccagatccaccgggagctgatcaagatcagcgagggcaccggcttccgcatccacatgatccacaaggctgctgtggccgccaagaagtttggccccaagagcagcaagaagtttgacatcctggtgaccacccccaacagactcatctacctgctgaagcaggaccccccaggcatcgacctggcctctgtggagtggctggtggtggatgaaagtgacaagctgtttgaagatggcaagacaggcttccgggaccagctggccagcatcttcctggcctgcaccagccacaaggtgcggcgggccatgttttctgccacctttgcctatgatgtggagcagtggtgcaagctgaacctggacaacgtcatctctgtgtccatcggggccagaaattctgctgtggagaccgtggagcaggagctgctgtttgtgggcagcgagaccgggaagctgctggccatgagggagctggtgaagaagggcttcaacccccctgtgctggtgtttgtgcagagcattgaaagagccaaggagctgttccacgagctgatctatgagggcatcaacgtggatgtgattcatgctgagaggacccagcagcagagggacaacacagtgcacagcttccgggccggcaagatctgggtgctgatctgcacagccctgctggcccggggcatcgacttcaagggcgtgaacctggtgatcaactatgacttccccaccagctctgtggagtacatccaccgcatcggccgcacaggccgggccggcaacaagggcaaggccatcaccttcttcacagaagatgacaagcccctgctgcggtctgtggccaacgtcatccagcaggccggctgccctgtgcctgagtacatcaagggcttccagaagctgctgagcaagcagaagaagaagatgatcaagaagcccctggagcgggagagcatcagcaccacccccaagtgcttcctggagaaggccaaggacaagcagaagaaggtgacaggccagaacagcaagaagaaggtggccctggaggacaagagctag

SEQ ID NO: 149521 - DNA, 1476 bp, Artificial Sequence
  Description of Artificial Sequence: Synthetic coding sequence
atgagctctgtggaggccaagattgaggacaagaaggtgcagcgggagagcaagctgaccagcggcaagctggagaacctgaggaaggagaagatcaacttcctgaggaacaagcacaagatccacgtgcagggcacagacctgcctgaccccatcgccaccttccagcagctggaccaggagtacaagatcaacagccggctgctgcagaacatcctggatgctggcttccagatgcccacccccatccagatgcaggccatccctgtgatgctgcacggccgggagctgctggccagcgcccccactggaagtggcaagaccctggccttcagcatccccatcctgatgcagctgaagcagcctgccaacaagggcttccgggccctgatcatcagccccacccgggagctggccagccagatccaccgggagctgatcaagatcagcgagggcaccggcttccgcatccacatgatccacaaggctgctgtggccgccaagaagtttggccccaagagcagcaagaagtttgacatcctggtgaccacccccaacagactcatctacctgctgaagcaggaccccccaggcatcgacctggcctctgtggagtggctggtggtggatgaaagtgacaagctgtttgaagatggcaagacaggcttccgggaccagctggccagcatcttcctggcctgcaccagccacaaggtgcggcgggccatgttttctgccacctttgcctatgatgtggagcagtggtgcaagctgaacctggacaacgtcatctctgtgtccatcggggccagaaattctgctgtggagaccgtggagcaggagctgctgtttgtgggcagcgagaccgggaagctgctggccatgagggagctggtgaagaagggcttcaacccccctgtgctggtgtttgtgcagagcattgaaagagccaaggagctgttccacgagctgatctatgagggcatcaacgtggatgtgattcatgctgagaggacccagcagcagagggacaacacagtgcacagcttccgggccggcaagatctgggtgctgatctgcacagccctgctggcccggggcatcgacttcaagggcgtgaacctggtgatcaactatgacttccccaccagctctgtggagtacatccaccgcatcggccgcacaggccgggccggcaacaagggcaaggccatcaccttcttcacagaagatgacaagcccctgctgcggtctgtggccaacgtcatccagcaggccggctgccctgtgcctgagtacatcaagggcttccagaagctgctgagcaagcagaagaagaagatgatcaagaagcccctggagcgggagagcatcagcaccacccccaagtgcttcctggagaaggccaaggacaagcagaagaaggtgacaggccagaacagcaagaagaaggtggccctggaggacaagagctag

SEQ ID NO: 149522 - DNA, 2646 bp, Artificial Sequence
  Description of Artificial Sequence: Synthetic coding sequence
atggctgctgacaagggccctgctgctggccccaggagcagagctgccatggcccagtggaggaagaagaagggcctgaggaagagaagaggagctgccagccaggcccggggcagtgacagtgaagatggagaatttgagatccaggctgaagatgatgcccgggccaggaagctgggccctggccggcccctgcccaccttccccaccagcgagtgcaccagtgatgtggagccagacacccgggagatggtgcgggcccagaacaagaagaagaagaagagcggcggcttccagagcatgggcctgagctaccctgtgttcaagggcatcatgaagaagggctacaaggtgcccacccccatccagaggaagaccatccctgtgatcctggatggcaaggatgtggtggccatggccaggacaggcagcggcaagacagcctgcttcctgctgcccatgtttgagcggctgaagacccacagcgcccagacaggagcccgggccctgatcctgagccccacccgggagctggccctgcagaccctgaagttcaccaaggagctgggcaagttcaccggcctgaagacagccctgatcctgggcggggacaggatggaggaccagtttgctgccctgcatgaaaatccagacatcatcatcgccaccccaggccgcctggtgcacgtggccgtggagatgagcctgaagctgcagagcgtggagtatgtggtgtttgatgaagctgaccggctgtttgagatgggctttgctgagcagctgcaggagatcatcgcccggctgcccggcggccaccagacagtgctcttcagcgccaccctgcccaagctgctggtggagtttgcccgggccggcctgacagagcctgtgctgatccggctggatgtggacaccaagctgaatgagcagctgaagaccagcttcttcctggtgcgggaggacaccaaggctgctgtgctgctgcacctgctgcacaacgtggtgcggccccaggaccagacagtggtgtttgtggccaccaagcaccacgccgagtacctgacagagctgctgaccacccagagggtgtcctgtgcccacatctacagcgccctggaccccacagccaggaagatcaacctggccaagttcaccctgggcaagtgcagcaccctgattgtgacagacctggccgcccggggcctggacatccccctgctggacaacgtcatcaactacagcttccctgccaagggcaagctgttcctgcaccgggtgggccgggtggcccgggccggccgctctggaacagcctacagcctggtggccccagatgagatcccctacctgctggacctgcacctgttcctgggccgcagcctgaccctggcccggcccctgaaggagcccagcggcgtggccggcgtggatggcatgctgggccgggtgccccagagcgtggtggatgaagaagattctggcctgcagagcaccctggaggccagcctggagctgcggggcctggcccgggtggccgacaatgcccagcagcagtatgtgcgcagcaggcctgcccccagccctgagagcatcaagagggccaaggagatggacctggtgggcctgggcctgcaccccctcttcagcagcagatttgaggaggaggagctgcagaggctgcggctggtggacagcatcaagaactaccgcagccgggccaccatctttgagatcaatgccagcagccgggacctgtgcagccaggtgatgagggccaagaggcagaaggacaggaaggccatcgcccgcttccagcagggccagcagggccggcaggagcagcaggagggccctgtgggccctgcccccagcaggcctgccctgcaggagaagcagcctgagaaggaggaggaggaggaggccggggagagcgtggaggacatcttcagcgaggtggtgggcaggaagaggcagaggagcggccccaacagaggagccaagagaagaagagaggaggcccggcagagggaccaggagttctacatcccctaccggcccaaggactttgattctgagcggggcctgagcatcagcggggagggcggggcctttgagcagcaggccgccggggctgtgctggacctgatgggagatgaggcccagaacctgacccggggccggcagcagctgaagtgggacaggaagaagaagagatttgtgggccagagcggccaggaggacaagaagaagatcaagacagaaagtggccgctacatcagcagcagctacaagagggacctgtaccagaagtggaagcagaagcagaagattgatgaccgggacagtgatgaggagggcgccagtgaccggcggggccctgagaggagaggaggcaagagggaccggggccagggcgccagccggccccacgcccctggcaccccagctggccgggtgcggcctgagctgaagaccaagcagcagatcctgaagcagaggcggcgggcccagaagctgcacttcctgcagagaggaggcctgaagcagctgagcgccaggaacagaagaagagtgcaggagctgcagcagggcgccttcggccgcggggcccggagcaagaagggcaagatgaggaagaggatgtag

SEQ ID NO: 149523 - DNA, 2649 bp, Artificial Sequence
  Description of Artificial Sequence: Synthetic coding sequence
atggctgctgacaagggccctgctgctggccccaggagcagagctgccatggcccagtggaggaagaagaagggcctgaggaagagaagaggagctgccagccaggcccggggcagtgacagtgaagatggagaatttgagatccaggctgaagatgatgcccgggccaggaagctgggccctggccggcccctgcccaccttccccaccagcgagtgcaccagtgatgtggagccagacacccgggagatggtgcgggcccagaacaagaagaagaagaagagcggcggcttccagagcatgggcctgagctaccctgtgttcaagggcatcatgaagaagggctacaaggtgcccacccccatccagaggaagaccatccctgtgatcctggatggcaaggatgtggtggccatggccaggacaggcagcggcaagacagcctgcttcctgctgcccatgtttgagcggctgaagacccacagcgcccagacaggagcccgggccctgatcctgagccccacccgggagctggccctgcagaccctgaagttcaccaaggagctgggcaagttcaccggcctgaagacagccctgatcctgggcggggacaggatggaggaccagtttgctgccctgcatgaaaatccagacatcatcatcgccaccccaggccgcctggtgcacgtggccgtggagatgagcctgaagctgcagagcgtggagtatgtggtgtttgatgaagctgaccggctgtttgagatgggctttgctgagcagctgcaggagatcatcgcccggctgcccggcggccaccagacagtgctcttcagcgccaccctgcccaagctgctggtggagtttgcccgggccggcctgacagagcctgtgctgatccggctggatgtggacaccaagctgaatgagcagctgaagaccagcttcttcctggtgcgggaggacaccaaggctgctgtgctgctgcacctgctgcacaacgtggtgcggccccaggaccagacagtggtgtttgtggccaccaagcaccacgccgagtacctgacagagctgctgaccacccagagggtgtcctgtgcccacatctacagcgccctggaccccacagccaggaagatcaacctggccaagttcaccctgggcaagtgcagcaccctgattgtgacagacctggccgcccggggcctggacatccccctgctggacaacgtcatcaactacagcttccctgccaagggcaagctgttcctgcaccgggtgggccgggtggcccgggccggccgctctggaacagcctacagcctggtggccccagatgagatcccctacctgctggacctgcacctgttcctgggccgcagcctgaccctggcccggcccctgaaggagcccagcggcgtggccggcgtggatggcatgctgggccgggtgccccagagcgtggtggatgaagaagattctggcctgcagagcaccctggaggccagcctggagctgcggggcctggcccgggtggccgacaatgcccagcagcagtatgtgcgcagcaggcctgcccccagccctgagagcatcaagagggccaaggagatggacctggtgggcctgggcctgcaccccctcttcagcagcagatttgaggaggaggagctgcagaggctgcggctggtggacagcatcaagaactaccgcagccgggccaccatctttgagatcaatgccagcagccgggacctgtgcagccaggtgatgagggccaagaggcagaaggacaggaaggccatcgcccgcttccagcagggccagcagggccggcaggagcagcaggagggccctgtgggccctgcccccagcaggcctgccctgcaggagaagcagcctgagaaggaggaggaggaggaggccggggagagcgtggaggacatcttcagcgaggtggtgggcaggaagaggcagaggagcggccccaacagaggagccaagagaagaagagaggaggcccggcagagggaccaggagttctacatcccctaccggcccaaggactttgattctgagcggggcctgagcatcagcggggagggcggggcctttgagcagcaggccgccggggctgtgctggacctgatgggagatgaggcccagaacctgacccggggccggcagcagctgaagtgggacaggaagaagaagagatttgtgggccagagcggccaggaggacaagaagaagatcaagacagaaagtggccgctacatcagcagcagctacaagagggacctgtaccagaagtggaagcagaagcagaagattgatgaccgggacagtgatgaggagggcgccagtgaccggcggggccctgagaggagaggaggcaagagggaccggggccaggccggggccagccggccccacgcccctggcaccccagctggccgggtgcggcctgagctgaagaccaagcagcagatcctgaagcagaggagaagagcccagaagctgcacttcctgcagaggggcggcctgaagcagctgagcgccaggaacagaagaagagtgcaggagctgcagcagggcgccttcggccgcggggcccggagcaagaagggcaagatgaggaagaggatgtag

SEQ ID NO: 149524 - DNA, 1452 bp, Artificial Sequence
  Description of Artificial Sequence: Synthetic coding sequence
atgagcacagccaggacagaaaatcctgtgatcatgggcctgagcagccagaatggccagctgcggggccctgtgaagcccaccggcggccctgggggcggcggcacccagacccagcagcagatgaaccagctgaagaacaccaacaccatcaacaacggcacccagcagcaggcccagagcatgaccaccaccatcaagccaggagatgactggaagaagaccctgaagctgccccccaaggacctgcgcatcaagaccagtgatgtgaccagcaccaagggaaatgaatttgaggactactgcctgaagcgggagctgctgatgggcatctttgagatgggctgggagaagcccagccccatccaggaggagagcatccccatcgccctgagcggccgggacatcctggcccgggccaagaatggcaccgggaagagcggggcctacctgatccccctgctggagcggctggacctgaagaaggacaacatccaggccatggtgattgtgcccacccgggagctggccctgcaggtgtcccagatctgcatccaggtgtccaagcacatgggcggggccaaggtgatggccaccaccggcggcaccaacctgagagatgacatcatgaggctggatgacacagtgcacgtggtgattgccaccccaggccgcatcctggacctgatcaagaagggcgtggccaaggtggaccacgtgcagatgattgtgctggatgaggccgacaagctgctgagccaggactttgtgcagatcatggaggacatcatcctgaccctgcccaagaaccggcagatcctgctgtacagcgccaccttccccctgtctgtgcagaagttcatgaacagccacctgcagaagccctatgagatcaacctgatggaggagctgaccctgaagggcgtgacccagtactatgcctacgtgacagagcggcagaaggtgcactgcctgaacaccctcttcagccggctgcagatcaaccagagcatcatcttctgcaacagcagccagagggtggagctgctggccaagaagatcagccagctgggctacagctgcttctacatccacgccaagatgaggcaggagcacaggaacagagtcttccatgacttcagaaatggcctgtgcaggaacctggtgtgcacagacctcttcacccggggcatcgacatccaggccgtgaatgtggtgatcaactttgacttccccaagctggccgagacctacctgcaccgcatcggccgcagcggccgcttcggccacctgggcctggccatcaacctgatcacctatgatgaccgcttcaacctgaagagcattgaggagcagctgggcacagagatcaagcccatccccagcaacatcgacaagagcctgtatgtggccgagtaccacagcgagcctgtggaggatgagaagccctag

SEQ ID NO: 149525 - DNA, 1452 bp, Artificial Sequence; identical to SEQ ID NO: 149524
  Description of Artificial Sequence: Synthetic coding sequence

SEQ ID NO: 149526 - DNA, 1452 bp, Artificial Sequence; identical to SEQ ID NO: 149524
  Description of Artificial Sequence: Synthetic coding sequence

SEQ ID NO: 149527 - DNA, 564 bp, Artificial Sequence
  Description of Artificial Sequence: Synthetic coding sequence
atgagcacagccaggacagaaaatcctgtgatcatgggcctgagcagccagaatggccagctgcggggccctgtgaagcccaccggcggccctgggggcggcggcacccagacccagcagcagatgaaccagctgaagaacaccaacaccatcaacaacggcacccagcagcaggcccagagcatgaccaccaccatcaagccaggagatgactggaagaagaccctgaagctgccccccaaggacctgcgcatcaagaccagtgatgtgaccagcaccaagggaaatgaatttgaggactactgcctgaagcgggagctgctgatgggcatctttgagatgggctgggagaagcccagccccatccaggaggagagcatccccatcgccctgagcggccgggacatcctggcccgggccaagaatggcaccgggaagagcggggcctacctgatccccctgctggagcggctggacctgaagaaggacaacatccaggccatggtgattgtgcccacccgggagctggccctgcaggtgtcccagatctgcaccgtgtgctag

SEQ ID NO: 149528 - DNA, 5139 bp, Artificial Sequence
  Description of Artificial Sequence: Synthetic coding sequence
atggagagaaatgtgctgaccaccttcagccaggagatgagccagctgatcctgaatgagatgcccaaggccgagtacagcagcctcttcaatgactttgtggagagcgagttcttcctgattgatggagacagcctgctgatcacctgcatctgtgagatctccttcaagccaggccagaacctgcacttcttctacctggtggagcgctacctggtggacctgatcagcaagggcggccagttcaccatcgtgttcttcaaggatgctgaatatgcctacttcaacttccctgagctgctgagcctgaggacagccctgatcctgcacctgcagaagaacaccaccattgatgtgaggaccaccttcagccgctgcctgagcaaggagtggggcagcttcctggaggagagctacccctacttcctgattgtggctgatgagggcctgaatgacctgcagacccagctgttcaacttcctgatcatccacagctgggccaggaaggtgaatgtggtgctgagcagcggccaggagagtgatgtgctgtgcctgtatgcctacctgctgcccagcatgtaccgccaccagatcttctcctggaagaacaagcagaacatcaaggatgcctacaccaccctgctgaaccagctggagcgcttcaagctgagcgccctggcccccctgtttggcagcctgaagtggaacaacatcacagaggaggcccacaagacagtgtccctgctgacccaggtgtggccagagggcagtgacatccggcgggtcttctgtgtgaccagctgcagcctgagcctgaggatgtaccaccgcttcctgggcaaccgggagcccagcagcggccaggagacagagatccagcaggtgaacagcaactgcctgaccctgcaggagatggaggacctgtgcaagctgcactgcctgactgtggtgttcctgctgcacctgcccctgagccagagggcctgtgcccgggtcatcaccagccactgggccgaggacatgaagcccctgctgcagatgaagaagtggtgtgagtacttcatcctgaggaacatccacacctttgagttctggaacctgaacctgatccacctgagtgacctgaatgatgagctgctgctgaagaacatcgccttctactatgaaaatgaaaatgtgaagggcctgcacctgaacctgggggacaccatcatgaaggactatgagtacctgtggaacacagtgtccaagctggtgcgggactttgaggtgggccagcccttccccctgcggaccaccaaggtgtgcttcctggagaagaagcccagccccatcaaggacagcagcaatgagatggtgcccaacctgggcttcatccccaccagcagctttgtggtggacaagtttgctggggacatcctgaaggacctgcccttcctgaagagtgatgaccccatcgtgaccagcctggtgaagcagaaggagtttgatgagctggtgcactggcacagccacaagcccctgagtgatgattatgacaggagccgctgccagtttgatgagaagagccgggacccccgggtgctgcggtctgtgcagaagtaccacgtgttccagcgcttctacggcaacagcctggagaccgtgagcagcaagatcatcgtgacccagaccatcaagagcaagaaggacttcagcggccccaagagcaagaaggcccacgagaccaaggccgagatcatcgcccgggagaacaagaagaggctgtttgcccgggaggagcagaaggaggagcagaagtggaatgccctgtccttcagcattgaggagcagctgaaggagaacctgcacagcggcatcaagagcctggaggacttcctgaagagctgcaagagcagctgtgtgaagctgcaggtggagatggtgggcctgacagcctgcctgaaggcctggaaggagcactgccgctctgaggagggcaagaccaccaaggacctgagcattgctgtgcaggtgatgaagaggatccacagcctgatggagaagtacagcgagctgctgcaggaggatgaccggcagctgattgcccgctgcctgaagtacctgggctttgatgagctggccagcagcctgcacccagcccaggatgctgaaaatgatgtgaaggtgaagaagaggaacaagtacagcgtgggcatcggccctgcccgcttccagctgcagtacatgggccactacctgatcagagatgagaggaaggaccctgacccccgggtgcaggacttcatcccagacacctggcagcgggagctgctggatgtggtggacaagaatgaatctgctgtgattgtggcccccaccagcagcggcaagacctacgccagctactactgcatggagaaggtgctgaaggagagtgatgatggagtggtggtgtatgtggcccccaccaaggccctggtgaaccaggtggccgccaccgtgcagaaccgcttcaccaagaacctgcccagcggggaggtgctgtgtggggtcttcacccgggagtacagacatgatgccctgaactgccaggtgctgatcaccgtgcctgcctgctttgagatcctgctgctggccccccaccggcagaactgggtgaagaagatccgctacgtgatctttgatgaggtgcactgcctgggcggggagatcggggctgagatctgggagcacctgctggtgatgatccgctgccccttcctggccctgagcgccaccatcagcaaccctgagcacctgacagagtggctgcagagcgtgaagtggtactggaagcaggaggacaagatcatcgagaacaacacagccagcaagagacatgtgggccggcaggccggcttccccaaggactacctgcaggtgaagcagagctacaaggtgcggctggtgctgtatggagagcgctacaatgacctggagaagcacgtgtgcagcatcaagcatggagacatccactttgaccacttccacccctgtgccgccctgaccacagaccacatcgagagatatggcttccccccagacctgaccctgagcccccgggagagcatccagctgtatgatgccatgttccagatctggaagtcctggccccgggcccaggagctgtgcccagagaacttcatccacttcaacaacaagctggtgatcaagaagatggatgccaggaaatatgaggagagcctgaaggccgagctgacctcctggatcaagaatggaaatgtggagcaggccaggatggtgctgcagaacctgagccctgaggccgacctgagccctgagaacatgatcaccatgttccccctgctggtggagaagctgaggaagatggagaagctgcctgccctcttcttcctgttcaagctgggcgctgtggagaatgctgctgagagcgtgtccaccttcctgaagaagaagcaggagaccaagaggcctcccaaggctgacaaggaggcccacgtgatggccaacaagctgaggaaggtgaagaagagcattgagaagcagaagatcattgatgagaagagccagaagaagaccagaaatgtggaccagagcctcatccatgaagctgagcatgacaacctggtgaagtgcctggagaagaacctggagatcccccaggactgcacctatgctgaccagaaggctgtggacacagagaccctgcagaaggtgtttggccgggtgaagtttgagaggaaaggagaggagctgaaggccctggccgagcggggcatcggctaccaccacagcgccatgtccttcaaggagaagcagctggtggagatcctcttcaggaagggctacctgcgggtggtgacagccaccggcaccctggccctgggcgtgaacatgccctgcaagtctgtggtgtttgcccagaacagcgtgtacctggatgccctgaactaccggcagatgagcggccgggccggccggcggggccaggacctgatgggagatgtgtacttctttgacatccccttccccaagattggcaagctgatcaagagcaatgtgcctgagctgcggggccacttccccctgagcatcaccctggtgctgcggctgatgctgctggccagcaaaggagatgatcctgaagatgccaaggccaaggtgctgtctgtgctgaagcacagcctgctgtccttcaagcagccccgggtgatggacatgctgaagctgtacttcctgttcagcctgcagttcctggtgaaggagggctacctggaccaggagggcaaccccatgggctttgctggcctggtgagccacctgcactaccacgagcccagcaacctggtgtttgtgtccttcctggtgaatggcctcttccatgacctgtgccagcccaccaggaagggcagcaagcacttcagccaggatgtgatggagaagctggtgctggtgctggcccacctgtttggaagacgctacttcccccccaagttccaggatgcccactttgagttctaccagagcaaggtgttcctggatgacctgcctgaggacttcagtgatgccctggatgagtacaacatgaagatcatggaggacttcaccaccttcctgcgcatcgtgtccaagctggccgacatgaaccaggagtaccagctgcccctgagcaagatcaagttcaccgggaaggaatgtgaggacagccagctggtgagccacctgatgagctgcaaggagggccgggtggccatcagcccctttgtgtgcctgagcggcaactttgatgatgacctgctgcggctggagacccccaaccacgtgaccctgggcaccatcggcgtgaacagaagccaggcccctgtgctgctgagccagaagtttgacaacagaggaaggaagatgagcctgaatgcctatgccctggacttctacaagcacggcagcctcatcggcctggtgcaggacaacaggatgaatgaaggagatgcctactacctgctgaaggactttgccctgaccatcaagagcatctctgtgtccctgcgggagctgtgtgaaaatgaagatgacaacgtggtgctggcctttgagcagctgagcaccaccttctgggagaagctgaacaaggtgtag

SEQ ID NO: 149529 - DNA, 363 bp, Artificial Sequence
  Description of Artificial Sequence: Synthetic coding sequence
atggagagaaatgtgctgaccaccttcagccaggagatgagccagctgatcctgaatgagatgcccaaggccgagtacagcagcctcttcaatgactttgtggagagcgagttcttcctgattgatggagacagcctgctgatcacctgcatctgtgagatctccttcaagccaggccagaacctgcacttcttctacctggtggagcgctacctggtggacctgatcagcaagggcggccagttcaccatcgtgttcttcaaggatgctgaatatgcctacttcaacttccctgagctgctgagcctgaggacagccctgatcctgcacctgcagaagaacaccaccattgatgtgaggtag

SEQ ID NO: 149530 - DNA, 885 bp, Artificial Sequence
  Description of Artificial Sequence: Synthetic coding sequence
atgatccgctgccccttcctggccctgagcgccaccatcagcaaccctgagcacctgacagagtggctgcagagcgtgaagtggtactggaagcaggaggacaagatcatcgagaacaacacagccagcaagagacatgtgggccggcaggccggcttccccaaggactacctgcaggtgaagcagagctacaaggtgcggctggtgctgtatggagagcgctacaatgacctggagaagcacgtgtgcagcatcaagcatggagacatccactttgaccacttccacccctgtgccgccctgaccacagaccacatcgagagatatggcttccccccagacctgaccctgagcccccgggagagcatccagctgtatgatgccatgttccagatctggaagtcctggccccgggcccaggagctgtgcccagagaacttcatccacttcaacaacaagctggtgatcaagaagatggatgccaggaaatatgaggagagcctgaaggccgagctgacctcctggatcaagaatggaaatgtggagcaggccaggatggtgctgcagaacctgagccctgaggccgacctgagccctgagaacatgatcaccatgttccccctgctggtggagaagctgaggaagatggagaagctgcctgccctcttcttcctgttcaagctgggcgctgtggagaatgctgctgagagcgtgtccaccttcctgaagaagaagcaggagaccaagaggcctcccaaggctgacaaggaggcccacgtgatggccaacaagctgaggaaggtgaagaagagcattgagaagcagaagatcattgatgagaagagccagaagaaccagaagtgtggcagcaagcccaacacctag

SEQ ID NO: 149531 - DNA, 1062 bp, Artificial Sequence
  Description of Artificial Sequence: Synthetic coding sequence
atgcagagcaagagggactgtgagctgtggtgtgagcgggtgaaccctgagaacaaggccgccctggaggcctgggtgcgggagaccggcatccggctggtgcaggtgaatggccagaggaaatatggaggccccccacctggctgggtgggcagccccccacctgctggcagcgaggtgttcatcggccgcctgccccaggatgtgtatgagcaccagctgatccccctcttccagagggtgggccgcctgtatgagttccggctgatgatgaccttcagcggcctgaacagaggatttgcctatgcccgctacagcagccggcggggggcccaggccgccatcgccaccctgcacaaccaccccctgcggcccagctgccccctgctggtgtgccgcagcacagagaagtgtgagctgtctgtggatggcctgccccccaacctgaccaggtctgccctgctgctggccctgcagcccctgggccctggcctgcaggaggcccggctgctgcccagccctggccctgcccctggccagatcgccctgctgaagttcagcagccacagagctgctgccatggccaagaaggccctggtggagggccagagccacctgtgtggggagcaggtggccgtggagtggctgaagccagacctgaagcagaggctgcggcagcagctggtgggccccttcctgcggagcccccagcctgagggcagccagctggccctggcccgggacaagctgggcttccagggcgcccgggccaccctgcagctgctgtgccagaggatgaagctgggcagccctgtgttcctgaccaagtgcctgggcatcggccctgctggctggcaccgcttctggtaccaggtggtgattcctggccaccctgtgcccttcagcggcctcatctgggtggtgctgaccctggatggaagagatggccacgaggtggccaaggatgctgtgtctgtgcggctgctgcaggccctgtctgagagcggggccaacctgctgtggagcgctggagctgaggccggcaccatggtgaagcagtag

SEQ ID NO: 149532 - DNA, 1491 bp, Artificial Sequence
  Description of Artificial Sequence: Synthetic coding sequence
atgtttgccaaggccaccaggaacttcctgcgggaggtggatgctgatggagacctgattgctgtgagcaacctgaatgacagcgacaagctgcagctgctgagcctggtgaccaagaagaagcgcttctggtgctggcagaggcccaagtaccagttcctgagcctgaccctgggagatgtgctgattgaggaccagttccccagccctgtggtggtggagagtgactttgtgaagtatgagggcaagtttgccaaccacgtgtctggcaccctggagacagccctgggcaaggtgaagctgaacctgggcggcagcagccgggtggagagccagagcagctttggcaccctgaggaagcaggaggtggacctgcagcagctgatccgggacagcgctgagaggaccatcaacctgaggaaccctgtgctgcagcaggtgctggagggcagaaatgaggtgctgtgtgtgctgacccagaagatcaccaccatgcagaagtgtgtgatcagcgagcacatgcaggtggaggagaagtgtggcggcatcgtgggcatccagaccaagacagtgcaggtgtctgccacagaagatggaaatgtgaccaaggacagcaatgtggtgctggagatcccagctgccaccaccatcgcctatggagtcatcgagctgtatgtgaagctggatggccagtttgagttctgcctgctgcggggcaagcagggcggctttgagaacaagaagagaattgacagcgtgtacctggaccccctggtgttccgggagtttgccttcatcgacatgccagatgctgcccacggcatcagcagccaggacggccccctgtctgtgctgaagcaggccaccctgctgctggagaggaacttccacccctttgctgagctgcctgagccccagcagacagccctgagtgacatcttccaggccgtgctgtttgatgatgagctgctgatggtgctggagcctgtgtgtgatgacctggtgtctggcctgagccccaccgtggccgtgctgggggagctgaagccccggcagcagcaggacctggtggccttcctgcagctggtgggctgcagcctgcagggcggctgccccggcccagaagatgctggcagcaagcagctgttcatgacagcctacttcctggtgtctgccctggccgagatgccagattctgctgctgccctgctgggcacctgctgcaagctgcagatcatccccaccctgtgccacctgctgcgggccctgagtgatgatggagtgtctgacctggaggaccccaccctgacccccctgaaggacacagaaagatttggaattgtgcagaggctgtttgccagcgctgacatcagcctggagcggctgaagagctctgtgaaggccgtcatcctgaaggacagcaaggtgttccccctgctgctgtgcatcaccctgaatggcctgtgtgccctgggccgggagcacagctag

SEQ ID NO: 149533 - DNA, 1491 bp, Artificial Sequence; identical to SEQ ID NO: 149532
  Description of Artificial Sequence: Synthetic coding sequence

SEQ ID NO: 149534 - DNA, 999 bp, Artificial Sequence
  Description of Artificial Sequence: Synthetic coding sequence
atgcagaagtgtgtgatcagcgagcacatgcaggtggaggagaagtgtggcggcatcgtgggcatccagaccaagacagtgcaggtgtctgccacagaagatggaaatgtgaccaaggacagcaatgtggtgctggagatcccagctgccaccaccatcgcctatggagtcatcgagctgtatgtgaagctggatggccagtttgagttctgcctgctgcggggcaagcagggcggctttgagaacaagaagagaattgacagcgtgtacctggaccccctggtgttccgggagtttgccttcatcgacatgccagatgctgcccacggcatcagcagccaggacggccccctgtctgtgctgaagcaggccaccctgctgctggagaggaacttccacccctttgctgagctgcctgagccccagcagacagccctgagtgacatcttccaggccgtgctgtttgatgatgagctgctgatggtgctggagcctgtgtgtgatgacctggtgtctggcctgagccccaccgtggccgtgctgggggagctgaagccccggcagcagcaggacctggtggccttcctgcagctggtgggctgcagcctgcagggcggctgccccggcccagaagatgctggcagcaagcagctgttcatgacagcctacttcctggtgtctgccctggccgagatgccagattctgctgctgccctgctgggcacctgctgcaagctgcagatcatccccaccctgtgccacctgctgcgggccctgagtgatgatggagtgtctgacctggaggaccccaccctgacccccctgaaggacacagaaagatttggaattgtgcagaggctgtttgccagcgctgacatcagcctggagcggctgaagagctctgtgaaggccgtcatcctgaaggacagcaaggtgttccccctgctgctgtgcatcaccctgaatggcctgtgtgccctgggccgggagcacagctag

SEQ ID NO: 149535 - DNA, 999 bp, Artificial Sequence; identical to SEQ ID NO: 149534
  Description of Artificial Sequence: Synthetic coding sequence

SEQ ID NO: 149536 - DNA, 1575 bp, Artificial Sequence
  Description of Artificial Sequence: Synthetic coding sequence
atggccaacagcgctggcttcctgggggacctgaccacagagggcatcaacaagccaggcttctacaagggccctgctggcagccaggtgaccctgagcagcctgggcaaccagaccagggtgctgctggaggagcaggcccggcacctgctgaatgagcaggagcacgccaccatggcctactacctggatgagtaccggggcggctctgtgtctgtggaggccctggtgatggccctcttcaagctgctgaacacccacgccaagttcagcctgctgtctgaggtgcggggcaccatcagcccccaggacctggagagatttgaccacctggtgctgcggcgggagattgaatccatgaaggcccggcagcccccaggccctggggccggggacacctacagcatggtgtcctacagcgacaccggcagcagcacaggcagccacggcaccagcaccaccgtgtcctctgccaggaacaccctggacctggaggagactggagaggccgtgcagggcaacatcaatgccctgcctgatgtgtctgtggatgatgtgcgcagcaccagccagggcctgagcagcttcaagcccctgccccggcccccacccctggcccagggcaatgacctgcccctgggccagcccaggaagctgggccgggaggacctgcagccccccagctccatgcccagctgcagcggcaccgtcttcagcgccccccagaacagaagccccccagctggaacagcccccaccccaggcaccagcagcgcccaggacctgcccagcagccccatctatgcctctgtgtccccagccaaccccagcagcaagaggcccctggatgcccacctggccctggtgaaccagcaccccatcggccccttcccccgggtgcagagccccccccacctgaagagccccagcgctgaggccaccgtggccggcggctgcctgctgccccccagccccagcggccacccagaccagacaggcaccaaccagcactttgtgatggtggaggtgcacaggccagacagcgagccagatgtgaatgaggtgcgggccctgccccagaccaggacagccagcaccctgagccacctgagtgacagcggccagaccctgtctgaagattctggagtggatgctggggaggccgaggccagcgcccctggccggggccggcagagcgtgtccaccaagagccgcagcagcaaggagctgcccagaaatgaaagacccacagatggagccaacaagcccccaggcctgctggagcccaccagcaccctggtgcgggtgaagaagtctgctgccaccctgggcatcgccattgaaggaggagccaacacccggcagcccctgccccgcatcgtgaccatccagaggggcggcagcgcccacaactgtggccagctgaaggtgggccacgtgatcctggaggtgaatggcctgaccctgcggggcaaggagcaccgggaggccgcccgcatcatcgccgaggccttcaagaccaaggaccgggactacatcgacttcctggtgacagagttcaacgtgatgctgtag

SEQ ID NO: 149537 - DNA, 2724 bp, Artificial Sequence
  Description of Artificial Sequence: Synthetic coding sequence
atgaatgcccccctggatggcctgtctgtgagcagcagcagcacaggcagcctgggcagcgctgctggggccggcggcggcggcggggccggcctgcggctgctgagcgccaacgtgcggcagctgcaccaggccctgacagccctgctgtctgaggccgagcgggagcagttcacccactgcctgaatgcctaccacgccaggagaaatgtgtttgacctggtgaggaccctgcgggtgctgctggacagccctgtgaagaggcggctgctgcccatgctgcggctggtgatccccaggagtgaccagctgctgtttgaccagtacacagctgagggcctgtacctgcctgccaccaccccctaccggcagcctgcctggggcggccctgacagcgctggccctggagaggtgcggctggtgtccctgcggcgggccaaggcccacgagggcctgggcttcagcatccggggcggcagcgagcacggcgtgggcatctacgtgtccctggtggagcccggcagcctggccgagaaggagggcctgcgggtgggggaccagatcctgcgggtgaatgacaagagcctggcccgggtgacccacgccgaggccgtgaaggccctgaagggcagcaagaagctggtgctgtctgtgtacagcgctggccgcatccctgggggctacgtgaccaaccacatctacacctgggtggacccccagggccgcagcatcagcccccccagcggcctgccccagccccacggcggggccctgcggcagcaggagggggacagaagaagcaccctgcacctgctgcagggcggagatgagaagaaggtgaacctggtgctgggagatggccgcagcctgggcctgaccatccggggcggcgcagaatatggcctgggcatctacatcactggagtggaccccggcagcgaggccgagggcagcggcctgaaggtgggggaccagatcctggaggtgaatggccgctccttcctgaacatcctgcatgatgaggccgtgcggctgctgaagagcagccgccacctgatcctgactgtgaaggatgtgggccgcctgccccgggcccggaccaccgtggatgagaccaagtggatcgccagcagccgcatccgggagaccatggccaacagcgctggcttcctgggggacctgaccacagagggcatcaacaagccaggcttctacaagggccctgctggcagccaggtgaccctgagcagcctgggcaaccagaccagggtgctgctggaggagcaggcccggcacctgctgaatgagcaggagcacgccaccatggcctactacctggatgagtacagaggaggctctgtgtctgtggaggccctggtgatggccctcttcaagctgctgaacacccacgccaagttcagcctgctgtctgaggtgcggggcaccatcagcccccaggacctggagagatttgaccacctggtgctgcggcgggagattgagagcatgaaggcccggcagcccccaggccctggagctggggacacctacagcatggtgtcctacagcgacaccggcagcagcacaggcagccacggcaccagcaccaccgtgagcagcgccaggaacaccctggacctggaggagaccggggaggccgtgcagggcaacatcaatgccctgcctgatgtgtctgtggatgatgtgcgcagcaccagccagggcctgagcagcttcaagcccctgccccggcccccacccctggcccagggcaatgacctgcccctgggccagcccaggaagctgggccgggaggacctgcagccccccagctccatgcccagctgcagcggcaccgtcttcagcgccccccagaacagaagccccccagctggaacagcccccaccccaggcaccagcagcgcccaggacctgcccagcagccccatctatgcctctgtgtccccagccaaccccagcagcaagaggcccctggatgcccacctggccctggtgaaccagcaccccatcggccccttcccccgggtgcagagccccccccacctgaagagccccagcgctgaggccaccgtggccggcggctgcctgctgccccccagccccagcggccacccagaccagacaggcaccaaccagcactttgtgatggtggaggtgcacaggccagattctgagccagatgtgaatgaggtgcgggccctgccccagaccaggacagccagcaccctgagccacctgagtgacagcggccagaccctgtctgaggacagcggcgtggatgctggggaggccgaggccagcgcccctggccggggccggcagagcgtgtccaccaagagccgcagcagcaaggagctgcccagaaatgaaagacccacagatggagccaacaagcccccaggcctgctggagcccaccagcaccctggtgcgggtgaagaagtctgctgccaccctgggcatcgccatcgagggcggggccaacacccggcagcccctgcccagaattgtgaccatccagagaggaggcagcgcccacaactgtggccagctgaaggtgggccacgtgatcctggaggtgaatggcctgaccctgcggggcaaggagcaccgggaggccgcccgcatcatcgccgaggccttcaagaccaaggaccgggactacatcgacttcctggtgacagagttcaacgtgatgctgtag

SEQ ID NO: 149538 - DNA, 1038 bp, Artificial Sequence
  Description of Artificial Sequence: Synthetic coding sequence
atgaatgcccccctggatggcctgtctgtgagcagcagcagcacaggcagcctgggcagcgctgctggggccggcggcggcggcggggccggcctgcggctgctgagcgccaacgtgcggcagctgcaccaggccctgacagccctgctgtctgaggccgagcgggagcagttcacccactgcctgaatgcctaccacgccaggagaaatgtgtttgacctggtgaggaccctgcgggtgctgctggacagccctgtgaagaggcggctgctgcccatgctgcggctggtgatccccaggagtgaccagctgctgtttgaccagtacacagctgagggcctgtacctgcctgccaccaccccctaccggcagcctgcctggggcggccctgacagcgctggccctggagaggtgcggctggtgtccctgcggcgggccaaggcccacgagggcctgggcttcagcatccggggcggcagcgagcacggcgtgggcatctacgtgtccctggtggagcccggcagcctggccgagaaggagggcctgcgggtgggggaccagatcctgcgggtgaatgacaagagcctggcccgggtgacccacgccgaggccgtgaaggccctgaagggcagcaagaagctggtgctgtctgtgtacagcgctggccgcatccctgggggctacgtgaccaaccacatctacacctgggtggacccccagggccgcagcatcagcccccccagcggcctgccccagccccacggcggggccctgcggcagcaggagggggacagaagaagcaccctgcacctgctgcagggcggagatgagaagaaggtgtctggagtgggcaaaggaggccagcccctgcggcaccgcatcctgccccccaaccctgagcagcagagctgcctggaggccgcccggcggggctggttctgccccggctctgtgttcccccaggtgtgcacagagggctggtgcttcttctttgccttcctgtttgacctgtgcagcgtgtgctacaacacaggatag

SEQ ID NO: 149539 - DNA, 1671 bp, Artificial Sequence
  Description of Artificial Sequence: Synthetic coding sequence
atgcacggcagcctggaggccctgctcttcctgccccaggtgaccctgagcctggcccacgcccacctgatctgcagcaatgcccagctggagatgtgtgtgttcccccaccgcttcctgggggacctgaccacagagggcatcaacaagccaggcttctacaagggccctgctggcagccaggtgaccctgagcagcctgggcaaccagaccagggtgctgctggaggagcaggcccggcacctgctgaatgagcaggagcacgccaccatggcctactacctggatgagtaccggggcggctctgtgtctgtggaggccctggtgatggccctcttcaagctgctgaacacccacgccaagttcagcctgctgtctgaggtgcggggcaccatcagcccccaggacctggagagatttgaccacctggtgctgcggcgggagattgaatccatgaaggcccggcagcccccaggccctggggccggggacacctacagcatggtgtcctacagcgacaccggcagcagcacaggcagccacggcaccagcaccaccgtgtcctctgccaggaacaccctggacctggaggagactggagaggccgtgcagggcaacatcaatgccctgcctgatgtgtctgtggatgatgtgcgcagcaccagccagggcctgagcagcttcaagcccctgccccggcccccacccctggcccagggcaatgacctgcccctgggccagcccaggaagctgggccgggaggacctgcagccccccagctccatgcccagctgcagcggcaccgtcttcagcgccccccagaacagaagccccccagctggaacagcccccaccccaggcaccagcagcgcccaggacctgcccagcagccccatctatgcctctgtgtccccagccaaccccagcagcaagaggcccctggatgcccacctggccctggtgaaccagcaccccatcggccccttcccccgggtgcagagccccccccacctgaagagccccagcgctgaggccaccgtggccggcggctgcctgctgccccccagccccagcggccacccagaccagacaggcaccaaccagcactttgtgatggtggaggtgcacaggccagacagcgagccagatgtgaatgaggtgcgggccctgccccagaccaggacagccagcaccctgagccacctgagtgacagcggccagaccctgtctgaagattctggagtggatgctggggaggccgaggccagcgcccctggccggggccggcagagcgtgtccaccaagagccgcagcagcaaggagctgcccagaaatgaaagacccacagatggagccaacaagcccccaggcctgctggagcccaccagcaccctggtgcgggtgaagaagtctgctgccaccctgggcatcgccattgaaggaggagccaacacccggcagcccctgccccgcatcgtgaccatccagaggggcggcagcgcccacaactgtggccagctgaaggtgggccacgtgatcctggaggtgaatggcctgaccctgcggggcaaggagcaccgggaggccgcccgcatcatcgccgaggccttcaagaccaaggaccgggactacatcgacttcctggtgacagagttcaacgtgatgctgtag

SEQ ID NO: 149540 - DNA, 1059 bp, Artificial Sequence
  Description of Artificial Sequence: Synthetic coding sequence
atgtttgctgctgccaccaagagctttgtgaagcaggtgggagatggcggccgcctggtgcctgtgcccagcctgtctgaggccgacaagtaccagcccctgagcctggtggtgaagaagaagcgctgcttcctgttcccccgctacaagttcaccagcacccccttcaccctgaaggacatcctgctgggggaccgggagatctctgctggcatcagcagctaccagctgctgaactatgaagatgaaagtgatgtgtccctgtatggaagaagaggcaaccacatcgtgaatgatgtgggcatcaacgtggccggcagtgacagcattgctgtgaaggccagctttggcatcgtgaccaagcatgaggtggaggtgtccaccctgctgaaggagatcaccaccaggaagatcaactttgaccacagcctcatccggcagagccgcagcagcaggaaggctgtgctgtgtgtggtgatggagagcatccgcaccacccggcagtgcagcctgtctgtgcatgctggcatccggggggaggccatgaggttccacttcatggatgagcagaaccccaagggccgggacaaggccatcgtgtttcctgcccacaccaccatcgccttctctgtgtttgagctgttcatctacctggatggagcctttgacctgtgtgtgacctctgtgtccaaaggaggctttgagcgggaggagacagccacctttgccctgctgtaccgcctgaggaacatcctgtttgaaagaaacagaagagtgatggatgtgatcagccgcagccagctgtacctggatgacctcttcagtgactactatgacaagcccctgtccatgacagacatcagcctgaaggagggcacccacatccgggtgaacctgctgaaccacaacatccccaagggcccctgcatcctgtgtggcatgggcaacttcaagcgggagaccgtgtatggctgcttccagtgcagcgtggatggccagaagtatgtgcggctgcatgctgtgccctgctttgacatctggcacaagaggatgaagtag

SEQ ID NO: 149541 - DNA, 1059 bp, Artificial Sequence; identical to SEQ ID NO: 149540
  Description of Artificial Sequence: Synthetic coding sequence

SEQ ID NO: 149542 - DNA, 2388 bp, Artificial Sequence
  Description of Artificial Sequence: Synthetic coding sequence
atgagcaagaggcaccggctggacctgggggaggactaccccagcggcaagaagagagctggaacagatggcaaggaccgggaccgggaccgggaccgggaggacaggagcaaggaccgggaccgggagcgggacagaggagaccgggagcgggagcgggagaaggagaaggagaaggagctgcgggccagcaccaatgccatgctgatctctgctggcctgccccccctgaaggccagccacagcgcccacagcacccacagcgcccacagcacccacagcacccacagcgcccacagcacccatgctggccacgccggccacaccagcctgccccagtgcatcaaccccttcaccaacctgccccacaccccccgctactatgacatcctgaagaagaggctgcagctgcctgtgtgggagtacaaggaccgcttcacagacatcctggtgcgccaccagagctttgtgctggtgggggagaccggcagcggcaagaccacccagatcccccagtggtgtgtggagtacatgaggagcctgcccggccccaagaggggcgtggcctgcacccagccccggcgggtggccgccatgtctgtggcccagagggtggctgatgagatggatgtgatgctgggccaggaggtgggctacagcatccgctttgaggactgcagcagcgccaagaccatcctgaagtacatgacagatggcatgctgctgcgggaggccatgaatgaccccctgctggagagatatggagtcatcatcctggatgaggcccacgagaggaccctggccacagacatcctgatgggcgtgctgaaggaggtggtgcggcagaggagtgacctgaaggtgattgtgatgtctgccaccctggatgctgggaagttccagatctactttgacaactgccccctgctgaccatccctggccgcacccaccctgtggagatcttctacaccccagagcctgagcgggactacctggaggccgccatccgcaccgtcatccagatccacatgtgtgaggaggaggagggggacctgctgctcttcctgaccggccaggaggagattgatgaggcctgcaagaggatcaagcgggaggtggatgacctgggccctgaggtgggggacatcaagatcatccccctgtacagcaccctgcccccccagcagcagcagaggatctttgagcccccaccacccaagaagcagaatggagccatcggcaggaaggtggtggtgtccaccaacattgctgagaccagcctgaccattgatggagtggtgtttgtgattgatcctggctttgccaagcagaaggtgtacaacccccgcatccgggtggagagcctgctggtgacagccatcagcaaggccagcgcccagcagagagctggccgggccggccgcaccaggcctgggaagtgcttccggctgtacacagagaaggcctacaagacagagatgcaggacaacacctacccagagatcctgcggagcaacctgggctctgtggtgctgcagctgaagaagctgggcattgatgacctggtgcactttgacttcatggaccccccagcccctgagaccctgatgagggccctggagctgctgaactacctggccgccctgaatgatgatggagacctgacagagctgggctccatgatggccgagttccccctggacccccagctggccaagatggtgattgccagctgtgactacaactgcagcaatgaggtgctgagcatcacagccatgctgtctgtgccccagtgctttgtgcggcccacagaggccaagaaggccgcagatgaggccaagatgagatttgcccacattgatggagaccacctgaccctgctgaatgtgtaccacgccttcaagcagaaccacgagagcgtgcagtggtgctatgacaacttcatcaactaccgcagcctgatgtctgctgacaacgtgcggcagcagctgagccgcatcatggaccgcttcaacctgcccaggaggagcacagacttcaccagccgggactactacatcaacatcaggaaggccctggtgacaggctacttcatgcaggtggcccacctggagaggacaggccactacctgactgtgaaggacaaccaggtggtgcagctgcaccccagcacagtgctggaccacaagccagagtgggtgctgtacaatgaatttgtgctgaccaccaagaactacatccgcacctgcacagacatcaagccagagtggctggtgaagatcgccccccagtactatgacatgagcaacttcccccagtgtgaggccaagaggcagctggaccgcatcatcgccaagctgcagagcaaggagtacagccagtactag

SEQ ID NO: 149543 - DNA, 2355 bp, Artificial Sequence
  Description of Artificial Sequence: Synthetic coding sequence
atgagcaagaggcaccggctggacctgggggaggactaccccagcggcaagaagagagctggaacagatggcaaggaccgggaccgggaccgggagcgggacagaggagaccgggagcgggagcgggagaaggagaaggagaaggagctgcgggccagcaccaatgccatgctgatctctgctggcctgccccccctgaaggccagccacagcgcccacagcacccacagcgcccacagcacccacagcacccacagcgcccacagcacccacgccggccatgctggccacaccagcctgccccagtgcatcaaccccttcaccaacctgccccacaccccccgctactatgacatcctgaagaagaggctgcagctgcctgtgtgggagtacaaggaccgcttcacagacatcctggtgcgccaccagagctttgtgctggtgggggagactggaagtggcaagaccacccagatcccccagtggtgtgtggagtacatgaggagcctgcccggccccaagaggggcgtggcctgcacccagcccaggagagtggccgccatgtctgtggcccagagggtggctgatgagatggatgtgatgctgggccaggaggtgggctacagcatccgctttgaggactgcagcagcgccaagaccatcctgaagtacatgacagatggcatgctgctgcgggaggccatgaatgaccccctgctggagagatatggagtcatcatcctggatgaggcccacgagaggaccctggccacagacatcctgatgggcgtgctgaaggaggtggtgcggcagaggagtgacctgaaggtgattgtgatgtctgccaccctggatgctgggaagttccagatctactttgacaactgccccctgctgaccatccctggccgcacccaccctgtggagatcttctacaccccagagcctgagcgggactacctggaggccgccatcagaactgtcatccagatccacatgtgtgaggaggaggagggggacctgctgctcttcctgaccggccaggaggagattgatgaggcctgcaagaggatcaagcgggaggtggatgacctgggccctgaggtgggggacatcaagatcatccccctgtacagcaccctgcccccccagcagcagcagaggatctttgagcccccaccacccaagaagcagaatggagccatcggcaggaaggtggtggtgtccaccaacattgctgagaccagcctgaccattgatggagtggtgtttgtgattgaccccggctttgccaagcagaaggtgtacaacccccgcatccgggtggagagcctgctggtgacagccatcagcaaggccagcgcccagcagagagctggccgggccggccgcaccaggcctgggaagtgcttccggctgtacacagagaaggcctacaagacagagatgcaggacaacacctacccagagatcctgcggagcaacctgggctctgtggtgctgcagctgaagaagctgggcattgatgacctggtgcactttgacttcatggaccccccagcccctgagaccctgatgagggccctggagctgctgaactacctggccgccctgaatgatgatggagacctgacagagctgggctccatgatggccgagttccccctggacccccagctggccaagatggtgattgccagctgtgactacaactgcagcaatgaggtgctgagcatcacagccatgctgtctgtgccccagtgctttgtgcggcccacagaggccaagaaggctgctgatgaggccaagatgagatttgcccacattgatggagaccacctgaccctgctgaatgtgtaccacgccttcaagcagaaccatgaatctgtgcagtggtgctatgacaacttcatcaactaccgcagcctgatgtctgctgacaacgtgcggcagcagctgagccgcatcatggaccgcttcaacctgccccggcgcagcacagacttcaccagccgggactactacatcaacatcaggaaggccctggtgacaggctacttcatgcaggtggcccacctggagaggacaggccactacctgactgtgaaggacaaccaggtggtgcagctgcaccccagcacagtgctggaccacaagccagagtgggtgctgtacaatgaatttgtgctgaccaccaagaactacatccgcacctgcacagacatcaagccagagtggctggtgaagatcgccccccagtactatgacatgagcaacttcccccagtgtgaggccaagaggcagctggaccgcatcatcgccaagctgcagagcaaggagtacagccagtactag

SEQ ID NO: 149544 - DNA, 1683 bp, Artificial Sequence
  Description of Artificial Sequence: Synthetic coding sequence
atggagagccagcctgcccaggagtgcctgatgcagatgttcctgcccattgaaccagcctgctttgtggagtggctgggcaccagccccagccagctgggcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatgatgcccctgtgttccgcatccctggccgccgcttccctgtggacatcttctacaccaaggcccctgaggccgactacctggaggcctgtgtggtgtctgtgctgcagatccacgtgacccagcccccaggggacatcctggtgttcctgaccggccaggaggagattgaggccgcctgtgagatgctgcaggaccgctgccggcggctgggcagcaagatccgggagctgctggtgctgcccatctatgccaacctgcccagcgacatgcaggcccgcatcttccagcccaccccacctggggccaggaaggtggtggtggccaccaacattgctgagaccagcctgaccatcgagggcatcatctacgtgctggaccccggcttctgcaagcagaagagctacaaccccaggacaggcatggagagcctgactgtgaccccctgcagcaaggccagcgccaaccagagagctggccgggccggccgggtggccgccggcaagtgcttccggctgtacacagcctgggcctaccagcacgagctggaggagaccaccgtgcctgagatccagaggaccagcctgggcaatgtggtgctgctgctgaagagcctgggcatccatgacctgatgcactttgacttcctggaccccccaccctatgagaccctgctgctggccctggagcagctgtatgccctgggcgccctgaaccacctgggggagctgaccaccagcggcaggaagatggccgagctgcctgtggaccccatgctgagcaagatgatcctggccagcgagaagtacagctgcagcgaggagatcctgactgtggccgccatgctgtctgtgaacaacagcatcttctaccggcccaaggacaaggtggtgcatgctgacaatgcccgggtgaacttcttcctgcctggaggagaccacctggtgctgctgaatgtgtacacccagtgggccgagagcggctacagcagccagtggtgctatgaaaattttgtgcagttccgctccatgaggcgggccagagatgtgcgggagcagctggagggcctgctggagcgggtggaggtgggcctgagcagctgccagggcgactacatccgggtgaggaaggccatcacagctggctacttctaccacacagcccggctgaccaggagcggctacagaacagtgaagcagcagcagaccgtcttcatccaccccaacagcagcctgtttgagcagcagccccgctggctgctgtaccacgagctggtgctgaccaccaaggagttcatgaggcaggtgctggagattgagagctcctggctgctggaggtggccccccactactacaaggccaaggagctggaggacccccacgccaagaagatgcccaagaagattggcaagacccgggaggagctgggctag

SEQ ID NO: 149545 - DNA, 3126 bp, Artificial Sequence
  Description of Artificial Sequence: Synthetic coding sequence
atggccaccccagctggcctggagcgctgggtgcaggatgagctgcacagcgtgctgggcctgtctgaaagacatgtggcccagttcctgattggaacagcccagcgctgcaccagcgctgaggagtttgtgcagaggctgcgggacacagacaccctggacctgagcggccctgcccgggactttgccctgcggctgtggaacaaggtgcccaggaaggctgtggtggagaagccagcccgggctgctgagcgggaggcccgggccctgctggagaagaacagaagctaccgcctgctggaggacagcgaggagagcagcgaggagaccgtgtcccgggccggcagcagcctgcagaagaagaggaagaagaggaagcacctgaggaagaagcgggaggaggaggaggaggaggaggccagcgagaagggcaagaagaagacaggaggcagcaagcagcagacagagaagccagagagtgaagatgagtgggagaggacagagcgggagcggctgcaggacctggaggagagagatgcctttgctgagcgggtgcggcagagggacaaggacaggaccagaaatgtgctggagaggagtgacaagaaggcctatgaggaggcccagaagaggctgaagatggccgaggaggacaggaaggccatggtgcctgagctgaggaagaagagcagaagagagtacctggccaagcgggagcgggagaagctggaggacctggaggccgagctggctgatgaggagttcctgtttggagatgtggagctgagcagacatgagcggcaggagctgaagtacaagagaagagtgcgggacctggcccgggagtacagagctgctggggagcaggagaagctggaggccaccaaccgctaccacatgcccaaggagacccggggccagcctgcccgggctgtggacctggtggaggaggagagcggggcccctggagaggagcagaggcgctgggaggaggcccggctgggcgccgccagcctgaagtttggagccagagatgctgccagccaggagcccaagtaccagctggtgctggaggaggaggagaccattgaatttgtgcgggccacccagctgcagggagatgaggagcccagcgccccacccaccagcacccaggcccagcagaaggagagcatccaggccgtgcggcgcagcctgcccgtcttccccttccgggaggagctgctggccgccatcgccaaccaccaggtgctgatcatcgagggggagaccggcagcggcaagaccacccagatcccccagtacctgtttgaggagggctacaccaacaagggcatgaagatcgcctgcacccagccccggcgggtggccgccatgtctgtggccgcccgggtggcccgggagatgggcgtgaagctgggcaatgaggtgggctacagcatccgctttgaggactgcaccagcgagaggacagtgctgcgctacatgacagatggcatgctgctgcgggagttcctgtctgagccagacctggccagctacagcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatgatgcccctgtgttccgcatccctggaagacgcttccctgtggacatcttctacaccaaggcccctgaggccgactacctggaggcctgtgtggtgtctgtgctgcagatccacgtgacccagcccccaggggacatcctggtgttcctgaccggccaggaggagattgaagctgcctgtgagatgctgcaggaccgctgccggcggctgggcagcaagatccgggagctgctggtgctgcccatctatgccaacctgcccagcgacatgcaggcccgcatcttccagcccaccccacctggggccaggaaggtggtggtggccaccaacattgctgagaccagcctgaccatcgagggcatcatctacgtgctggaccccggcttctgcaagcagaagagctacaaccccaggacaggcatggagagcctgactgtgaccccctgcagcaaggccagcgccaaccagagagctggccgggccggccgggtggccgccggcaagtgcttccggctgtacacagcctgggcctaccagcacgagctggaggagaccaccgtgcctgagatccagaggaccagcctgggcaatgtggtgctgctgctgaagagcctgggcatccatgacctgatgcactttgacttcctggaccccccaccctatgagaccctgctgctggccctggagcagctgtatgccctgggcgccctgaaccacctgggggagctgaccaccagcggcaggaagatggccgagctgcctgtggaccccatgctgagcaagatgatcctggccagcgagaagtacagctgcagcgaggagatcctgactgtggccgccatgctgtctgtgaacaacagcatcttctaccggcccaaggacaaggtggtgcacgccgacaatgcccgggtgaacttcttcctgcccggcggggaccacctggtgctgctgaatgtgtacacccagtgggccgagagcggctacagcagccagtggtgctatgagaactttgtgcagttccgctccatgagaagagccagagatgtgcgggagcagctggagggcctgctggagcgggtggaggtgggcctgagcagctgccagggcgactacatccgggtgaggaaggccatcacagctggctacttctaccacacagcccggctgaccaggagcggctacagaacagtgaagcagcagcagacagtgttcatccaccccaacagcagcctgtttgagcagcagccccgctggctgctgtaccacgagctggtgctgaccaccaaggagttcatgaggcaggtgctggagattgagagctcctggctgctggaggtggccccccactactacaaggccaaggagctggaggacccccacgccaagaagatgcccaagaagattggcaagacccgggaggagctgggctag

SEQ ID NO: 149546 - DNA, 1683 bp, Artificial Sequence
  Description of Artificial Sequence: Synthetic coding sequence
atggagagccagcctgcccaggagtgcctgatgcagatgttcctgcccattgaaccagcctgctttgtggagtggctgggcaccagccccagccagctgggcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatggagcccctgtgttccgcatccctggccgccgcttccctgtggacatcttctacaccaaggcccctgaggccgactacctggaggcctgtgtggtgtctgtgctgcagatccacgtgacccagcccccaggggacatcctggtgttcctgaccggccaggaggagattgaggccgcctgtgagatgctgcaggaccgctgccggcggctgggcagcaagatccgggagctgctggtgctgcccatctatgccaacctgcccagcgacatgcaggcccgcatcttccagcccaccccacctggggccaggaaggtggtggtggccaccaacattgctgagaccagcctgaccatcgagggcatcatctacgtgctggaccccggcttctgcaagcagaagagctacaaccccaggacaggcatggagagcctgactgtgaccccctgcagcaaggccagcgccaaccagagagctggccgggccggccgggtggccgccggcaagtgcttccggctgtacacagcctgggcctaccagcacgagctggaggagaccaccgtgcctgagatccagaggaccagcctgggcaatgtggtgctgctgctgaagagcctgggcatccatgacctgatgcactttgacttcctggaccccccaccctatgagaccctgctgctggccctggagcagctgtatgccctgggcgccctgaaccacctgggggagctgaccaccagcggcaggaagatggccgagctgcctgtggaccccatgctgagcaagatgatcctggccagcgagaagtacagctgcagcgaggagatcctgactgtggccgccatgctgtctgtgaacaacagcatcttctaccggcccaaggacaaggtggtgcatgctgacaatgcccgggtgaacttcttcctgcctggaggagaccacctggtgctgctgaatgtgtacacccagtgggccgagagcggctacagcagccagtggtgctatgaaaattttgtgcagttccgctccatgaggcgggccagagatgtgcgggagcagctggagggcctgctggagcgggtggaggtgggcctgagcagctgccagggcgactacatccgggtgaggaaggccatcacagctggctacttctaccacacagcccggctgaccaggagcggctacagaacagtgaagcagcagcagaccgtcttcatccaccccaacagcagcctgtttgagcagcagccccgctggctgctgtaccacgagctggtgctgaccaccaaggagttcatgaggcaggtgctggagattgagagctcctggctgctggaggtggccccccactactacaaggccaaggagctggaggacccccacgccaagaagatgcccaagaagattggcaagacccgggaggagctgggctag

SEQ ID NO: 149547 - DNA, 3126 bp, Artificial Sequence
  Description of Artificial Sequence: Synthetic coding sequence
atggccaccccagctggcctggagcgctgggtgcaggatgagctgcacagcgtgctgggcctgtctgaaagacatgtggcccagttcctgattggaacagcccagcgctgcaccagcgctgaggagtttgtgcagaggctgcgggacacagacaccctggacctgagcggccctgcccgggactttgccctgcggctgtggaacaaggtgcccaggaaggctgtggtggagaagccagcccgggctgctgagcgggaggcccgggccctgctggagaagaacagaagctaccgcctgctggaggacagcgaggagagcagcgaggagaccgtgtcccgggccggcagcagcctgcagaagaagaggaagaagaggaagcacctgaggaagaagcgggaggaggaggaggaggaggaggccagcgagaagggcaagaagaagacaggaggcagcaagcagcagacagagaagccagagagtgaagatgagtgggagaggacagagcgggagcggctgcaggacctggaggagagagatgcctttgctgagcgggtgcggcagagggacaaggacaggaccagaaatgtgctggagaggagtgacaagaaggcctatgaggaggcccagaagaggctgaagatggccgaggaggacaggaaggccatggtgcctgagctgaggaagaagagcagaagagagtacctggccaagcgggagcgggagaagctggaggacctggaggccgagctggctgatgaggagttcctgtttggagatgtggagctgagcagacatgagcggcaggagctgaagtacaagagaagagtgcgggacctggcccgggagtacagagctgctggggagcaggagaagctggaggccaccaaccgctaccacatgcccaaggagacccggggccagcctgcccgggctgtggacctggtggaggaggagagcggggcccctggagaggagcagaggcgctgggaggaggcccggctgggcgccgccagcctgaagtttggagccagagatgctgccagccaggagcccaagtaccagctggtgctggaggaggaggagaccattgaatttgtgcgggccacccagctgcagggagatgaggagcccagcgccccacccaccagcacccaggcccagcagaaggagagcatccaggccgtgcggcgcagcctgcccgtcttccccttccgggaggagctgctggccgccatcgccaaccaccaggtgctgatcatcgagggggagaccggcagcggcaagaccacccagatcccccagtacctgtttgaggagggctacaccaacaagggcatgaagatcgcctgcacccagccccggcgggtggccgccatgtctgtggccgcccgggtggcccgggagatgggcgtgaagctgggcaatgaggtgggctacagcatccgctttgaggactgcaccagcgagaggacagtgctgcgctacatgacagatggcatgctgctgcgggagttcctgtctgagccagacctggccagctacagcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatggagcccctgtgttccgcatccctggaagacgcttccctgtggacatcttctacaccaaggcccctgaggccgactacctggaggcctgtgtggtgtctgtgctgcagatccacgtgacccagcccccaggggacatcctggtgttcctgaccggccaggaggagattgaagctgcctgtgagatgctgcaggaccgctgccggcggctgggcagcaagatccgggagctgctggtgctgcccatctatgccaacctgcccagcgacatgcaggcccgcatcttccagcccaccccacctggggccaggaaggtggtggtggccaccaacattgctgagaccagcctgaccatcgagggcatcatctacgtgctggaccccggcttctgcaagcagaagagctacaaccccaggacaggcatggagagcctgactgtgaccccctgcagcaaggccagcgccaaccagagagctggccgggccggccgggtggccgccggcaagtgcttccggctgtacacagcctgggcctaccagcacgagctggaggagaccaccgtgcctgagatccagaggaccagcctgggcaatgtggtgctgctgctgaagagcctgggcatccatgacctgatgcactttgacttcctggaccccccaccctatgagaccctgctgctggccctggagcagctgtatgccctgggcgccctgaaccacctgggggagctgaccaccagcggcaggaagatggccgagctgcctgtggaccccatgctgagcaagatgatcctggccagcgagaagtacagctgcagcgaggagatcctgactgtggccgccatgctgtctgtgaacaacagcatcttctaccggcccaaggacaaggtggtgcacgccgacaatgcccgggtgaacttcttcctgcccggcggggaccacctggtgctgctgaatgtgtacacccagtgggccgagagcggctacagcagccagtggtgctatgagaactttgtgcagttccgctccatgagaagagccagagatgtgcgggagcagctggagggcctgctggagcgggtggaggtgggcctgagcagctgccagggcgactacatccgggtgaggaaggccatcacagctggctacttctaccacacagcccggctgaccaggagcggctacagaacagtgaagcagcagcagacagtgttcatccaccccaacagcagcctgtttgagcagcagccccgctggctgctgtaccacgagctggtgctgaccaccaaggagttcatgaggcaggtgctggagattgagagctcctggctgctggaggtggccccccactactacaaggccaaggagctggaggacccccacgccaagaagatgcccaagaagattggcaagacccgggaggagctgggctag

SEQ ID NO: 149548 - DNA, 1683 bp, Artificial Sequence; identical to SEQ ID NO: 149544
  Description of Artificial Sequence: Synthetic coding sequence

SEQ ID NO: 149549 - DNA, 888 bp, Artificial Sequence
  Description of Artificial Sequence: Synthetic coding sequence
atgtctgaggacccccggggccccaaggtgcccaggaaggctgtggtggagaagccagcccgggctgctgagcgggaggcccgggccctgctggagaagaacagaagctaccgcctgctggaggacagcgaggagagcagcgaggagaccgtgtcccgggccggcagcagcctgcagaagaagaggaagaagaggaagcacctgaggaagaagcgggaggaggaggaggaggaggaggccagcgagaagggcaagaagaagacaggaggcagcaagcagcagacagagaagccagagagtgaagatgagtgggagaggacagagcgggagcggctgcaggacctggaggagagagatgcctttgctgagcgggtgcggcagagggacaaggacaggaccagaaatgtgctggagaggagtgacaagaaggcctatgaggaggcccagaagaggctgaagatggccgaggaggacaggaaggccatggtgcctgagctgaggaagaagagcagaagagagtacctggccaagcgggagcgggagaagctggaggacctggaggccgagctggctgatgaggagttcctgtttggagatgtggagctgagcagacatgagcggcaggagctgaagtacaagagaagagtgcgggacctggcccgggagtacagagctgctggggagcaggagaagctggaggccaccaaccgctaccacatgcccaaggagacccggggccagcctgcccgggctgtggacctggtggaggaggagagcggggcccctggagaggagcagaggcgctgggaggaggcccggctgggcgccgccagcctgaagtttggagccagagatgctgccagccaggagcccaagtaccagctgtag

SEQ ID NO: 149550 - DNA, 3126 bp, Artificial Sequence; identical to SEQ ID NO: 149545
  Description of Artificial Sequence: Synthetic coding sequence

SEQ ID NO: 149551 - DNA, 3126 bp, Artificial Sequence; identical to SEQ ID NO: 149545
  Description of Artificial Sequence: Synthetic coding sequence

SEQ ID NO: 149552 - DNA, 3126 bp, Artificial Sequence; identical to SEQ ID NO: 149545
  Description of Artificial Sequence: Synthetic coding sequence

SEQ ID NO: 149553 - DNA, 888 bp, Artificial Sequence; identical to SEQ ID NO: 149549
  Description of Artificial Sequence: Synthetic coding sequence

SEQ ID NO: 149554 - DNA, 888 bp, Artificial Sequence; identical to SEQ ID NO: 149549
  Description of Artificial Sequence: Synthetic coding sequence

SEQ ID NO: 149555 - DNA, 1683 bp, Artificial Sequence; identical to SEQ ID NO: 149544
  Description of Artificial Sequence: Synthetic coding sequence

SEQ ID NO: 149556 - DNA, 888 bp, Artificial Sequence; identical to SEQ ID NO: 149549
  Description of Artificial Sequence: Synthetic coding sequence

SEQ ID NO: 149557 - DNA, 888 bp, Artificial Sequence; identical to SEQ ID NO: 149549
  Description of Artificial Sequence: Synthetic coding sequence

SEQ ID NO: 149558 - DNA, 888 bp, Artificial Sequence; identical to SEQ ID NO: 149549
  Description of Artificial Sequence: Synthetic coding sequence

SEQ ID NO: 149559 - DNA, 888 bp, Artificial Sequence; identical to SEQ ID NO: 149549
  Description of Artificial Sequence: Synthetic coding sequence

SEQ ID NO: 149560 - DNA, 1683 bp, Artificial Sequence; identical to SEQ ID NO: 149544
  Description of Artificial Sequence: Synthetic coding sequence

SEQ ID NO: 149561 - DNA, 888 bp, Artificial Sequence; identical to SEQ ID NO: 149549
  Description of Artificial Sequence: Synthetic coding sequence

SEQ ID NO: 149562 - DNA, 2010 bp, Artificial Sequence
  Description of Artificial Sequence: Synthetic coding sequence
atggccaccccagctggcctggagcgctgggtgcaggatgagctgcacagcgtgctgggcctgtctgaaagacatgtggcccagttcctgattggaacagcccagcgctgcaccagcgctgaggagtttgtgcagaggctgcgggacacagacaccctggacctgagcggccctgcccgggactttgccctgcggctgtggaacaaggtgcccaggaaggctgtggtggagaagccagcccgggctgctgagcgggaggcccgggccctgctggagaagaacagaagctaccgcctgctggaggacagcgaggagagcagcgaggagaccgtgtcccgggccggcagcagcctgcagaagaagaggaagaagaggaagcacctgaggaagaagcgggaggaggaggaggaggaggaggccagcgagaagggcaagaagaagacaggaggcagcaagcagcagacagagaagccagagagtgaagatgagtgggagaggacagagcgggagcggctgcaggacctggaggagagagatgcctttgctgagcgggtgcggcagagggacaaggacaggaccagaaatgtgctggagaggagtgacaagaaggcctatgaggaggcccagaagaggctgaagatggccgaggaggacaggaaggccatggtgcctgagctgaggaagaagagcagaagagagtacctggccaagcgggagcgggagaagctggaggacctggaggccgagctggctgatgaggagttcctgtttggagatgtggagctgagcagacatgagcggcaggagctgaagtacaagagaagagtgcgggacctggcccgggagtacagagctgctggggagcaggagaagctggaggccaccaaccgctaccacatgcccaaggagacccggggccagcctgcccgggctgtggacctggtggaggaggagagcggggcccctggagaggagcagaggcgctgggaggaggcccggctgggcgccgccagcctgaagtttggagccagagatgctgccagccaggagcccaagtaccagctggtgctggaggaggaggagaccattgaatttgtgcgggccacccagctgcagggagatgaggagcccagcgccccacccaccagcacccaggcccagcagaaggagagcatccaggccgtgcggcgcagcctgcccgtcttccccttccgggaggagctgctggccgccatcgccaaccaccaggtgctgatcatcgagggggagaccggcagcggcaagaccacccagatcccccagtacctgtttgaggagggctacaccaacaagggcatgaagatcgcctgcacccagccccggcgggtggccgccatgtctgtggccgcccgggtggcccgggagatgggcgtgaagctgggcaatgaggtgggctacagcatccgctttgaggactgcaccagcgagaggacagtgctgcgctacatgacagatggcatgctgctgcgggagttcctgtctgagccagacctggccagctacagcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatgatgcccctgtgttccgcatccctggaagacgcttccctgtggacatcttctacaccaaggcccctgaggccgactacctggaggcctgtgtggtgtctgtgctgcagatccacgtgacccagcccccaggggacatcctggtgttcctgaccggccaggaggagattgaagctgcctgtgagatgctgcaggaccgctgccggcggctgggcagcaagatccgggagctgctggtgctgcccatctatgccaacctgcccagcgacatgcaggcccgcatcttccagcccaccccacctggggccaggaagtag

SEQ ID NO: 149563 - DNA, 3126 bp, Artificial Sequence; identical to SEQ ID NO: 149545
  Description of Artificial Sequence: Synthetic coding sequence

SEQ ID NO: 149564 - DNA, 1683 bp, Artificial Sequence; identical to SEQ ID NO: 149544
  Description of Artificial Sequence: Synthetic coding sequence

SEQ ID NO: 149565 - DNA, 1683 bp, Artificial Sequence; identical to SEQ ID NO: 149544
  Description of Artificial Sequence: Synthetic coding sequence

SEQ ID NO: 149566 - DNA, 567 bp, Artificial Sequence
  Description of Artificial Sequence: Synthetic coding sequence
atggagagccagcctgcccaggagtgcctgatgcagatgttcctgcccattgaaccagcctgctttgtggagtggctgggcaccagccccagccagctgggcgtggtgatggtggatgaggcccacgagaggaccctgcacacagacatcctgtttggcctcatcaaggatgtggcccgcttccggcctgagctgaaggtgctggtggccagcgccaccatggacacagcccgcttcagcaccttctttgatgatgcccctgtgttccgcatccctggccgccgcttccctgtggacatcttctacaccaaggcccctgaggccgactacctggaggcctgtgtggtgtctgtgctgcagatccacgtgacccagcccccaggggacatcctggtgttcctgaccggccaggaggagattgaggccgcctgtgagatgctgcaggaccgctgccggcggctgggcagcaagatccgggagctgctggtgctgcccatctatgccaacctgcccagcgacatgcaggcccgcatcttccagcccaccccacctggggccaggaagtag

SEQ ID NO: 149567 - DNA, 3126 bp, Artificial Sequence; identical to SEQ ID NO: 149545
  Description of Artificial Sequence: Synthetic coding sequence

SEQ ID NO: 149568 - DNA, 444 bp, Artificial Sequence
  Description of Artificial Sequence: Synthetic coding sequence
atggccaccccagctggcctggagcgctgggtgcaggatgagctgcacagcgtgctgggcctgtctgaaagacatgtggcccagttcctgattggaacagcccagcgctgcaccagcgctgaggagtttgtgcagaggctgcgggacacagacaccctggacctgagcggccctgcccgggactttgccctgcggctgtggaacaaggtgcccaggaaggctgtggtggagaagccagcccgggctgctgagcgggaggcccgggccctgctggagaagaacagaagctaccgcctgctggaggacagcgaggagagcagcgaggagaccgtgtcccgggccggcagcagcctgcagaagaagaggaagaagaggaagcacctgaggaagaagcgggaggaggaggaggaggaggaggccagcgagaagggcaagaagaagtag

SEQ ID NO: 149569 - DNA, 4110 bp, Artificial Sequence
  Description of Artificial Sequence: Synthetic coding sequence
atgggcggcaagaacaagaagcacaaggccccagctgctgctgtggtgcgggctgctgtgtctgccagccgggccaagtctgctgaggccggcattgctggggaggcccagagcaagaagcctgtgtccaggcctgccacagctgctgctgctgctgctggcagccgggagccccgggtgaagcagggccccaagatctacagcttcaacagcaccaatgacagcagcggccctgccaacctggacaagagcatcctgaaggtggtgatcaacaacaagctggagcagaggatcattggagtcatcaatgagcacaagaagcagaacaatgacaagggcatgatcagcggccgcctgacagccaagaagctgcaggacctgtacatggccctgcaggccttctccttcaagaccaaggacattgaagatgccatgaccaacaccctgctgtatggaggagacctgcacagcgccctggactggctgtgcctgaacctgagtgatgatgccctgcctgagggcttcagccaggagtttgaggagcagcagcccaagagccggcccaagttccagagcccccagatccaggccaccatcagcccccccctgcagcccaagaccaagacctatgaggaggaccccaagagcaagcccaagaaggaggagaagaacatggaggtgaacatgaaggagtggatcctgcgctatgcagagcagcagaatgaggaggagaagaatgaaaacagcaagagcctggaggaggaggagaagtttgaccccaatgaaagatacctgcacctggccgccaagctgctggatgccaaggagcaggccgccaccttcaagctggagaagaacaagcagggccagaaggaggcccaggagaagatcaggaagttccagcgggagatggagaccctggaggaccaccctgtgttcaacccagccatgaagatcagccaccagcagaatgaaaggaagaagccccctgtggccacagaaggagagagcgccctgaacttcaacctgtttgagaagtctgctgctgccacagaggaggagaaggacaagaagaaggagccccatgatgtgaggaactttgactacacagcccgctcctggacaggcaagagccccaagcagttcctgattgactgggtgaggaagaacctgcccaagagccccaaccccagctttgagaaggtgcctgtgggccgctactggaagtgccgggtgcgggtcatcaagtcagaagatgatgtgctggtggtgtgccccaccatcctgacagaagatggcatgcaggcccagcacctgggcgccaccctggccctgtaccgcctggtgaagggccagagcgtgcaccagctgctgccccccacctacagagatgtgtggctggagtggagcgatgctgagaagaagcgggaggagctgaacaagatggagaccaacaagccccgggacctcttcatcgccaagctgctgaacaagctgaagcagcagcagcagcagcagcagcagcacagcgagaacaagagagaaaattctgaggaccctgaggagagctgggagaacctggtgtctgatgaggacttcagcgccctgagcctggagagcgccaacgtggaggacctggagcctgtgaggaacctcttcaggaagctgcagagcacccccaagtaccagaagctgctgaaggagcggcagcagctgcctgtgttcaagcaccgggacagcatcgtggagaccctgaagaggcaccgggtggtggtggtggccggggagactggaagtggcaagagcacccaggtgccccacttcctgctggaggacctgctgctgaatgagtgggaggccagcaagtgcaacatcgtgtgcacccagccccggcgcatctctgctgtgtccctggccaacagagtgtgtgatgagctgggctgtgaaaatggacctgggggcaggaacagcctgtgtggctaccagatccgcatggagagccgggcctgtgagagcacccggctgctgtactgcaccaccggggtgctgctgaggaagctgcaggaggatggcctgctgagcaatgtgagccacgtgattgtggatgaggtgcatgagaggtctgtgcagagcgacttcctgctgatcatcctgaaggagatcctgcagaagagaagtgacctgcacctgatcctgatgtctgccaccgtggacagcgagaagttcagcacctacttcacccactgccccatcctgcgcatcagcggccgcagctaccctgtggaggtgttccacctggaggacatcatcgaggagactggatttgtgctggagaaggacagcgagtactgccagaagttcctggaggaggaggaggaggtgaccatcaacgtgaccagcaaggccggcggcatcaagaagtaccaggagtacatccctgtgcagacaggagcccacgccgacctgaaccccttctaccagaagtacagcagcaggacccagcacgccatcctgtacatgaacccccacaagatcaacctggacctgatcctggagctgctggcctacctggacaagagcccccagttcaggaacatcgagggcgctgtgctgatcttcctgcccggcctggcccacatccagcagctgtatgacctgctgagcaatgaccggcgcttctacagcgagcgctacaaggtgattgccctgcacagcatcctgagcacccaggaccaggccgccgccttcaccctgcccccacctggggtgaggaagatcgtgctggccaccaacattgctgagaccggcatcaccatcccagatgtggtgtttgtgattgacaccggccgcaccaaggagaacaagtaccacgagagcagccagatgagcagcctggtggagacctttgtgtccaaggccagcgccctgcagaggcagggccgggccggccgggtgagagatggcttctgcttcaggatgtacacccgggagagatttgagggcttcatggactacagcgtgcctgagatcctgcgggtgcccctggaggagctgtgcctgcacatcatgaagtgcaacctgggcagccctgaggacttcctgagcaaggccctggaccccccccagctgcaggtgatcagcaatgccatgaacctgctgaggaagatcggggcctgtgagctgaatgagcccaagctgacccccctgggccagcacctggccgccctgcctgtgaatgtgaagattggcaagatgctgatctttggagccatcttcggctgcctggaccctgtggccaccctggccgctgtgatgacagagaagagccccttcaccacccccatcggcaggaaggatgaagctgacctggccaagagcgccctggccatggctgacagcgaccacctgaccatctacaatgcctacctgggctggaagaaggcccggcaggagggcggctacagaagtgagatcacctactgcagaagaaacttcctgaacagaaccagcctgctgaccctggaggatgtgaagcaggagctgatcaagctggtgaaggccgccggcttcagcagcagcaccaccagcacctcctgggagggcaacagagccagccagaccctgtccttccaggagatcgccctgctgaaggctgtgctggtggccggcctgtatgacaacgtgggcaagatcatctacaccaagtctgtggatgtgacagagaagctggcctgcatcgtggagacagcccagggcaaggcccaggtgcaccccagctctgtgaacagagacctgcagacccacggctggctgctgtaccaggagaagatccgctatgcccgggtgtacctgcgggagaccaccctcatcacccccttccctgtgctgctgtttggaggagacatcgaggtgcagcaccgggagcggctgctgagcattgatggctggatctacttccaggcccctgtgaagattgctgtgatcttcaagcagctgcgggtgctgattgacagcgtgctgaggaagaagctggagaaccccaagatgagcctggagaatgacaagatcctgcagatcatcacagagctgatcaagacagagaacaactag

SEQ ID NO: 149570 - DNA, 1989 bp, Artificial Sequence
  Description of Artificial Sequence: Synthetic coding sequence
atggaggaggagggcctggagtgccccaacagcagcagcgagaagcgctacttccctgagagcctggacagcagtgatggagatgaggaggaggtgctggcctgtgaggacctggagctgaacccctttgatggcctgccctacagcagccgctactacaagctgctgaaggagcgggaggacctgcccatctggaaggagaagtacagcttcatggagaacctgctgcagaaccagatcgtcatcgtgtctggagatgccaagtgtgggaagagcgcccaggtgccccagtggtgtgccgagtactgcctgagcatccactaccagcacggcggcgtcatctgcacccaggtgcacaagcagacagtggtgcagctggccctgcgggtggctgatgagatggatgtgaacatcggccacgaggtgggctacgtgatcccctttgagaactgctgcaccaatgagaccatcctgcgctactgcacagatgacatgctgcagcgggagatgatgagcaaccccttcctgggcagctatggagtcatcatcctggatgacatccacgagaggagcatcgccacagatgtgctgctgggcctgctgaaggatgtgctgctggcccggcctgagctgaagctgatcatcaacagcagcccccacctgatcagcaagctgaacagctactatggaaatgtgcctgtgattgaggtgaagaacaagcaccctgtggaggtggtgtacctgtctgaggcccagaaggacagctttgagagcatcctgcggctcatctttgagatccaccacagcggggagaagggggacatcgtggtgttcctggcctgtgagcaggtgtacaacccccgcatccgggccaacagcctggtgatgcagcccatcagccagagccaggccgagatcaggaagcagatcctgggcagcagcagcagcggcaagttcttctgcctgtacacagaggagtttgccagcaaggacatgacccccctgaagccagctgagatgcaggaggccaacctgacctccatggtgctcttcatgaagagaattgatattgctggcctgggccactgtgacttcatgaacagacctgcccctgagagcctgatgcaggccctggaggacctggactacctggccgccctggacaatgatggcaacctgtctgaatttggcatcatcatgtctgagttccccctggacccccagctgagcaagagcatcctggccagctgtgaatttgactgtgtggatgaggtgctgaccatcgccgccatggtgacagcccccaactgcttcagccacgtgccccatggagctgaggaggccgccctgacctgctggaagaccttcctgcaccctgagggggaccacttcaccctcatcagcatctacaaggcctaccaggacaccaccctgaacagcagcagcgagtactgtgtggagaagtggtgccgggactacttcctgaactgcagcgccctgaggatggctgatgtgatccgggcagagctgctggagatcatcaagagaattgagctgccctatgcagagcccgccttcggcagcaaggagaacaccctgaacatcaagaaggccctgctgagcggctacttcatgcagatcgccagagatgtggatggcagcggcaactacctgatgctgacccacaagcaggtggcccagctgcaccccctgagcggctacagcatcaccaagaagatgcctgagtgggtgctcttccacaagttcagcatcagcgagaacaactacatccgcatcaccagcgagatcagccctgagctgttcatgcagctggtgccccagtactacttcagcaacctgcccccatctgagagcaaggacatcctgcagcaggtggtggaccacctgagccctgtgtccaccatgaacaaggagcagcagatgtgtgagacctgcccagagacagagcagcgctgcaccctgcagtag

SEQ ID NO: 149571 - DNA, 2232 bp, Artificial Sequence
  Description of Artificial Sequence: Synthetic coding sequence
atggaggaggagggcctggagtgccccaacagcagcagcgagaagcgctacttccctgagagcctggacagcagtgatggagatgaggaggaggtgctggcctgtgaggacctggagctgaacccctttgatggcctgccctacagcagccgctactacaagctgctgaaggagcgggaggacctgcccatctggaaggagaagtacagcttcatggagaacctgctgcagaaccagatcgtcatcgtgtctggagatgccaagtgtgggaagagcgcccaggtgccccagtggtgtgccgagtactgcctgagcatccactaccagcacggcggcgtcatctgcacccaggtgcacaagcagacagtggtgcagctggccctgcgggtggctgatgagatggatgtgaacatcggccacgaggtgggctacgtgatcccctttgagaactgctgcaccaatgagaccatcctgcgctactgcacagatgacatgctgcagcgggagatgatgagcaaccccttcctgggcagctatggagtcatcatcctggatgacatccacgagaggagcatcgccacagatgtgctgctgggcctgctgaaggatgtgctgctggcccggcctgagctgaagctgatcatcaacagcagcccccacctgatcagcaagctgaacagctactatggaaatgtgcctgtgattgaggtgaagaacaagcaccctgtggaggtggtgtacctgtctgaggcccagaaggacagctttgagagcatcctgcggctcatctttgagatccaccacagcggggagaagggggacatcgtggtgttcctggcctgtgagcaggacatcgagaaggtgtgtgaaacagtgtaccagggcagcaacctgaacccagacctgggggagctggtggtggtgcccctgtaccccaaggagaagtgcagcctcttcaagcccctggatgaaacagagaagcgctgccaggtgtaccagaggagagtggtgctgaccaccagcagcggggagttcctgatctggagcaacagcgtgcgctttgtgattgatgtgggcgtggagaggaggaaggtgtacaacccccgcatccgggccaacagcctggtgatgcagcccatcagccagagccaggccgagatcaggaagcagatcctgggcagcagcagcagcggcaagttcttctgcctgtacacagaggagtttgccagcaaggacatgacccccctgaagccagctgagatgcaggaggccaacctgacctccatggtgctcttcatgaagagaattgatattgctggcctgggccactgtgacttcatgaacagacctgcccctgagagcctgatgcaggccctggaggacctggactacctggccgccctggacaatgatggcaacctgtctgaatttggcatcatcatgtctgagttccccctggacccccagctgagcaagagcatcctggccagctgtgaatttgactgtgtggatgaggtgctgaccatcgccgccatggtgacagcccccaactgcttcagccacgtgccccacggggctgaggaggccgccctgacctgctggaagaccttcctgcaccctgagggggaccacttcaccctcatcagcatctacaaggcctaccaggacaccaccctgaacagcagcagcgagtactgtgtggagaagtggtgccgggactacttcctgaactgcagcgccctgaggatggctgatgtgatccgggcagagctgctggagatcatcaagagaattgagctgccctatgcagagcccgccttcggcagcaaagaaaacaccctgaacatcaagaaggccctgctgagcggctacttcatgcagatcgccagagatgtggatggcagcggcaactacctgatgctgacccacaagcaggtggcccagctgcaccccctgagcggctacagcatcaccaagaagatgcctgagtgggtgctcttccacaagttcagcatcagcgagaacaactacatccgcatcaccagcgagatcagccctgagctgttcatgcagctggtgccccagtactacttcagcaacctgccccccagcgagagcaaggacatcctgcagcaggtggtggaccacctgagccctgtgtccaccatgaacaaggagcagcagatgtgtgagacctgcccagagacagagcagcgctgcaccctgcagtag

SEQ ID NO: 149572 - DNA, 1104 bp, Artificial Sequence
  Description of Artificial Sequence: Synthetic coding sequence
atgcagcccatcagccagagccaggccgagatcaggaagcagatcctgggcagcagcagcagcggcaagttcttctgcctgtacacagaggagtttgccagcaaggacatgacccccctgaagccagctgagatgcaggaggccaacctgacctccatggtgctcttcatgaagagaattgatattgctggcctgggccactgtgacttcatgaacagacctgcccctgagagcctgatgcaggccctggaggacctggactacctggccgccctggacaatgatggcaacctgtctgaatttggcatcatcatgtctgagttccccctggacccccagctgagcaagagcatcctggccagctgtgaatttgactgtgtggatgaggtgctgaccatcgccgccatggtgacagcccccaactgcttcagccacgtgccccacggggctgaggaggccgccctgacctgctggaagaccttcctgcaccctgagggggaccacttcaccctcatcagcatctacaaggcctaccaggacaccaccctgaacagcagcagcgagtactgtgtggagaagtggtgccgggactacttcctgaactgcagcgccctgaggatggctgatgtgatccgggcagagctgctggagatcatcaagagaattgagctgccctatgcagagcccgccttcggcagcaaagaaaacaccctgaacatcaagaaggccctgctgagcggctacttcatgcagatcgccagagatgtggatggcagcggcaactacctgatgctgacccacaagcaggtggcccagctgcaccccctgagcggctacagcatcaccaagaagatgcctgagtgggtgctcttccacaagttcagcatcagcgagaacaactacatccgcatcaccagcgagatcagccctgagctgttcatgcagctggtgccccagtactacttcagcaacctgccccccagcgagagcaaggacatcctgcagcaggtggtggaccacctgagccctgtgtccaccatgaacaaggagcagcagatgtgtgagacctgcccagagacagagcagcgctgcaccctgcagtag

SEQ ID NO: 149573 - DNA, 339 bp, Artificial Sequence
  Description of Artificial Sequence: Synthetic coding sequence
atggaggaggagggcctggagtgccccaacagcagcagcgagaagcgctacttccctgagagcctggacagcagtgatggagatgaggaggaggtgctggcctgtgaggacctggagctgaacccctttgatggcctgccctacagcagccgctactacaagctgctgaaggagcgggaggacctgcccatctggaaggagaagtacagcttcatggagaacctgctgcagaaccagatcgtcatcgtgtctggagatgccaagtgtgggaagagcgcccaggtgccccagtggtgtgccgagtactgcctgagcatccactaccagcacggcggctag

SEQ ID NO: 149574 - DNA, 1935 bp, Artificial Sequence
  Description of Artificial Sequence: Synthetic coding sequence
atgaccattgaaattgacttcctgcagaagaagagcattgacagcaacccctatgacacagacaagatggctgctgagttcatccagcagttcaacaaccaggccttctctgtgggccagcagctggtgttctccttcaatgagaagctgtttggcctgctggtgaaggacatcgaggccatggaccccagcatcctgaagggggagcccgccaccgggaagaggcagaagattgaggtgggcctggtggtgggcaacagccaggtggcctttgagaaggccgagaacagcagcctgaacctgattggcaaggccaagaccaaggaaaatcggcagagcatcatcaacccagactggaactttgagaagatgggcatcggcggcctggacaaggagttcagtgacatcttccggcgggcctttgccagcagggtcttccccccagagatcgtggagcagatgggctgcaagcacgtgaagggcatcctgctgtatggccccccaggctgtgggaagaccctgctggcccggcagatcggcaagatgctgaatgcccgggagcccaaggtggtgaatggacctgagatcctgaacaagtatgtgggggagagcgaggccaacatcaggaagctgtttgctgatgctgaggaggagcagaggcggctgggcgccaacagcggcctgcacatcatcatctttgatgaaattgatgccatctgcaagcagaggggctccatggccggcagcactggagtgcatgacacagtggtgaaccagctgctgagcaagattgatggagtggagcagctgaacaacatcctggtgattggcatgaccaacagaccagacctgattgatgaggccctgctgcggcccggccgcctggaggtgaagatggagatcggcctgcctgatgagaagggccgcctgcagatcctgcacatccacacagccaggatgaggggccaccagctgctgtctgcagatgtggacatcaaggagctggccgtggagaccaagaacttctctggagctgagctggagggcctggtgcgggccgcccagagcacagccatgaacagacacatcaaggccagcaccaaggtggaggtggacatggagaaggccgagagcctgcaggtgaccaggggggacttcctggccagcctggagaatgacatcaagccagccttcggcaccaaccaggaggactatgccagctacatcatgaatggcatcatcaagtggggagaccctgtgaccagggtgctggatgatggagagctgctggtgcagcagaccaagaacagcgacaggacccccctggtgtctgtgctgctggagggccccccccacagcggcaagacagccctggccgccaagattgctgaggagagcaacttccccttcatcaagatctgcagcccagacaagatgattggcttcagcgagacagccaagtgccaggccatgaagaagatctttgatgatgcctacaagagccagctgagctgtgtggtggtggatgacatcgagcggctgctggactatgtgcccatcggcccccgcttcagcaacctggtgctgcaggccctgctggtgctgctgaagaaggccccaccccagggcaggaagctgctgatcatcggcaccaccagcaggaaggatgtgctgcaggagatggagatgctgaatgccttcagcaccaccatccacgtgcccaacatcgccaccggggagcagctgctggaggccctggagctgctgggcaacttcaaggacaaggagaggaccaccatcgcccagcaggtgaagggcaagaaggtgtggattggcatcaagaagctgctgatgctgattgagatgagcctgcagatggaccctgagtacagagtgaggaagttcctggccctgctgcgggaggagggcgcctag

SEQ ID NO: 149575 - DNA, 1452 bp, Artificial Sequence
  Description of Artificial Sequence: Synthetic coding sequence
atgcctgaggaggccggcttccccccagccaagcgcttccggcccggcagcggcccccccagcagagctggcagcttccccccaggccggcaggtggtgatgctgctgacagctggcagcggcggccggggcggcggcggcggccggcggcagcagccccccctggcccagcccagcgccagcccctacccagaggccgtggagctgcagaggaggagcctgcccatcttccaggcccggggccagctgctggcccagctgaggaacctggacaatgctgtgctgattggcagccccttcttcaccggccaccctggggtgccccactgggccggcggggacaggagccatgagcaggatgtgcccaggcactgcaaggccccaccccggcggctgccctgtgatgctggccccagctctgtgcggctgcctgccctgtgcacagctgcccccagcctgccccggggccccaaggacagcggcctggaggtgctggccgtgcagagggtgtccaagacccaggcctggcagaggacaggccgggccggcagagaagattctggcatctgctaccgcctgtacacagaagatgaatttgagaagtttgacaagatgacagtgcctgagatccagcgctgcaacctggcctctgtgatgctgcagctgctggccatgaaggtgcccaacgtgctgacctttgacttcatgagcaagcccagcccagaccacatccaggccgccatcgcccagctggacctgctgggcgccctggagcacaaggatgaccagctgaccctgacccccatgggcaggaagatggccgccttccccctggagcccaagtttgccaagaccatcctgatgagccccaagttccactgcacagaggagatcctgaccatcgtgtccctgctgtctgtggacagcgtgctgcacaacccccccagcagaagagaggaggtgcagggcgtgaggaagaagttcatcagcagcgagggggaccacatgaccctgctgaacatctaccgcaccttcaagaacctgggcggcaacaaggactggtgcaaggaaaattttgtgaacagcaagaacatgaccctggtggccgaggtgcgggcccagctgcgggacatctgcctgaagatgtccatgcccatcgccagcagcagaggagatgtggagagcgtgcggcgctgcctggcccacagcctcttcatgagcacagctgagctgcagccagatggcacctacgccaccacagacacccaccagcctgtggccatccaccccagctctgtgctcttccactgcaagccagcctgtgtggtgtacacagagctgctgtacaccaacaagtgctacatgagggacctgtgtgtgattgatgcccagtggctgtatgaagctgcccctgagtacttccggaggaagctgaggacagccaggaactag

SEQ ID NO: 149576 - DNA, 2940 bp, Artificial Sequence
  Description of Artificial Sequence: Synthetic coding sequence
atgtcctatgactaccaccagaactggggcagagatggcggccccaggagcagcggcggcggctacggcggcggccctgctgggggccacggcggcaacagaggcagcggcggcggcggcggcggcggcggcggcggccggggcggccggggccgccaccctggccacctgaagggccgggagatcggcatgtggtacgccaagaagcagggccagaagaacaaggaggccgagcggcaggagagagctgtggtgcacatggatgagcggcgggaggagcagatcgtgcagctgctgaacagcgtgcaggccaagaatgacaaggagagcgaggcccagatctcctggtttgcccctgaggaccacggctacggcacagaggtgtccaccaagaacaccccctgcagcgagaacaagctggacatccaggagaagaagctgatcaaccaggagaagaagatgttccgcatccggaacagaagctacatcgaccgggacagcgagtacctgctgcaggagaatgaaccagatggcaccctggaccagaagctgctggaggacctgcagaagaagaagaatgacctgcgctacatcgagatgcagcacttccgggagaagctgcccagctatggcatgcagaaggagctggtgaacctgattgacaaccaccaggtgaccgtcatctctggagagaccggctgtgggaagaccacccaggtgacccagttcatcctggacaactacatcgagcggggcaaaggaagtgcctgcagaattgtgtgcacccagccccggcgcatcagcgccatctctgtggccgagcgggtggccgctgagagagctgagagctgtggcagcggcaacagcacaggctaccagatccggctgcagagccggctgcccaggaagcagggcagcatcctgtactgcaccaccggcatcatcctgcagtggctgcagagcgacccctacctgagctctgtgagccacatcgtgctggatgagatccatgaaagaaacctgcagagtgatgtgctgatgacagtggtgaaggacctgctgaacttcagaagtgacctgaaggtgatcctgatgtctgccaccctgaatgctgagaagttcagcgagtacttcggcaactgccccatgatccacatccctggcttcaccttccctgtggtggagtacctgctggaggatgtgattgagaagatccgctacgtgcctgagcagaaggagcacaggagccagttcaagaggggcttcatgcagggccacgtgaaccggcaggagaaggaggagaaggaggccatctacaaggagcgctggccagactatgtgcgggagctgcggcggcgctacagcgccagcacagtggatgtgattgagatgatggaggatgacaaggtggacctgaacctgattgtggccctgatccgctacatcgtgctggaggaggaggatggagccatcctggtgttcctgcccggctgggacaacatcagcaccctgcatgacctgctgatgagccaggtgatgttcaagagtgacaagttcctgatcatccccctgcacagcctgatgcccaccgtgaaccagacccaggtgttcaagaggaccccacctggggtgaggaagatcgtgattgccaccaacattgctgagaccagcatcaccattgatgatgtggtgtatgtgattgatggcggcaagatcaaggagacccactttgacacccagaacaacatcagcaccatgtctgctgagtgggtgtccaaggccaatgccaagcagaggaagggccgggccggccgggtgcagcccggccactgctaccacctgtacaacggcctgcgggccagcctgctggatgactaccagctgcctgagatcctgcggacccccctggaggagctgtgcctgcagatcaagatcctgcggctgggcggcatcgcctacttcctgagccggctgatggacccccccagcaatgaggccgtgctgctgagcatccgccacctgatggagctgaatgccctggacaagcaggaggagctgacccccctgggcgtgcacctggcccggctgcctgtggagccccacatcggcaagatgatcctgtttggagccctcttctgctgcctggaccctgtgctgaccatcgccgccagcctgtccttcaaggacccctttgtgatccccctgggctgggaggaggcccggcggcggggcttccgctatgagaaggactactgctgggagtacttcctgagcagcaacaccctgcagatgctgcacaacatgaagggccagtttgctgagcacctgctgggcgccggctttgtgagcagcaggaaccccaaggaccctgagagcaacatcaacagcgacaatgagaagatcatcaaggccgtcatctgtgccggcctgtaccccaaggtggccaagatccggctgaacctgggcaagaagaggaagatggtgaaggtgtacaccaagacagatggcctggtggccgtgcaccccaagtctgtgaatgtggagcagacagacttccactacaactggctgatctaccacctgaagatgaggaccagcagcatctacctgtatgactgcacagaggtgagcccctactgcctgctcttcttcggcggggacatcagcatccagaaggacaatgaccaggagaccatcgctgtggatgagtggatcgtgttccagagccctgccagaattgcccacctggtgaaggagctgaggaaggagctggacatcctgctgcaggagaagattgagagcccccaccctgtggactggaatgacaccaagagccgggactgtgctgtgctgagcgccatcatcgacctgatcaagacccaggagaaggccaccccaagaaacttccccccacgcttccaggacggctactacagctag

SEQ ID NO: 149577 - DNA, 2985 bp, Artificial Sequence
  Description of Artificial Sequence: Synthetic coding sequence
atgtcctatgactaccaccagaactggggcagagatggcggccccaggagcagcggcggcggctacggcggcggccctgctgggggccacggcggcaacagaggcagcggcggcggcggcggcggcggcggcggcggccggggcggccggggccgccaccctggccacctgaagggccgggagatcggcatgtggtacgccaagaagcagggccagaagaacaaggaggccgagcggcaggagagagctgtggtgcacatggatgagcggcgggaggagcagatcgtgcagctgctgaacagcgtgcaggccaagaatgacaaggagagcgaggcccagatctcctggtttgcccctgaggaccacggctacggcacagaggtgtccaccaagaacaccccctgcagcgagaacaagctggacatccaggagaagaagctgatcaaccaggagaagaagatgttccgcatccggaacagaagctacatcgaccgggacagcgagtacctgctgcaggagaatgaaccagatggcaccctggaccagaagctgctggaggacctgcagaagaagaagaatgacctgcgctacatcgagatgcagcacttccgggagaagctgcccagctatggcatgcagaaggagctggtgaacctgattgacaaccaccaggtgaccgtcatctctggagagaccggctgtgggaagaccacccaggtgacccagttcatcctggacaactacatcgagcggggcaaaggaagtgcctgcagaattgtgtgcacccagccccggcgcatcagcgccatctctgtggccgagcgggtggccgctgagagagctgagagctgtggcagcggcaacagcacaggctaccagatccggctgcagagccggctgcccaggaagcagggcagcatcctgtactgcaccaccggcatcatcctgcagtggctgcagagcgacccctacctgagctctgtgagccacatcgtgctggatgagatccatgaaagaaacctgcagagtgatgtgctgatgacagtggtgaaggacctgctgaacttcagaagtgacctgaaggtgatcctgatgtctgccaccctgaatgctgagaagttcagcgagtacttcggcaactgccccatgatccacatccctggcttcaccttccctgtggtggagtacctgctggaggatgtgattgagaagatccgctacgtgcctgagcagaaggagcacaggagccagttcaagaggggcttcatgcagggccacgtgaaccggcaggagaaggaggagaaggaggccatctacaaggagcgctggccagactatgtgcgggagctgcggcggcgctacagcgccagcacagtggatgtgattgagatgatggaggatgacaaggtggacctgaacctgattgtggccctgatccgctacatcgtgctggaggaggaggatggagccatcctggtgttcctgcccggctgggacaacatcagcaccctgcatgacctgctgatgagccaggtgatgttcaagtctgtgaaccagacccaggtgttcaagaggaccccacctggggtgaggaagatcgtgattgccaccaacattgctgagaccagcatcaccattgatgatgtggtgtatgtgattgatggcggcaagatcaaggagacccactttgacacccagaacaacatcagcaccatgtctgctgagtgggtgtccaaggccaatgccaagcagaggaagggccgggccggccgggtgcagcccggccactgctaccacctgtacaacggcctgcgggccagcctgctggatgactaccagctgcctgagatcctgcggacccccctggaggagctgtgcctgcagatcaagatcctgcggctgggcggcatcgcctacttcctgagccggctgatggacccccccagcaatgaggccgtgctgctgagcatccgccacctgatggagctgaatgccctggacaagcaggaggagctgacccccctgggcgtgcacctggcccggctgcctgtggagccccacatcggcaagatgatcctgtttggagccctcttctgctgcctggaccctgtgctgaccatcgccgccagcctgtccttcaaggacccctttgtgatccccctgggcaaggagaagattgctgatgcccggaggaaggagctggccaaggacaccaggagtgaccacctgactgtggtgaatgcctttgagggctgggaggaggccaggagaagaggcttccgctatgagaaggactactgctgggagtacttcctgagcagcaacaccctgcagatgctgcacaacatgaagggccagtttgctgagcacctgctgggcgccggctttgtgagcagcaggaaccccaaggaccctgagagcaacatcaacagcgacaatgagaagatcatcaaggctgtgatctgtgccggcctgtaccccaaggtggccaagatccggctgaacctgggcaagaagaggaagatggtgaaggtgtacaccaagacagatggcctggtggccgtgcaccccaagtctgtgaatgtggagcagacagacttccactacaactggctgatctaccacctgaagatgaggaccagcagcatctacctgtatgactgcacagaggtgagcccctactgcctgctcttctttggaggagacatcagcatccagaaggacaatgaccaggagaccatcgctgtggatgagtggatcgtgttccagagccctgcccgcatcgcccacctggtgaaggagctgaggaaggagctggacatcctgctgcaggagaagattgagagcccccaccctgtggactggaatgacaccaagagccgggactgtgctgtgctgagcgccatcatcgacctgatcaagacccaggagaaggccacccccaggaacttccccccacgcttccaggacggctactacagctag

SEQ ID NO: 149578 - DNA, 3027 bp, Artificial Sequence
  Description of Artificial Sequence: Synthetic coding sequence
atgtcctatgactaccaccagaactggggcagagatggcggccccaggagcagcggcggcggctacggcggcggccctgctgggggccacggcggcaacagaggcagcggcggcggcggcggcggcggcggcggcggccggggcggccggggccgccaccctggccacctgaagggccgggagatcggcatgtggtacgccaagaagcagggccagaagaacaaggaggccgagcggcaggagagagctgtggtgcacatggatgagcggcgggaggagcagatcgtgcagctgctgaacagcgtgcaggccaagaatgacaaggagagcgaggcccagatctcctggtttgcccctgaggaccacggctacggcacagaggtgtccaccaagaacaccccctgcagcgagaacaagctggacatccaggagaagaagctgatcaaccaggagaagaagatgttccgcatccggaacagaagctacatcgaccgggacagcgagtacctgctgcaggagaatgaaccagatggcaccctggaccagaagctgctggaggacctgcagaagaagaagaatgacctgcgctacatcgagatgcagcacttccgggagaagctgcccagctatggcatgcagaaggagctggtgaacctgattgacaaccaccaggtgaccgtcatctctggagagaccggctgtgggaagaccacccaggtgacccagttcatcctggacaactacatcgagcggggcaaaggaagtgcctgcagaattgtgtgcacccagccccggcgcatcagcgccatctctgtggccgagcgggtggccgctgagagagctgagagctgtggcagcggcaacagcacaggctaccagatccggctgcagagccggctgcccaggaagcagggcagcatcctgtactgcaccaccggcatcatcctgcagtggctgcagagcgacccctacctgagctctgtgagccacatcgtgctggatgagatccatgaaagaaacctgcagagtgatgtgctgatgacagtggtgaaggacctgctgaacttcagaagtgacctgaaggtgatcctgatgtctgccaccctgaatgctgagaagttcagcgagtacttcggcaactgccccatgatccacatccctggcttcaccttccctgtggtggagtacctgctggaggatgtgattgagaagatccgctacgtgcctgagcagaaggagcacaggagccagttcaagaggggcttcatgcagggccacgtgaaccggcaggagaaggaggagaaggaggccatctacaaggagcgctggccagactatgtgcgggagctgcggcggcgctacagcgccagcacagtggatgtgattgagatgatggaggatgacaaggtggacctgaacctgattgtggccctgatccgctacatcgtgctggaggaggaggatggagccatcctggtgttcctgcccggctgggacaacatcagcaccctgcatgacctgctgatgagccaggtgatgttcaagagtgacaagttcctgatcatccccctgcacagcctgatgcccaccgtgaaccagacccaggtgttcaagaggaccccacctggggtgaggaagatcgtgattgccaccaacattgctgagaccagcatcaccattgatgatgtggtgtatgtgattgatggcggcaagatcaaggagacccactttgacacccagaacaacatcagcaccatgtctgctgagtgggtgtccaaggccaatgccaagcagaggaagggccgggccggccgggtgcagcccggccactgctaccacctgtacaacggcctgcgggccagcctgctggatgactaccagctgcctgagatcctgcggacccccctggaggagctgtgcctgcagatcaagatcctgcggctgggcggcatcgcctacttcctgagccggctgatggacccccccagcaatgaggccgtgctgctgagcatccgccacctgatggagctgaatgccctggacaagcaggaggagctgacccccctgggcgtgcacctggcccggctgcctgtggagccccacatcggcaagatgatcctgtttggagccctcttctgctgcctggaccctgtgctgaccatcgccgccagcctgtccttcaaggacccctttgtgatccccctgggcaaggagaagattgctgatgcccggaggaaggagctggccaaggacaccaggagtgaccacctgactgtggtgaatgcctttgagggctgggaggaggccaggagaagaggcttccgctatgagaaggactactgctgggagtacttcctgagcagcaacaccctgcagatgctgcacaacatgaagggccagtttgctgagcacctgctgggcgccggctttgtgagcagcaggaaccccaaggaccctgagagcaacatcaacagcgacaatgagaagatcatcaaggctgtgatctgtgccggcctgtaccccaaggtggccaagatccggctgaacctgggcaagaagaggaagatggtgaaggtgtacaccaagacagatggcctggtggccgtgcaccccaagtctgtgaatgtggagcagacagacttccactacaactggctgatctaccacctgaagatgaggaccagcagcatctacctgtatgactgcacagaggtgagcccctactgcctgctcttctttggaggagacatcagcatccagaaggacaatgaccaggagaccatcgctgtggatgagtggatcgtgttccagagccctgcccgcatcgcccacctggtgaaggagctgaggaaggagctggacatcctgctgcaggagaagattgagagcccccaccctgtggactggaatgacaccaagagccgggactgtgctgtgctgagcgccatcatcgacctgatcaagacccaggagaaggccacccccaggaacttccccccacgcttccaggacggctactacagctag

SEQ ID NO: 149579 - DNA, 2985 bp, Artificial Sequence
  Description of Artificial Sequence: Synthetic coding sequence
atgtcctatgactaccaccagaactggggcagagatggcggccccaggagcagcggcggcggctacggcggcggccctgctgggggccacggcggcaacagaggcagcggcggcggcggcggcggcggcggcggcggccggggcggccggggccgccaccctggccacctgaagggccgggagatcggcatgtggtacgccaagaagcagggccagaagaacaaggaggccgagcggcaggagagagctgtggtgcacatggatgagcggcgggaggagcagatcgtgcagctgctgaacagcgtgcaggccaagaatgacaaggagagcgaggcccagatctcctggtttgcccctgaggaccacggctacggcacagaggtgtccaccaagaacaccccctgcagcgagaacaagctggacatccaggagaagaagctgatcaaccaggagaagaagatgttccgcatccggaacagaagctacatcgaccgggacagcgagtacctgctgcaggagaatgaaccagatggcaccctggaccagaagctgctggaggacctgcagaagaagaagaatgacctgcgctacatcgagatgcagcacttccgggagaagctgcccagctatggcatgcagaaggagctggtgaacctgattgacaaccaccaggtgaccgtcatctctggagagaccggctgtgggaagaccacccaggtgacccagttcatcctggacaactacatcgagcggggcaaaggaagtgcctgcagaattgtgtgcacccagccccggcgcatcagcgccatctctgtggccgagcgggtggccgctgagagagctgagagctgtggcagcggcaacagcacaggctaccagatccggctgcagagccggctgcccaggaagcagggcagcatcctgtactgcaccaccggcatcatcctgcagtggctgcagagcgacccctacctgagctctgtgagccacatcgtgctggatgagatccatgaaagaaacctgcagagtgatgtgctgatgacagtggtgaaggacctgctgaacttcagaagtgacctgaaggtgatcctgatgtctgccaccctgaatgctgagaagttcagcgagtacttcggcaactgccccatgatccacatccctggcttcaccttccctgtggtggagtacctgctggaggatgtgattgagaagatccgctacgtgcctgagcagaaggagcacaggagccagttcaagaggggcttcatgcagggccacgtgaaccggcaggagaaggaggagaaggaggccatctacaaggagcgctggccagactatgtgcgggagctgcggcggcgctacagcgccagcacagtggatgtgattgagatgatggaggatgacaaggtggacctgaacctgattgtggccctgatccgctacatcgtgctggaggaggaggatggagccatcctggtgttcctgcccggctgggacaacatcagcaccctgcatgacctgctgatgagccaggtgatgttcaagagcggcaccatgagccaggtgttcaagaggaccccacctggggtgaggaagatcgtgattgccaccaacattgctgagaccagcatcaccattgatgatgtggtgtatgtgattgatggcggcaagatcaaggagacccactttgacacccagaacaacatcagcaccatgtctgctgagtgggtgtccaaggccaatgccaagcagaggaagggccgggccggccgggtgcagcccggccactgctaccacctgtacaacggcctgcgggccagcctgctggatgactaccagctgcctgagatcctgcggacccccctggaggagctgtgcctgcagatcaagatcctgcggctgggcggcatcgcctacttcctgagccggctgatggacccccccagcaatgaggccgtgctgctgagcatccgccacctgatggagctgaatgccctggacaagcaggaggagctgacccccctgggcgtgcacctggcccggctgcctgtggagccccacatcggcaagatgatcctgtttggagccctcttctgctgcctggaccctgtgctgaccatcgccgccagcctgtccttcaaggacccctttgtgatccccctgggcaaggagaagattgctgatgcccggaggaaggagctggccaaggacaccaggagtgaccacctgactgtggtgaatgcctttgagggctgggaggaggccaggagaagaggcttccgctatgagaaggactactgctgggagtacttcctgagcagcaacaccctgcagatgctgcacaacatgaagggccagtttgctgagcacctgctgggcgccggctttgtgagcagcaggaaccccaaggaccctgagagcaacatcaacagcgacaatgagaagatcatcaaggctgtgatctgtgccggcctgtaccccaaggtggccaagatccggctgaacctgggcaagaagaggaagatggtgaaggtgtacaccaagacagatggcctggtggccgtgcaccccaagtctgtgaatgtggagcagacagacttccactacaactggctgatctaccacctgaagatgaggaccagcagcatctacctgtatgactgcacagaggtgagcccctactgcctgctcttctttggaggagacatcagcatccagaaggacaatgaccaggagaccatcgctgtggatgagtggatcgtgttccagagccctgcccgcatcgcccacctggtgaaggagctgaggaaggagctggacatcctgctgcaggagaagattgagagcccccaccctgtggactggaatgacaccaagagccgggactgtgctgtgctgagcgccatcatcgacctgatcaagacccaggagaaggccacccccaggaacttccccccacgcttccaggacggctactacagctag

SEQ ID NO: 149580 - DNA, 3684 bp, Artificial Sequence
  Description of Artificial Sequence: Synthetic coding sequence
atgggagacaccagtgaagatgccagcatccaccggctggagggcacagacctggactgccaggtgggcggcctcatctgcaagagcaagtctgctgccagcgagcagcacgtgttcaaggccccagccccccggcccagcctgctgggcctggacctgctggccagcctgaagagaagagagcgggaggagaaggatgatggagaggacaagaagaagagcaaggtgagcagctacaaggactgggaggagagcaaggatgaccagaaggatgctgaggaggagggcggggaccaggccggccagaacatcaggaaggacagacactaccgcagcgcccgggtggagacccccagccaccctggaggagtgtctgaggagttctgggagaggagccggcagcgggagcgggagcggcgggagcacggcgtgtatgccagcagcaaggaggagaaggactggaagaaggagaagagccgggaccgggactatgacaggaagagggacagagatgagcgggacaggagccgccacagcagccgctcagaaagagatggcggcagcgagaggagcagcagaagaaatgaacctgagagccccaggcaccggcccaaggatgctgccacccccagccgcagcacctgggaggaggaggacagcggctacggcagcagccgccgcagccagtgggagagccccagccccacccccagctacagagacagcgagaggagccaccggctgagcacccgggaccgggacagatctgtgcggggcaagtacagtgatgacacccccctgcccacccccagctacaagtacaatgagtgggcagatgacagaagacacctgggcagcaccccccggctgagccggggccggggccggcgggaggagggggaggagggcatcagctttgacacagaggaggagcggcagcagtgggaggatgaccagaggcaggccgaccgggactggtacatgatggatgagggctatgatgagttccacaaccccctggcctacagcagtgaagattatgtgagaagaagagagcagcacctgcacaagcagaagcagaagaggatcagcgcccagaggcggcagatcaatgaagataatgaacgctgggagaccaacaggatgctgaccagcggcgtggtgcaccggctggaggtggatgaagattttgaagaagataatgctgccaaggtgcacctgatggtgcacaacctggtgccccccttcctggatggaagaattgtgttcaccaagcagcctgagcctgtgattcctgtgaaggatgccaccagtgacctggccatcatcgccaggaagggcagccagacagtgaggaagcaccgggagcagaaggagaggaagaaggcccagcacaagcactgggagctggccggcaccaagctgggggacatcatgggcgtgaagaaggaggaggagccagacaaggctgtgacagaagatggcaaggtggactacagaacagagcagaagtttgctgaccacatgaagaggaagtctgaggccagcagcgagtttgccaagaagaagagcatcctggagcagaggcagtacctgcccatctttgctgtgcagcaggagctgctgaccatcatccgggacaacagcatcgtcatcgtggtgggggagactggaagtggcaagaccacccagctgacccagtacctgcatgaagatggctacacagattatggcatgattggctgcacccagccccggcgggtggccgccatgtctgtggccaagagggtgtctgaggagatgggcggcaacctgggggaggaggtgggctacgccatccgctttgaggactgcaccagcgagaacaccctcatcaagtacatgacagatggcatcctgctgcgggagagcctgcgggaggccgacctggaccactacagcgccatcatcatggatgaggcccacgagaggagcctgaacacagatgtgctgtttggcctgctgcgggaggtggtggcccggcggagtgacctgaagctgattgtgaccagcgccaccatggatgctgagaagtttgctgccttctttggaaatgtgcccatcttccacatccctggccgcaccttccctgtggacatcctcttcagcaagaccccccaggaggactatgtggaggccgctgtgaagcagagcctgcaggtgcacctgagcggggcccctggggacatcctgatcttcatgcctggccaggaggacatcgaggtgaccagtgaccagatcgtggagcacctggaggagctggagaatgccccagccctggccgtgctgcccatctacagccagctgcccagcgacctgcaggccaagatcttccagaaggccccagatggagtgaggaagtgcatcgtggccaccaacattgctgagaccagcctgactgtggatggcatcatgtttgtgattgattctggctactgcaagctgaaggtgttcaaccccagaattggcatggatgccctgcagatctaccccatcagccaggccaatgccaaccagaggagcggccgggccggccgcacaggccctggccagtgcttccggctgtacacccagagcgcctacaagaatgagctgctgaccaccaccgtgcctgagatccagaggaccaacctggccaacgtggtgctgctgctgaagagcctgggcgtgcaggacctgctgcagttccacttcatggaccccccacctgaggacaacatgctgaacagcatgtaccagctgtggatcctgggcgccctggacaacacaggaggcctgaccagcacaggccgcctgatggtggagttccccctggaccctgccctgagcaagatgctgattgtgtcctgtgacatgggctgcagcagcgagatcctgctgattgtgtccatgctgtctgtgcctgccatcttctaccggcccaagggccgggaggaggagagtgaccagatccgggagaagtttgctgtgcctgagagtgaccacctgacctacctgaatgtgtacctgcagtggaagaacaacaactacagcaccatctggtgcaatgaccacttcatccacgccaaggccatgaggaaggtgcgggaggtgcgggcccagctgaaggacatcatggtgcagcagaggatgagcctggccagctgtggcacagactgggacatcgtgaggaagtgcatctgtgccgcctacttccaccaggccgccaagctgaagggcattggagaatatgtgaacatcagaacaggcatgccctgccacctgcaccccaccagcagcctgtttggcatgggctacaccccagactacatcgtgtaccacgagctggtgatgaccaccaaggagtacatgcagtgtgtgacagctgtggatggagagtggctggccgagctgggccccatgttctacagcgtgaagcaggccggcaagagccggcaggagaacagaagaagagccaaggaggaggccagcgccatggaggaggagatggccctggccgaggagcagctgcgggcccggcggcaggagcaggagaagaggagccccctgggctctgtgcgcagcaccaagatctacaccccaggcaggaaggagcagggcgagcccatgacccccaggaggaccccagccaggtttggcctgtag

SEQ ID NO: 149581 - DNA, 1620 bp, Artificial Sequence
  Description of Artificial Sequence: Synthetic coding sequence
atgggagacaccagtgaagatgccagcatccaccggctggagggcacagacctggactgccaggtgggcggcctcatctgcaagagcaagtctgctgccagcgagcagcacgtgttcaaggccccagccccccggcccagcctgctgggcctggacctgctggccagcctgaagagaagagagcgggaggagaaggatgatggagaggacaagaagaagagcaaggtgagcagctacaaggactgggaggagagcaaggatgaccagaaggatgctgaggaggagggcggggaccaggccaagatcttccagaaggccccagatggagtgaggaagtgcatcgtggccaccaacattgctgagaccagcctgactgtggatggcatcatgtttgtgattgattctggctactgcaagctgaaggtgttcaaccccagaattggcatggatgccctgcagatctaccccatcagccaggccaatgccaaccagaggagcggccgggccggccgcacaggccctggccagtgcttccggctgtacacccagagcgcctacaagaatgagctgctgaccaccaccgtgcctgagatccagaggaccaacctggccaacgtggtgctgctgctgaagagcctgggcgtgcaggacctgctgcagttccacttcatggaccccccacctgaggacaacatgctgaacagcatgtaccagctgtggatcctgggcgccctggacaacacaggaggcctgaccagcacaggccgcctgatggtggagttccccctggaccctgccctgagcaagatgctgattgtgtcctgtgacatgggctgcagcagcgagatcctgctgattgtgtccatgctgtctgtgcctgccatcttctaccggcccaagggccgggaggaggagagtgaccagatccgggagaagtttgctgtgcctgagagtgaccacctgacctacctgaatgtgtacctgcagtggaagaacaacaactacagcaccatctggtgcaatgaccacttcatccacgccaaggccatgaggaaggtgcgggaggtgcgggcccagctgaaggacatcatggtgcagcagaggatgagcctggccagctgtggcacagactgggacatcgtgaggaagtgcatctgtgccgcctacttccaccaggccgccaagctgaagggcattggagaatatgtgaacatcagaacaggcatgccctgccacctgcaccccaccagcagcctgtttggcatgggctacaccccagactacatcgtgtaccacgagctggtgatgaccaccaaggagtacatgcagtgtgtgacagctgtggatggagagtggctggccgagctgggccccatgttctacagcgtgaagcaggccggcaagagccggcaggagaacagaagaagagccaaggaggaggccagcgccatggaggaggagatggccctggccgaggagcagctgcgggcccggcggcaggagcaggagaagaggagccccctgggctctgtgcgcagcaccaagatctacaccccaggcaggaaggagcagggcgagcccatgacccccaggaggaccccagccaggtttggcctgtag

SEQ ID NO: 149582 - DNA, 2340 bp, Artificial Sequence
  Description of Artificial Sequence: Synthetic coding sequence
atgagccgcttccctgctgtggccggccgggccccccggcggcaggaggagggggagaggagccgggacctgcaggaggagcggctgtctgctgtgtgcatcgctgaccgggaggagaagggctgcaccagccaggagggcggcaccacccccaccttccccatccagaagcagaggaagaagatcatccaggccgtgcgggacaacagcttcctgattgtgactggaaacacaggcagcggcaagaccacccagctgcccaagtacctgtatgaagctggcttcagccagcacggcatgattggagtgacccagcccaggaaggtggccgccatctctgtggcccagagggtggccgaggagatgaagtgcaccctgggcagcaaggtgggctaccaggtgcgctttgatgactgcagcagcaaggagacagccatcaagtacatgacagatggctgcctgctgaagcacatcctgggggaccccaacctgaccaagttcagcgtcatcatcctggatgaggcccacgagaggaccctgaccacagacatcctgtttggcctgctgaagaagctgttccaggagaagagccccaacaggaaggagcacctgaaggtggtggtgatgtctgccaccatggagctggccaagctgagcgccttcttcggcaactgccccatctttgacatccctggccgcctgtaccctgtgcgggagaagttctgcaacctgattggcccccgggacagagaaaatacagcctacatccaggccatcgtgaaggtgaccatggacatccacctgaatgagatggccggggacatcctggtgttcctgaccggccagtttgaaattgagaagagctgtgagctgctcttccagatggccgagagcgtggactatgactatgatgtgcaggacaccaccctggatggcctgctgatcctgccctgctacggctccatgaccacagaccagcagaggcgcatcttcctgcccccacctcctggcatcagaaaatgtgtgatcagcaccaacatcagcgccaccagcctgaccattgatggcatccgctacgtggtggatggcggctttgtgaagcagctgaaccacaacccccggctgggcctggacatcctggaggtggtgcccatcagcaagtctgaggccctgcagaggagcggccgggccggccgcaccagcagcggcaagtgcttccgcatctacagcaaggacttctggaaccagtgcatgccagaccacgtgattcctgagatcaagaggaccagcctgacctctgtggtgctgaccctgaagtgcctggccatccatgatgtgatccgcttcccctacctggaccccccaaatgaaagactcatcctggaggccctgaagcagctgtaccagtgtgatgccatcgacaggagcggccacgtgacccggctgggcctgtccatggtggagttccccctgcccccccacctgacctgtgccgtcatcaaggccgccagcctggactgtgaggacctgctgctgcccatcgccgccatgctgtctgtggagaatgtgttcatccggcctgtggaccctgagtaccagaaggaggccgagcagaggcaccgggagctggccgccaaggccggcggcttcaatgactttgccaccctggccgtcatctttgagcagtgcaagagcagcggggccccagcctcctggtgccagaagcactggatccactggcgctgcctcttcagcgccttccgggtggaggcccagctgcgggagctgatcaggaagctgaagcagcagagcgacttccccaaggagacctttgagggccccaagcatgaggtgctgcggcgctgcctgtgtgccggctacttcaagaatgtggccaggagatctgtgggccgcaccttctgcaccatggatggccggggcagccctgtgcacatccaccccagcagcgccctgcacgagcaggagaccaagctggagtggatcatcttccacgaggtgctggtgaccaccaaggtgtatgccagaattgtgtgccccatccgctatgagtgggtgcgggacctgctgcccaagctgcacgagttcaatgcccatgacctgagctctgtggcccggcgggaggtgagagaagatgcccggcggcgctggaccaacaaggaaaatgtgaagcagctgaaggatggcatcagcaaggatgtgctgaagaagatgcagaggagaaatgatgacaagagcatcagtgatgcccgggcccgcttcctggagaggaagcagcagaggacccaggaccacagcgacaccaggaaggagaccggctag

SEQ ID NO: 149583 - DNA, 2169 bp, Artificial Sequence
  Description of Artificial Sequence: Synthetic coding sequence
atgagccgcttccctgctgtggccggccgggccccccggcggcaggaggagggggagaggagccgggacctgcaggaggagcggctgtctgctgtgtgcatcgctgaccgggaggagaagggctgcaccagccaggagggcggcaccacccccaccttccccatccagaagcagaggaagaagatcatccaggccgtgcgggacaacagcttcctgattgtgactggaaacacaggcagcggcaagaccacccagctgcccaagtacctgtatgaagctggcttcagccagcacggcatgattggagtgacccagcccaggaaggtggccgccatctctgtggcccagagggtggccgaggagatgaagtgcaccctgggcagcaaggtgggctaccaggtgcgctttgatgactgcagcagcaaggagacagccatcaagtacatgacagatggctgcctgctgaagcacatcctgggggaccccaacctgaccaagttcagcgtcatcatcctggatgaggcccacgagaggaccctgaccacagacatcctgtttggcctgctgaagaagctgttccaggagaagagccccaacaggaaggagcacctgaaggtggtggtgatgtctgccaccatggagctggccaagctgagcgccttcttcggcaactgccccatctttgacatccctggccgcctgtaccctgtgcgggagaagttctgcaacctgattggcccccgggacagagaaaatacagcctacatccaggccatcgtgaaggtgaccatggacatccacctgaatgagatggccggggacatcctggtgttcctgaccggccagtttgaaattgagaagagctgtgagctgctcttccagatggccgagagcgtggactatgactatgatgtgcaggacaccaccctggatggcctgctgatcctgccctgctacggctccatgaccacagaccagcagaggcgcatcttcctgcccccacctcctggcatcagaaaatgtgtgatcagcaccaacatcagcgccaccagcctgaccattgatggcatccgctacgtggtggatggcggctttgtgaagcagctgaaccacaacccccggctgggcctggacatcctggaggtggtgcccatcagcaagtctgaggccctgcagaggagcggccgggccggccgcaccagcagcggcaagtgcttccgcatctacagcaaggacttctggaaccagtgcatgccagaccacgtgattcctgagatcaagaggaccagcctgacctctgtggtgctgaccctgaagtgcctggccatccatgatgtgatccgcttcccctacctggaccccccaaatgaaagactcatcctggaggccctgaagcagctgtaccagtgtgatgccatcgacaggagcggccacgtgacccggctgggcctgtccatggtggagttccccctgcccccccacctgacctgtgccgtcatcaaggccgccagcctggactgtgaggacctgctgctgcccatcgccgccatgctgtctgtggagaatgtgttcatccggcctgtggaccctgagtaccagaaggaggccgagcagaggcaccgggagctggccgccaaggccggcggcttcaatgactttgccaccctggccgtcatctttgagcagtgcaagagcagcggggccccagcctcctggtgccagaagcactggatccactggcgctgcctcttcagcgccttccgggtggaggcccagctgcgggagctgatcaggaagctgaagcagcagagcgacttccccaaggagacctttgagggccccaagcatgaggtgctgcggcgctgcctgtgtgccggctacttcaagaatgtggccaggagatctgtgggccgcaccttctgcaccatggatggccggggcagccctgtgcacatccaccccagcagcgccctgcacgagcaggagaccaagctggagtggatcatcttccacgaggtgctggtgaccaccaaggtgtatgccagaattgtgtgccccatccgctatgagtgggtgcgggacctgctgcccaagctgcacgagttcaatgcccatgacctgagctctgtggcccggcgggaggtgtccaagatcaagctgttccagtag

SEQ ID NO: 149584 - DNA, 2196 bp, Artificial Sequence
  Description of Artificial Sequence: Synthetic coding sequence
atgattggagtgacccagcccaggaaggtggccgccatctctgtggcccagagggtggccgaggagatgaagtgcaccctgggcagcaaggtgggctaccaggtgcgctttgatgactgcagcagcaaggagacagccatcaagtacatgacagatggctgcctgctgaagcacatcctgggggaccccaacctgaccaagttcagcgtcatcatcctggatgaggcccacgagaggaccctgaccacagacatcctgtttggcctgctgaagaagctgttccaggagaagagccccaacaggaaggagcacctgaaggtggtggtgatgtctgccaccatggagctggccaagctgagcgccttctttggaaactgccccatctttgacatccctggccgcctgtaccctgtgcgggagaagttctgcaacctgattggcccccgggaccgggagaacacagcctacatccaggccatcgtgaaggtgaccatggacatccacctgaatgagatggccggggacatcctggtgttcctgaccggccagtttgaaattgagaagagctgtgagctgctcttccagatggccgagagcgtggactatgactatgatgtgcaggacaccaccctggatggcctgctgatcctgccctgctacggctccatgaccaccgtgtcccagaccagcctgacctttgtgacccacatccagatcatgaagcagatcagcgagaaccagcacagcctgaccggcctgaccatcgccggcatcactggagtgagccaccacgcccggcccaggaacatgacctgcaatgagaagctgaaccagcagaggcgcatcttcctgcccccacctcctggcatcagaaaatgtgtgatcagcaccaacatcagcgccaccagcctgaccattgatggcatccgctacgtggtggatggcggctttgtgaagcagctgaaccacaacccccggctgggcctggacatcctggaggtggtgcccatcagcaagtctgaggccctgcagaggagcggccgggccggccgcaccagcagcggcaagtgcttccgcatctacagcaaggacttctggaaccagtgcatgccagaccacgtgattcctgagatcaagaggaccagcctgacctctgtggtgctgaccctgaagtgcctggccatccatgatgtgatccgcttcccctacctggaccccccaaatgaaagactcatcctggaggccctgaagcagctgtaccagtgtgatgccatcgacaggagcggccacgtgacccggctgggcctgtccatggtggagttccccctgcccccccacctgacctgtgccgtcatcaaggccgccagcctggactgtgaggacctgctgctgcccatcgccgccatgctgtctgtggagaatgtgttcatccggcctgtggaccctgagtaccagaaggaggccgagcagaggcaccgggagctggccgccaaggccggcggcttcaatgactttgccaccctggccgtcatctttgagcagtgcaagagcagcggggccccagcctcctggtgccagaagcactggatccactggcgctgcctcttcagcgccttccgggtggaggcccagctgcgggagctgatcaggaagctgaagcagcagagcgacttccccaaggagacctttgagggccccaagcatgaggtgctgcggcgctgcctgtgtgccggctacttcaagaatgtggccaggagatctgtgggccgcaccttctgcaccatggatggccggggcagccctgtgcacatccaccccagcagcgccctgcacgagcaggagaccaagctggagtggatcatcttccacgaggtgctggtgaccaccaaggtgtatgccagaattgtgtgccccatccgctatgagtgggtgcgggacctgctgcccaagctgcacgagttcaatgcccatgacctgagctctgtggcccggcgggaggtgagagaagatgcccggcggcgctggaccaacaaggaaaatgtgaagcagctgaaggatggcatcagcaaggatgtgctgaagaagatgcagaggagaaatgatgacaagagcatcagtgatgcccgggcccgcttcctggagaggaagcagcagaggacccaggaccacagcgacaccaggaaggagaccggctag

SEQ ID NO: 149585 - DNA, 2109 bp, Artificial Sequence
  Description of Artificial Sequence: Synthetic coding sequence
atgagccgcttccctgctgtggccggccgggccccccggcggcaggaggagggggagaggagccgggacctgcaggaggagcggctgtctgctgtgtgcatcgctgaccgggaggagaagggctgcaccagccaggagggcggcaccacccccaccttccccatccagaagcagaggaagaagatcatccaggccgagacagccatcaagtacatgacagatggctgcctgctgaagcacatcctgggggaccccaacctgaccaagttcagcgtcatcatcctggatgaggcccacgagaggaccctgaccacagacatcctgtttggcctgctgaagaagctgttccaggagaagagccccaacaggaaggagcacctgaaggtggtggtgatgtctgccaccatggagctggccaagctgagcgccttctttggaaactgccccatctttgacatccctggccgcctgtaccctgtgcgggagaagttctgcaacctgattggcccccgggaccgggagaacacagcctacatccaggccatcgtgaaggtgaccatggacatccacctgaatgagatggccggggacatcctggtgttcctgaccggccagtttgaaattgagaagagctgtgagctgctcttccagatggccgagagcgtggactatgactatgatgtgcaggacaccaccctggatggcctgctgatcctgccctgctacggctccatgaccacagaccagcagaggcgcatcttcctgcccccacctcctggcatcagaaaatgtgtgatcagcaccaacatcagcgccaccagcctgaccattgatggcatccgctacgtggtggatggcggctttgtgaagcagctgaaccacaacccccggctgggcctggacatcctggaggtggtgcccatcagcaagtctgaggccctgcagaggagcggccgggccggccgcaccagcagcggcaagtgcttccgcatctacagcaaggacttctggaaccagtgcatgccagaccacgtgattcctgagatcaagaggaccagcctgacctctgtggtgctgaccctgaagtgcctggccatccatgatgtgatccgcttcccctacctggaccccccaaatgaaagactcatcctggaggccctgaagcagctgtaccagtgtgatgccatcgacagaagtggccacgtgacccggctgggcctgtccatggtggagttccccctgcccccccacctgacctgtgctgtgatcaaggccgccagcctggactgtgaggacctgctgctgcccatcgccgccatgctgtctgtggagaatgtgttcatccggcctgtggaccctgagtaccagaaggaggccgagcagaggcaccgggagctggccgccaaggccggcggcttcaatgactttgccaccctggccgtcatctttgagcagtgcaagagcagcggggccccagcctcctggtgccagaagcactggatccactggcgctgcctcttcagcgccttccgggtggaggcccagctgcgggagctgatcaggaagctgaagcagcagagcgacttccccaaggagacctttgagggccccaagcatgaggtgctgcggcgctgcctgtgtgccggctacttcaagaatgtggcccggcgctctgtgggccgcaccttctgcaccatggatggccggggcagccctgtgcacatccaccccagcagcgccctgcacgagcaggagaccaagctggagtggatcatcttccacgaggtgctggtgaccaccaaggtgtatgcccgcatcgtgtgccccatccgctatgagtgggtgcgggacctgctgcccaagctgcacgagttcaatgcccatgacctgagctctgtggcccggcgggaggtgcgggaggatgcccggcggcgctggaccaacaaggaaaatgtgaagcagctgaaggatggcatcagcaaggatgtgctgaagaagatgcagaggagaaatgatgacaagagcatcagtgatgcccgggcccgcttcctggagaggaagcagcagaggacccaggaccacagcgacaccaggaaggagactggatag

SEQ ID NO: 149586 - DNA, 3663 bp, Artificial Sequence
  Description of Artificial Sequence: Synthetic coding sequence
atggctgtggccgtggccatggccggggccctgattggcagcgagcccggccctgctgaggagctggccaagctggagtacctgagcctggtgtccaaggtgtgcacagagctggacaaccacctgggcatcaatgacaaggacctggccgagtttgtgatcagcctggccgagaagaacaccacctttgacaccttcaaggccagcctggtgaagaatggagctgagttcacagacagcctcatcagcaacctgctgcggctcatccagaccatgaggcccccagccaagcccagcaccagcaaggaccctgtggtgaagcccaagacagagaaggagaagctgaaggagctgtttcctgtgctgtgccagcctgacaaccccagcgtgaggaccatgctggatgaagatgatgtgaaggtggccgtggatgtgctgaaggagctggaggccctgatgcccagcgctgctggccaggagaagcagagagatgctgagcaccgggacaggaccaagaagaagaagaggagccgcagccgggacaggaacagagaccgggaccgggaccgggagaggaacagagaccgggaccacaagaggaggcacaggagccgcagccgcagccgcagcaggacccgggagaggaacaaggtgaagagccgctaccgcagccgcagccgcagccagagcccccccaaggacaggaaggaccgggacaagtatggagagaggaacctggaccgctggagggacaagcacgtggacaggcctcctcctgaggagcccaccatcggggacatctacaacgggaaggtgaccagcatcatgcagtttggctgctttgtgcagctggagggcctgaggaagcgctgggagggcctggtgcacatcagcgagctgcggcgggagggccgggtggccaacgtggctgatgtggtgtccaagggccagagggtgaaggtgaaggtgctgtccttcaccggcaccaagaccagcctgtccatgaaggatgtggaccaggagaccggggaggacctgaaccccaacagaagaagaaacctggtgggggagaccaatgaggagacctccatgagaaatccagaccggcccacccacctgagcctggtgtctgcccctgaggtggaggatgacagcctggagaggaagaggctgacccgcatcagtgaccctgagaagtgggagatcaagcagatgattgctgccaacgtgctgagcaaggaggagttcccagactttgatgaggagaccggcatcctgcccaaggtggatgatgaagaagatgaggacctggagattgagctggtggaggaggagccccccttcctgcggggccacaccaagcagagcatggacatgagccccatcaagatcgtgaagaacccagatggcagcctgagccaggccgccatgatgcagagcgccctggccaaggagcggcgggagctgaagcaggcccagcgggaggccgagatggacagcatccccatgggcctgaacaagcactgggtggaccccctgcctgatgctgagggccggcagattgctgccaacatgaggggcatcggcatgatgcccaatgacatccctgagtggaagaagcacgcctttggaggcaacaaggccagctatggcaagaagacccagatgagcatcctggagcagcgggagagcctgcccatctacaagctgaaggagcagctggtgcaggccgtgcatgacaaccagatcctgattgtgattggagagaccggcagcggcaagaccacccagatcacccagtacctggccgaggccggctacaccagccggggcaagattggctgcacccagcccaggagagtggccgccatgtctgtggccaagagggtgtctgaggagtttggctgctgcctgggccaggaggtgggctacaccatccgctttgaggactgcaccagccctgagaccgtcatcaagtacatgacagatggcatgctgctgagagaatgtctgattgatcctgacctgacccagtatgccatcatcatgctggatgaggcccacgagaggaccatccacacagatgtgctgtttggcctgctgaagaagacagtgcagaagaggcaggacatgaagctgattgtgaccagcgccaccctggatgctgtgaagttcagccagtacttctatgaggcccccatcttcaccatccctggccgcacctaccctgtggagatcctgtacaccaaggagcctgagacagactacctggatgccagcctcatcaccgtgatgcagatccacctgacagagcccccaggggacatcctggtgttcctgaccggccaggaggagattgacacagcctgtgagatcctgtatgaaagaatgaagagcctgggcccagatgtgcctgagctgatcatcctgcctgtgtacagcgccctgcccagcgagatgcagacccgcatctttgatcctgcccctcctggcagcaggaaggtggtgattgccaccaacattgctgagaccagcctgaccattgatggcatctactacgtggtggaccccggctttgtgaagcagaaggtgtacaacagcaagacaggaattgaccagctggtggtgacccccatcagccaggcccaggccaagcagagagctggccgggccggccgcacaggccctgggaagtgctaccgcctgtacacagagcgggcctacagagatgagatgctgaccaccaacgtgcctgagatccagaggaccaacctggccagcacagtgctgagcctgaaggccatgggcatcaatgacctgctgagctttgacttcatggatgccccacccatggagaccctcatcacagccatggagcagctgtacaccctgggcgccctggatgatgagggcctgctgacccggctgggccgcaggatggccgagttccccctggagcccatgctgtgcaagatgctgatcatgtctgtgcacctgggctgcagcgaggagatgctgaccatcgtgtccatgctgtctgtgcagaatgtgttctaccggcccaaggacaagcaggccctggccgaccagaagaaggccaagttccaccagacagaaggagaccacctgaccctgctggccgtgtacaacagctggaagaacaacaagttcagcaacccctggtgctatgagaacttcatccaggcccggagcctgcggcgggcccaggacatcaggaagcagatgctgggcatcatggacagacacaagctggatgtggtgtcctgtgggaagagcacagtgcgggtgcagaaggccatctgcagcggcttcttcagaaatgctgccaagaaggacccccaggagggctaccgcaccctgattgaccagcaggtggtgtacatccaccccagcagcgccctcttcaaccggcagcctgagtgggtggtgtaccacgagctggtgctgaccaccaaggagtacatgagggaggtgaccaccatcgacccccgctggctggtggagtttgccccagccttcttcaaggtgtctgaccccaccaagctgagcaagcagaagaagcagcagaggctggagcccctgtacaacagatatgaggagcccaatgcctggaggatcagccgggccttcagaagaagatag

SEQ ID NO: 149587 - DNA, 3546 bp, Artificial Sequence
  Description of Artificial Sequence: Synthetic coding sequence
atggctgtggccgtggccatggccggggccctgattggcagcgagcccggccctgctgaggagctggccaagctggagtacctgagcctggtgtccaaggtgtgcacagagctggacaaccacctgggcatcaatgacaaggacctggccgagtttgtgatcagcctggccgagaagaacaccacctttgacaccttcaaggccagcctggtgaagaatggagctgagttcacagacagcctcatcagcaacctgctgcggctcatccagaccatgaggcccccagccaagcccagcaccagcaaggaccctgtggtgaagcccaagacagagaaggagaagctgaaggagctgtttcctgtgctgtgccagcctgacaaccccagcgtgaggaccatgctggatgaagatgatgtgaaggtggccgtggatgtgctgaaggagctggaggccctgatgcccagcgctgctggccaggagaagcagagagatgctgagcaccgggacaggaccaagaagaagaagaggagccgcagccgggacaggaacagagaccgggaccgggaccgggagaggaacagagaccgggaccacaagaggaggcacaggagccgcagccgcagccgcagcaggacccgggagaggaacaaggtgaagagccgctaccgcagccgcagccgcagccagagcccccccaaggacaggaaggaccgggacaagtatggagagaggaacctggaccgctggagggacaagcacgtggacaggcctcctcctgaggagcccaccatcggggacatctacaacgggaaggtgaccagcatcatgcagtttggctgctttgtgcagctggagggcctgaggaagcgctgggagggcctggtgcacatcagcgagctgcggcgggagggccgggtggccaacgtggctgatgtggtgtccaagggccagagggtgaaggtgaaggtgctgtccttcaccggcaccaagaccagcctgtccatgaaggatgtggaccaggagaccggggaggacctgaaccccaacagaagaagaaacctggtgggggagaccaatgaggagacctccatgagaaatccagaccggcccacccacctgagcctggtgtctgcccctgaggtggaggatgacagcctggagaggaagaggctgacccgcatcagtgaccctgagaagtgggagatcaagcagatgattgctgccaacgtgctgagcaaggaggagttcccagactttgatgaggagaccggcatcctgcccaaggtggatgatgaagaagatgaggacctggagattgagctggtggaggaggagccccccttcctgcggggccacaccaagcagagcatggacatgagccccatcaagatcgtgaagaacccagatggcagcctgagccaggccgccatgatgcagagcgccctggccaaggagcggcgggagctgaagcaggcccagcgggaggccgagatggacagcatccccatgggcctgaacaagcactgggtggaccccctgcctgatgctgagggccggcagattgctgccaacatgaggggcatcggcatgatgcccaatgacatccctgagtggaagaagcacgcctttggaggcaacaaggccagctatggcaagaagacccagatgagcatcctggagcagcgggagagcctgcccatctacaagctgaaggagcagctggtgcaggccgtgcatgacaaccagatcctgattgtgattggagagaccggcagcggcaagaccacccagatcacccagtacctggccgaggccggctacaccagccggggcaagattggctgcacccagcccaggagagtggccgccatgtctgtggccaagagggtgtctgaggagtttggctgctgcctgggccaggaggtgggctacaccatccgctttgaggactgcaccagccctgagaccgtcatcaagtacatgacagatggcatgctgctgagagaatgtctgattgatcctgacctgacccagtatgccatcatcatgctggatgaggcccacgagaggaccatccacacagatgtgctgtttggcctgctgaagaagacagtgcagaagaggcaggacatgaagctgattgtgaccagcgccaccctggatgctgtgaagttcagccagtacttctatgaggcccccatcttcaccatccctggccgcacctaccctgtggagatcctgtacaccaaggagcctgagacagactacctggatgccagcctcatcaccgtgatgcagatccacctgacagagcccccaggggacatcctggtgttcctgaccggccaggaggagattgacacagcctgtgagatcctgtatgaaagaatgaagagcctgggcccagatgtgcctgagctgatcatcctgcctgtgtacagcgccctgcccagcgagatgcagacccgcatctttgatcctgcccctcctggcagcaggaaggtggtgattgccaccaacattgctgagaccagcctgaccattgatggcatctactacgtggtggaccccggctttgtgaagcagaaggtgtacaacagcaagacaggaattgaccagctggtggtgacccccatcagccaggcccaggccaagcagagagctggccgggccggccgcacaggccctgggaagtgctaccgcctgtacacagagcgggcctacagagatgagatgctgaccaccaacgtgcctgagatccagaggaccaacctggccagcacagtgctgagcctgaaggccatgggcatcaatgacctgctgagctttgacttcatggatgccccacccatggagaccctcatcacagccatggagcagctgtacaccctgggcgccctggatgatgagggcctgctgacccggctgggccgcaggatggccgagttccccctggagcccatgctgtgcaagatgctgatcatgtctgtgcacctgggctgcagcgaggagatgctgaccatcgtgtccatgctgtctgtgcagaatgtgttctaccggcccaaggacaagcaggccctggccgaccagaagaaggccaagttccaccagacagaaggagaccacctgaccctgctggccgtgtacaacagctggaagaacaacaagttcagcaacccctggtgctatgagaacttcatccaggcccggagcctgcggcgggcccaggacatcaggaagcagatgctgggcatcatggacagacacaagctggatgtggtgtcctgtgggaagagcacagtgcgggtgcagaaggccatctgcagcggcttcttcagaaatgctgccaagaaggacccccaggagggctaccgcaccctgattgaccagcaggtggtgtacatccaccccagcagcgccctcttcaaccggcagccagaatgtcccaagcacttcctgcctgtggtggccgtggccgtgtccctggagcagtgcctgagcaagtttgaggacctgaacaaggagctgggcctggtgacctgctag

SEQ ID NO: 149588 - DNA, 3813 bp, Artificial Sequence
  Description of Artificial Sequence: Synthetic coding sequence
atgggagatgtgaagaacttcctgtatgcctggtgtgggaagaggaagatgacccccagctatgagatccgggctgtgggcaacaagaaccggcagaagttcatgtgtgaggtgcaggtggagggctacaactacacaggcatgggcaacagcaccaacaagaaggatgcccagagcaatgctgcccgggactttgtgaactacctggtgcgcatcaatgagatcaagtctgaggaggtgcctgcctttggagtggccagccccccacccctgacagacaccccagacaccacagccaatgctgagggggacctgcccaccaccatgggcggccccctgcccccccacctggccctgaaggccgagaacaacagcgaggtgggcgccagcggctacggcgtgcccggccccacctgggacagaggagccaacctgaaggactactacagcaggaaggaggagcaggaggtgcaggccaccctggagagcgaggaggtggacctgaatgccggcctgcacggcaactggaccctggagaatgccaaggcccggctgaaccagtacttccagaaggagaagatccagggcgagtacaagtacacccaggtgggccctgaccacaacagaagcttcatcgccgagatgaccatctacatcaagcagctgggccgccgcatctttgcccgggagcacggcagcaacaagaagctggccgcccagagctgtgccctgagcctggtgcggcagctgtaccacctgggcgtggtggaggcctacagcggcctgaccaagaagaaggagggggagaccgtggagccctacaaggtgaacctgagccaggacctggagcaccagctgcagaacatcatccaggagctgaacctggagatcctgcccccacctgaggaccccagcgtgcctgtggccctgaacatcggcaagctggcccagtttgagcccagccagaggcagaaccaggtgggcgtggtgccctggagccccccccagagcaactggaacccctggaccagcagcaacattgatgagggccccctggcctttgccaccccagagcagatctccatggacctgaagaatgagctgatgtaccagctggagcaggaccatgacctgcaggccatcctgcaggagcgggagctgctgcctgtgaagaagtttgaaagtgagatcctggaggccatcagccagaacagcgtggtgatcatccggggggccaccggctgcggcaagaccacccaggtgccccagttcatcctggatgacttcatccagaatgacagagctgctgagtgcaacatcgtggtgacccagccccggcgcatctctgctgtgtctgtggccgagcgggtggcctttgagcggggggaggagcccgggaagagctgtggctacagcgtgcgctttgagagcatcctgccccggccccacgccagcatcatgttctgcaccgtgggcgtgctgctgaggaagctggaggccggcatccggggcatcagccacgtgattgtggatgagatccacgagcgggacatcaacacagacttcctgctggtggtgctgagagatgtggtgcaggcctacccagaggtgagaattgtgctgatgtctgccaccatcgacacctccatgttctgtgagtacttcttcaactgccccatcatcgaggtgtatggccgcacctaccctgtgcaggagtacttcctggaggactgcatccagatgacccactttgtgcccccacccaaggacaagaagaagaaggacaaggatgatgatggaggagaagatgatgatgccaactgcaacctgatctgtggagatgaatatggccctgagacccggctgtccatgagccagctgaatgagaaggagaccccatttgagctgattgaggccctgctgaagtacatcgagaccctgaatgtgcctggagctgtgctggtgttcctgcccggctggaacctgatctacaccatgcagaagcacctggagatgaacccccacttcggcagccaccgctaccagatcctgcccctgcacagccagatcccccgggaggagcagaggaaggtgtttgatcctgtgcctgtgggcgtgaccaaggtgatcctgagcaccaacattgctgagaccagcatcaccatcaatgatgtggtgtatgtgattgacagctgcaagcagaaggtgaagctgttcaccgcccacaacaacatgaccaactatgccaccgtgtgggccagcaagaccaacctggagcagaggaagggccgggccggccgggtgcggcccggcttctgcttccacctgtgcagccgggccaggtttgagcggctggagacccacatgaccccagagatgttccgcacccccctgcatgaaattgccctgagcatcaagctgctgcggctgggcggcatcggccagttcctggccaaggccatcgagcccccacccctggatgctgtgattgaggccgagcacaccctgcgggagctggatgccctggatgccaatgatgagctgacccccctgggccgcatcctggccaagctgcccatcgagcccaggtttgggaagatgatgatcatgggctgcatcttctacgtgggagatgccatctgcaccatcgctgctgccacctgcttccctgagcccttcatcaatgaaggcaagaggctgggctacatccacaggaactttgctggcaaccgcttcagtgaccacgtggccctgctgagcgtcttccaggcctgggatgatgccaggatgggcggggaggaggccgagatccgcttctgtgagcacaagaggctgaacatggccaccctgaggatgacctgggaggccaaggtgcagctgaaggagatcctgatcaacagcggcttccctgaggactgcctgctgacccaggtgttcaccaacacaggccctgacaacaacctggatgtggtgatcagcctgctggcctttggagtgtaccccaacgtgtgctaccacaaggagaagaggaagatcctgaccacagagggcagaaatgccctgatccacaagagctctgtgaactgccccttcagcagccaggacatgaagtaccccagccccttctttgtgtttggagagaagatccgcacccgggccatcagcgccaagggcatgaccctggtgacccccctgcagctgctgctgtttgccagcaagaaggtgcagagtgatggccagatcgtgctggtggatgactggatcaagctgcagatcagccatgaggccgccgcctgcatcaccggcctgcgggccgccatggaggccctggtggtggaggtgaccaagcagcctgccatcatcagccagctggaccctgtgaatgaaagaatgctgaacatgatccggcagatcagccggcccagcgctgctggcatcaacctgatgattggcagcaccaggtatggagatggccccaggcctcccaagatggcccgctatgacaatggaagtggctaccgccggggcggcagcagctacagcggcggcggctatggaggcggctacagcagcggcggctacggcagcggcggctatggaggcagcgccaacagcttccgggccggctacggggccggcgtgggcggcggctaccggggcgtgtcccggggcggcttccggggcaacagcggcggggactaccggggccccagcggcggctaccggggcagcggcggcttccagaggggcggcggccgcggggcctacggcaccggctacttcggccagggccggggcggcggcggctactag

SEQ ID NO: 149589 - DNA, 1800 bp, Artificial Sequence
  Description of Artificial Sequence: Synthetic coding sequence
atgggagatgtgaagaacttcctgtatgcctggtgtgggaagaggaagatgacccccagctatgagatccgggctgtgggcaacaagaaccggcagaagttcatgtgtgaggtgcaggtggagggctacaactacacaggcatgggcaacagcaccaacaagaaggatgcccagagcaatgctgcccgggactttgtgaactacctggtgcgcatcaatgagatcaagtctgaggaggtgcctgcctttggagtggccagccccccacccctgacagacaccccagacaccacagccaatgctgagggggacctgcccaccaccatgggcggccccctgcccccccacctggccctgaaggccgagaacaacagcgaggtgggcgccagcggctacggcgtgcccggccccacctgggacagaggagccaacctgaaggactactacagcaggaaggaggagcaggaggtgcaggccaccctggagagcgaggaggtggacctgaatgccggcctgcacggcaactggaccctggagaatgccaaggcccggctgaaccagtacttccagaaggagaagatccagggcgagtacaagtacacccaggtgggccctgaccacaacagaagcttcatcgccgagatgaccatctacatcaagcagctgggccgccgcatctttgcccgggagcacggcagcaacaagaagctggccgcccagagctgtgccctgagcctggtgcggcagctgtaccacctgggcgtggtggaggcctacagcggcctgaccaagaagaaggagggggagaccgtggagccctacaaggtgaacctgagccaggacctggagcaccagctgcagaacatcatccaggagctgaacctggagatcctgcccccacctgaggaccccagcgtgcctgtggccctgaacatcggcaagctggcccagtttgagcccagccagaggcagaaccaggtgggcgtggtgccctggagccccccccagagcaactggaacccctggaccagcagcaacattgatgagggccccctggcctttgccaccccagagcagatctccatggacctgaagaatgagctgatgtaccagctggagcaggaccatgacctgcaggccatcctgcaggagcgggagctgctgcctgtgaagaagtttgaaagtgagatcctggaggccatcagccagaacagcgtggtgatcatccggggggccaccggctgcggcaagaccacccaggtgccccagttcatcctggatgacttcatccagaatgacagagctgctgagtgcaacatcgtggtgacccagccccggcgcatctctgctgtgtctgtggccgagcgggtggcctttgagcggggggaggagcccgggaagagctgtggctacagcgtgcgctttgagagcatcctgccccggccccacgccagcatcatgttctgcaccgtgggcgtgctgctgaggaagctggaggccggcatccggggcatcagccacgtgattgtggatgagatccacgagcgggacatcaacacagacttcctgctggtggtgctgagagatgtggtgcaggcctacccagaggtgagaattgtgctgatgtctgccaccatcgacacctccatgttctgtgagtacttcttcaactgccccatcatcgaggtgtatggccgcacctaccctgtgcaggagtacttcctggaggactgcatccagatgacccactttgtgcccccacccaaggacaagaagaagaaggacaagaagaagaagtag

SEQ ID NO: 149590 - DNA, 1197 bp, Artificial Sequence
  Description of Artificial Sequence: Synthetic coding sequence
atgatgctgaagggcatcaccaggctcatcagccgcatccacaagctggaccccggccgcttcctgcacatgggcacccaggcccggcagagcattgctgcccacctggacaaccaggtgcctgtggagagcccccgggccatcagcaggaccaatgaaaatgaccctgccaagcatggagaccagcacgagggccagcactacaacatcagcccccaggacctggagaccgtcttcccccacggcctgccccccaggtttgtgatgcaggtgaagaccttcagcgaggcctgcctgatggtgaggaagccagccctggagctgctgcactacctgaagaacaccagctttgcctacccagccatccgctacctgctgtatggagagaagggcaccgggaagaccctgagcctgtgccacgtgatccacttctgtgccaagcaggactggctgatcctgcacatcccagatgcccacctgtgggtgaagaactgccgggacctgctgcagagcagctacaacaagcagagatttgaccagcccctggaggccagcacctggctgaagaacttcaagaccaccaatgaacgcttcctgaaccagatcaaggtgcaggagaagtatgtgtggaacaagcgggagagcacagagaagggcagccccctgggggaggtggtggagcagggcatcaccagggtgagaaatgccacagatgctgtgggcatcgtgctgaaggagctgaagaggcagagcagcctgggcatgttccacctgctggtggccgtggatggcatcaatgccctgtggggccgcaccaccctgaagcgggaggacaagagccccatcgcccctgaggagctggccctggtgcacaacctgaggaagatgatgaagaatgactggcacggcggggccatcgtgtctgccctgagccagacaggcagcctcttcaagcccaggaaggcctacctgccccaggagctgctgggcaaggagggctttgatgccctggaccccttcatccccatcctggtgagcaactacaaccccaaggagtttgagagctgcatccagtactacctggagaacaactggctgcagcacgagaaggcccccacagaggagggcaagaaggagctgctcttcctgagcaatgccaaccccagcctgctggagcggcactgtgcctacctgtag

SEQ ID NO: 149591 - DNA, 1197 bp, Artificial Sequence; identical to SEQ ID NO: 149590
  Description of Artificial Sequence: Synthetic coding sequence

SEQ ID NO: 149592 - DNA, 1095 bp, Artificial Sequence
  Description of Artificial Sequence: Synthetic coding sequence
atgatgctgaagggcatcaccaggctcatcagccgcatccacaagctggaccccggccgcttcctgcacatgggcacccaggcccggcagagcattgctgcccacctggacaaccaggtgcctgtggagagcccccgggccatcagcaggaccaatgaaaatgaccctgtgaagaccttcagcgaggcctgcctgatggtgaggaagccagccctggagctgctgcactacctgaagaacaccagctttgcctacccagccatccgctacctgctgtatggagagaagggcaccgggaagaccctgagcctgtgccacgtgatccacttctgtgccaagcaggactggctgatcctgcacatcccagatgcccacctgtgggtgaagaactgccgggacctgctgcagagcagctacaacaagcagagatttgaccagcccctggaggccagcacctggctgaagaacttcaagaccaccaatgaacgcttcctgaaccagatcaaggtgcaggagaagtatgtgtggaacaagcgggagagcacagagaagggcagccccctgggggaggtggtggagcagggcatcaccagggtgagaaatgccacagatgctgtgggcatcgtgctgaaggagctgaagaggcagagcagcctgggcatgttccacctgctggtggccgtggatggcatcaatgccctgtggggccgcaccaccctgaagcgggaggacaagagccccatcgcccctgaggagctggccctggtgcacaacctgaggaagatgatgaagaatgactggcacggcggggccatcgtgtctgccctgagccagacaggcagcctcttcaagcccaggaaggcctacctgccccaggagctgctgggcaaggagggctttgatgccctggaccccttcatccccatcctggtgagcaactacaaccccaaggagtttgagagctgcatccagtactacctggagaacaactggctgcagcacgagaaggcccccacagaggagggcaagaaggagctgctcttcctgagcaatgccaaccccagcctgctggagcggcactgtgcctacctgtag

SEQ ID NO: 149593 - DNA, 1074 bp, Artificial Sequence
  Description of Artificial Sequence: Synthetic coding sequence
atgatgctgaagggcatcaccaggctcatcagccgcatccacaaggccaagcacggggaccagcacgagggccagcactacaacatcagcccccaggacctggagaccgtcttcccccacggcctgcccccaagatttgtgatgcaggtgaagaccttcagcgaggcctgcctgatggtgaggaagccagccctggagctgctgcactacctgaagaacaccagctttgcctacccagccatccgctacctgctgtatggagagaagggcaccgggaagaccctgagcctgtgccacgtgatccacttctgtgccaagcaggactggctgatcctgcacatcccagatgcccacctgtgggtgaagaactgccgggacctgctgcagagcagctacaacaagcagagatttgaccagcccctggaggccagcacctggctgaagaacttcaagaccaccaatgaacgcttcctgaaccagatcaaggtgcaggagaagtatgtgtggaacaagcgggagagcacagagaagggcagccccctgggggaggtggtggagcagggcatcaccagggtgagaaatgccacagatgctgtgggcatcgtgctgaaggagctgaagaggcagagcagcctgggcatgttccacctgctggtggccgtggatggcatcaatgccctgtggggccgcaccaccctgaagcgggaggacaagagccccatcgcccctgaggagctggccctggtgcacaacctgaggaagatgatgaagaatgactggcatggaggagccatcgtgtctgccctgagccagacaggcagcctcttcaagcccaggaaggcctacctgccccaggagctgctgggcaaggagggctttgatgccctggaccccttcatccccatcctggtgagcaactacaaccccaaggagtttgagagctgcatccagtactacctggagaacaactggctgcagcacgagaaggcccccacagaggagggcaagaaggagctgctcttcctgagcaatgccaaccccagcctgctggagcggcactgtgcctacctgtag

SEQ ID NO: 149594 - DNA, 1047 bp, Artificial Sequence
  Description of Artificial Sequence: Synthetic coding sequence
atggccggcctgaagaggcgggccagccaggtgtggccagaggagcacggggagcaggagcacggcctgtacagcctgcacaggatgtttgacatcgtgggcacccacctgacccacagagatgtgcgggtgctgtccttcctgtttgtggatgtgattgatgaccacgagcggggcctcatcagaaatggccgggacttcctgctggccctggagcggcagggccgctgtgatgagagcaacttccggcaggtgctgcagctgctgcgcatcatcaccaggcatgacctgctgccctacgtgaccctgaagagaagaagagctgtgtgcccagacctggtggacaagtacctggaggagaccagcatccgctacgtgaccccccgggccctgagtgaccctgagccccggcccccccagcccagcaagacagtgcccccccactaccctgtggtgtgctgccccaccagcggcccccagatgtgcagcaagaggcctgcccggggccgggccaccctgggcagccagaggaagaggaggaagtctgtgaccccagaccccaaggagaagcagacctgtggggaggaggtgcagggcttccagcgctggagccggctggagggggagtacaaggagctgctgggccactgggccgtgtatgccatccagtacatccggctgcgggtgcgggcagagtactgccagcacgagacagccctgcagggcaatgtgttcagcaacaagcaggaccccctggagcggcagtttgagcgcttcaaccaggccaacaccatcctgaagagccgggacctgggcagcatcatctgtgacatcaagttcagcgagctgacctacctggatgccttctggagggactacatcaatggcagcctgctggaggccctgaagggcgtcttcatcacagacagcctgaagcaggccgtgggccacgaggccatcaagctgctggtgaatgtggatgaagaagattatgagctgggccggcagaagctgctgaggaacctgatgctgcaggccctgccctag

SEQ ID NO: 149595 - DNA, 957 bp, Artificial Sequence
  Description of Artificial Sequence: Synthetic coding sequence
atggccggcctgaagaggcgggccagccaggtgtggccagaggagcacggggagcaggagcacggcctgtacagcctgcacaggatgtttgacatcgtgggcacccacctgacccacagagatgtgcgggtgctgtccttcctgtttgtggatgtgattgatgaccacgagcggggcctcatcagaaatggccgggacttcctgctggccctggagcggcagggccgctgtgatgagagcaacttccggcaggtgctgcagctgctgcgcatcatcaccaggcatgacctgctgccctacgtgaccctgaagagaagaagagctgtgtgcccagacctggtggacaagtacctggaggagaccagcatccgctacgtgaccccccgggccctgagtgaccctgagccccggcccccccagcccagcaagacagtgcccccccactaccctgtggtgtgctgccccaccagcggcccccagatgtgcagcaagaggcctgcccggggccgggccaccctgggcagccagaggaagaggaggaagtctgtgaccccagaccccaaggagaagcagacctgtgacatccggctgcgggtgcgggcagagtactgccagcacgagacagccctgcagggcaatgtgttcagcaacaagcaggaccccctggagcggcagtttgagcgcttcaaccaggccaacaccatcctgaagagccgggacctgggcagcatcatctgtgacatcaagttcagcgagctgacctacctggatgccttctggagggactacatcaatggcagcctgctggaggccctgaagggcgtcttcatcacagacagcctgaagcaggccgtgggccacgaggccatcaagctgctggtgaatgtggatgaagaagattatgagctgggccggcagaagctgctgaggaacctgatgctgcaggccctgccctag

SEQ ID NO: 149596 - DNA, 1047 bp, Artificial Sequence; identical to SEQ ID NO: 149594
  Description of Artificial Sequence: Synthetic coding sequence

SEQ ID NO: 149597 - DNA, 957 bp, Artificial Sequence; identical to SEQ ID NO: 149595
  Description of Artificial Sequence: Synthetic coding sequence

SEQ ID NO: 149598 - DNA, 828 bp, Artificial Sequence
  Description of Artificial Sequence: Synthetic coding sequence
atggccggcctgaagaggcgggccagccaggtgtggccagaggagcacggggagcaggagcacggcctgtacagcctgcacaggatgtttgacatcgtgggcacccacctgacccacagagatgtgctgcagctgctgcgcatcatcaccaggcatgacctgctgccctacgtgaccctgaagagaagaagagctgtgtgcccagacctggtggacaagtacctggaggagaccagcatccgctacgtgaccccccgggccctgagtgaccctgagcccaggcctccccagcccagcaagacagtgcccccccactaccctgtggtgtgctgccccaccagcggcccccagatgtgcagcaagaggcctgcccggggccgggccaccctgggcagccagaggaagaggaggaagtctgtgaccccagaccccaaggagaagcagacctgtgacatccggctgcgggtgcgggcagagtactgccagcatgaaacagccctgcagggcaatgtgttcagcaacaagcaggaccccctggagcggcagtttgagcgcttcaaccaggccaacaccatcctgaagagccgggacctgggcagcatcatctgtgacatcaagttcagcgagctgacctacctggatgccttctggagggactacatcaatggcagcctgctggaggccctgaagggcgtcttcatcacagacagcctgaagcaggccgtgggccacgaggccatcaagctgctggtgaatgtggatgaggaggactatgagctgggccggcagaagctgctgaggaacctgatgctgcaggccctgccctag

SEQ ID NO: 149599 - DNA, 957 bp, Artificial Sequence; identical to SEQ ID NO: 149595
  Description of Artificial Sequence: Synthetic coding sequence

SEQ ID NO: 149600 - DNA, 957 bp, Artificial Sequence; identical to SEQ ID NO: 149595
  Description of Artificial Sequence: Synthetic coding sequence

SEQ ID NO: 149601 - DNA, 1917 bp, Artificial Sequence
  Description of Artificial Sequence: Synthetic coding sequence
atggacctgtggcagctgctgctgaccctggccctggccggcagcagtgatgccttcagcggcagcgaggccacagctgccatcctgagccgggccccctggagcctgcagagcgtgaaccctggcctgaagaccaacagcagcaaggagcccaagttcaccaagtgccgcagccctgagcgggagaccttcagctgccactggacagatgaggtgcaccacggcaccaagaacctgggccccatccagctgttctacaccaggaggaacacccaggagtggacccaggagtggaaggagtgcccagactatgtgtctgctggggagaacagctgctacttcaacagcagcttcaccagcatctggatcccctactgcatcaagctgaccagcaatggaggcaccgtggatgagaagtgcttctctgtggatgagatcgtgcagcctgacccccccatcgccctgaactggaccctgctgaatgtgtccctgaccggcatccatgctgacatccaggtgcgctgggaggcccccagaaatgctgacatccagaagggctggatggtgctggagtatgagctgcagtacaaggaggtgaatgagaccaagtggaagatgatggaccccatcctgaccacctctgtgcctgtgtacagcctgaaggtggacaaggagtatgaggtgcgggtgcgcagcaagcagagaaattctggcaactacggggagttcagcgaggtgctgtatgtgaccctgccccagatgagccagttcacctgtgaggaggacttctacttcccctggctgctgatcatcatcttcggcatcttcggcctgactgtgatgctgtttgtgttcctgttcagcaagcagcagaggatcaagatgctgatcctgccccctgtgcctgtgcccaagatcaagggcattgatcctgacctgctgaaggagggcaagctggaggaggtgaacaccatcctggccatccatgacagctacaagccagagttccacagtgatgacagctgggtggagttcatcgagctggacattgatgagccagatgagaagacagaggagagtgacacagaccggctgctgagcagtgaccacgagaagagccacagcaacctgggcgtgaaggatggagacagcggccgcaccagctgctgtgagccagacatcctggagacagacttcaatgccaatgacatccacgagggcaccagcgaggtggcccagccccagaggctgaagggggaggccgacctgctgtgcctggaccagaagaaccagaacaacagcccctaccatgatgcctgcccagccacccagcagcccagcgtcatccaggccgagaagaacaagccccagcccctgcccacagaaggagctgagagcacccaccaggccgcccacatccagctgagcaaccccagcagcctgagcaacatcgacttctacgcccaggtgtctgacatcaccccagctggctctgtggtgctgagccctggccagaagaacaaggccggcatgagccagtgtgacatgcaccctgagatggtgtccctgtgccaggagaacttcctgatggacaatgcctacttctgtgaggctgatgccaagaagtgcatccctgtggccccccacatcaaggtggagagccacatccagcccagcctgaaccaggaggacatctacatcaccacagagagcctgaccacagctgctggccggcccggcactggagagcacgtgcccggcagcgagatgcctgtgcctgactacaccagcatccacatcgtgcagagcccccagggcctcatcctgaatgccacagccctgcccctgcctgacaaggagttcctgagcagctgtggctacgtgtccacagaccagctgaacaagatcatgccctag

SEQ ID NO: 149602 - DNA, 1113 bp, Artificial Sequence
  Description of Artificial Sequence: Synthetic coding sequence
atgttccaggcctccatgaggagccccaacatggagcccttcaagcagcagaaggtggaggacttctatgacattggagaggagctgggcagcggccagtttgccatcgtgaagaagtgccgggagaagagcacaggcctggagtatgctgccaagttcatcaagaagaggcagagccgggccagcagaagaggagtgtcccgggaggagattgagcgggaggtgtccatcctgcggcaggtgctgcaccacaacgtcatcaccctgcatgatgtgtatgagaacagaacagatgtggtgctgatcctggagctggtgtctggaggagagctgtttgacttcctggcccagaaggagagcctgtctgaggaggaggccaccagcttcatcaagcagatcctggatggagtgaactacctgcacaccaagaagatcgcccactttgacctgaagccagagaacatcatgctgctggacaagaacatccccatcccccacatcaagctgattgactttggcctggcccacgagattgaagatggagtggagttcaagaacatcttcggcaccccagagtttgtggcccctgagatcgtgaactatgagcccctgggcctggaggccgacatgtggagcattggagtcatcacctacatcctgctgagcggggccagccccttcctgggggacaccaagcaggagaccctggccaacatcacagctgtgtcctatgactttgatgaggagttcttcagccagaccagcgagctggccaaggacttcatcaggaagctgctggtgaaggagaccaggaagaggctgaccatccaggaggccctgcggcacccctggatcacccctgtggacaaccagcaggccatggtgcggcgggagagcgtggtgaacctggagaacttcaggaagcagtatgtgagaagacgctggaagctgtccttcagcatcgtgtccctgtgcaaccacctgaccaggagcctgatgaagaaggtgcacctgcggccagatgaggacctgaggaactgtgagagtgacacagaagaagatattgcccggaggaaggccctgcaccccaggagaagaagcagcaccagctag

SEQ ID NO: 149603 - DNA, 1113 bp, Artificial Sequence; identical to SEQ ID NO: 149602
  Description of Artificial Sequence: Synthetic coding sequence

SEQ ID NO: 149604 - DNA, 246 bp, Artificial Sequence
  Description of Artificial Sequence: Synthetic coding sequence
atgttccaggcctccatgaggagccccaacatggagcccttcaagcagcagaaggtggaggacttctatgacattggagaggagctgggcagcggccagtttgccatcgtgaagaagtgccgggagaagagcacaggcctggagtatgctgccaagttcatcaagaagaggcagagccgggccagcagaagaggagtgtcccgggaggagattgagcgggaggtgtccatcctgcggcaggtgtag

SEQ ID NO: 149605 - DNA, 2223 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgctgagaacacagccagccagagccccaggacccggggcagccggcggcagatccagaggctggagcagctgctggccctgtatgtggccgagatccggcggctgcaggagaaggagctggacctgtctgagctggatgatcctgacagcgcctacctgcaggaggcccggctgaagaggaagctgatccggctgtttggccgcctgtgtgagctgaaggactgcagcagcctgaccggccgggtgattgagcagaggatcccctaccggggcacccgctacccagaggtgaacagaagaattgagcggctcatcaacaagccaggccctgacaccttcccagactatggagatgtgctgcgggctgtggagaaggctgctgcccggcacagcctgggcctgccccggcagcagctgcagctgatggcccaggatgccttcagagatgtgggcatccggctgcaggagaggaggcacctggacctgatctacaactttggctgccacctgacagatgactacagacctggggtggaccctgccctgagtgaccctgtgctggcccggcggctgagagaaaatagaagcctggccatgagccggctggatgaagtcatcagcaaatatgccatgctgcaggacaagtctgaggagggggagaggaagaagaggcgggcccggctgcagggcaccagcagccacagcgctgacaccccagaggccagcctggacagcggggagggccccagcggcatggccagccagggctgccccagcgccagcagagctgagacagatgatgaagatgatgaggagagtgatgaggaggaggaggaggaggaggaggaggaggaggaggaggccacagattctgaggaggaggaggacctggagcagatgcaggagggccaggaggatgatgaggaggaggatgaggaggaggaggccgccgccggcaaggatggagacaagagccccatgagcagcctgcagatcagcaatgagaagaacctggagcccgggaagcagatcagccgcagcagcggggagcagcagaacaagggcagaattgtgagccccagcctgctgtctgaggagcccctggcccccagcagcattgatgctgagagcaatggagagcagcctgaggagctgaccctggaggaggagagccctgtgtcccagctgtttgagctggagattgaggccctgcccctggacacccccagctctgtggagacagacatcagcagcagcaggaagcagagcgaggagcccttcaccaccgtgctggagaatggagctggcatggtgagcagcaccagcttcaacggcggcgtgagcccccacaactggggagacagcggccccccctgcaagaagagcaggaaggagaagaagcagacaggcagcggccccctgggcaacagctatgtggagcggcagaggtctgtgcatgagaagaatggcaagaagatctgcaccctgcccagcccccccagccccctggccagcctggcccctgtggccgacagcagcaccagggtggacagccccagccacggcctggtgaccagcagcctgtgcatccccagccctgcccggctgagccagaccccccacagccagccccccaggcctggcacctgcaagacctctgtggccacccagtgtgaccctgaggagatcatcgtgctgagtgacagcgactag

SEQ ID NO: 149606 - DNA, 2223 bp, Artificial Sequence; identical to SEQ ID NO: 149605
  Description of Artificial Sequence: Synthetic coding sequence

SEQ ID NO: 149607 - DNA, 2223 bp, Artificial Sequence; identical to SEQ ID NO: 149605
  Description of Artificial Sequence: Synthetic coding sequence

SEQ ID NO: 149608 - DNA, 2223 bp, Artificial Sequence; identical to SEQ ID NO: 149605
  Description of Artificial Sequence: Synthetic coding sequence

SEQ ID NO: 149609 - DNA, 393 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtag

SEQ ID NO: 149610 - DNA, 147 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagccaggtag

SEQ ID NO: 149611 - DNA, 393 bp, Artificial Sequence; identical to SEQ ID NO: 149609
  Description of Artificial Sequence: Synthetic coding sequence

SEQ ID NO: 149612 - DNA, 147 bp, Artificial Sequence; identical to SEQ ID NO: 149610
  Description of Artificial Sequence: Synthetic coding sequence

SEQ ID NO: 149613 - DNA, 537 bp, Artificial Sequence
  Description of Artificial Sequence: Synthetic coding sequence
atggccacagccaacagcatcatcgtgctggatgatgatgatgaagatgaggccgccgcccagcccggccccagccaccccctgcccaatgctgccagccctggagctgaggcccccagcagcagcgagccccatggagcccggggcagcagcagcagcggcggcaagaagtgctacaagctggagaatgagaagctgtttgaggagttcctggagctgtgcaagatgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgctgagaacacagccagccagagctag

SEQ ID NO: 149614 - DNA, 537 bp, Artificial Sequence; identical to SEQ ID NO: 149613
  Description of Artificial Sequence: Synthetic coding sequence

SEQ ID NO: 149615 - DNA, 2223 bp, Artificial Sequence; identical to SEQ ID NO: 149605
  Description of Artificial Sequence: Synthetic coding sequence

SEQ ID NO: 149616 - DNA, 2223 bp, Artificial Sequence; identical to SEQ ID NO: 149605
  Description of Artificial Sequence: Synthetic coding sequence

SEQ ID NO: 149617 - DNA, 393 bp, Artificial Sequence; identical to SEQ ID NO: 149609
  Description of Artificial Sequence: Synthetic coding sequence

SEQ ID NO: 149618 - DNA, 537 bp, Artificial Sequence; identical to SEQ ID NO: 149613
  Description of Artificial Sequence: Synthetic coding sequence

SEQ ID NO: 149619 - DNA, 2223 bp, Artificial Sequence; identical to SEQ ID NO: 149605
  Description of Artificial Sequence: Synthetic coding sequence

SEQ ID NO: 149620 - DNA, 147 bp, Artificial Sequence; identical to SEQ ID NO: 149610
  Description of Artificial Sequence: Synthetic coding sequence

SEQ ID NO: 149621 - DNA, 393 bp, Artificial Sequence; identical to SEQ ID NO: 149609
  Description of Artificial Sequence: Synthetic coding sequence

SEQ ID NO: 149622 - DNA, 537 bp, Artificial Sequence; identical to SEQ ID NO: 149613
  Description of Artificial Sequence: Synthetic coding sequence

SEQ ID NO: 149623 - DNA, 2223 bp, Artificial Sequence; identical to SEQ ID NO: 149605
  Description of Artificial Sequence: Synthetic coding sequence

SEQ ID NO: 149624 - DNA, 147 bp, Artificial Sequence; identical to SEQ ID NO: 149610
  Description of Artificial Sequence: Synthetic coding sequence

SEQ ID NO: 149625 - DNA, 1998 bp, Artificial Sequence
  Description of Artificial Sequence: Synthetic coding sequence
atgcagacagctgaccaccctgaggtggtgcccttcctgtacaaccggcagcagagggcccacagcctcttcctggccagcgctgagttctgcaacatcctgagccgggtgctgagccgggcccggagcaggcctgccaagctgtatgtgtacatcaatgagctgtgcaccgtgctgaaggcccacagcgccaagaagaagctgaacctggccccagctgccaccaccagcaatgagcccagcggcaacaacccccccacccacctgagcctggaccccaccaatgcagaaaatacagccagccagagccccaggacccggggcagccggcggcagatccagaggctggagcagctgctggccctgtatgtggccgagatccggcggctgcaggagaaggagctggacctgtctgagctggatgatcctgattctgcctacctgcaggaggcccggctgaagaggaagctgatccggctgtttggccgcctgtgtgagctgaaggactgcagcagcctgaccggccgggtcatcgagcagaggatcccctaccggggcacccgctacccagaggtgaacagacgcatcgagcggctcatcaacaagccaggccctgacaccttcccagactatggagatgtgctgcgggctgtggagaaggccgccgcccggcacagcctgggcctgccccggcagcagctgcagctgatggcccaggatgccttcagagatgtgggcatccggctgcaggagcggcggcacctggacctgatctacaactttggctgccacctgacagatgactacagacctggggtggaccctgccctgagtgaccctgtgctggcccggcggctgcgggagaacagaagcctggccatgagccggctggatgaggtgatcagcaaatatgccatgctgcaggacaagtctgaggagggggagaggaagaagagaagagcccggctgcagggcaccagcagccacagcgctgacaccccagaggccagcctggacagcggggagggccccagcggcatggccagccagggctgccccagcgccagcagagctgagacagatgatgaagatgatgaggagagtgatgaggaggaggaggaggaggaggaggaggaggaggaggaggccacagacagcgaggaggaggaggacctggagcagatgcaggagggccaggaggatgatgaggaggaggatgaggaggaggaggccgctgctgggaaggatggagacaagagccccatgagcagcctgcagatcagcaatgagaagaacctggagcccgggaagcagatcagccgcagcagtggagagcagcagaacaagggccgcatcgtgagccccagcctgctgtctgaggagcccctggcccccagcagcattgatgctgagagcaatggagagcagcctgaggagctgaccctggaggaggagagccctgtgtcccagctgtttgagctggagattgaggccctgcccctggacacccccagctctgtggagacagacatcagcagcagcaggaagcagagcgaggagcccttcaccaccgtgctggagaatggagctggcatggtgagcagcaccagcttcaatggaggagtgagcccccacaactggggagacagcggccccccctgcaagaagagcaggaaggagaagaagcagacaggcagcggccccctgggcaacagctatgtggagcggcagaggtctgtgcatgagaagaatggcaagaagatctgcaccctgcccagcccccccagccccctggccagcctggcccctgtggccgacagcagcaccagggtggacagccccagccacggcctggtgaccagcagcctgtgcatccccagccctgcccggctgagccagaccccccacagccagcccccccggcccggcacctgcaagacctctgtggccacccagtgtgaccctgaggagatcatcgtgctgagtgacagcgactag

SEQ ID NO: 149626 - DNA, 1998 bp, Artificial Sequence; identical to SEQ ID NO: 149625
  Description of Artificial Sequence: Synthetic coding sequence

SEQ ID NO: 149627 - DNA, 1998 bp, Artificial Sequence; identical to SEQ ID NO: 149625
  Description of Artificial Sequence: Synthetic coding sequence

SEQ ID NO: 149628 - DNA, 1998 bp, Artificial Sequence; identical to SEQ ID NO: 149625
  Description of Artificial Sequence: Synthetic coding sequence

SEQ ID NO: 149629 - DNA, 1080 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgccctgatcctggtgaacaacaagatcagcaaggtgtcccctggggccttcacccccctggtgaagctggagcggctgtacctgagcaagaaccagctgaaggagctgcctgagaagatgcccaagaccctgcaggagctgcgggcccatgaaaatgagatcaccaaggtgaggaaggtgaccttcaacggcctgaaccagatgattgtgattgagctgggcaccaaccccctgaagagcagcggcattgaaaatggagccttccagggcatgaagaagctgagctacatcagaattgctgacaccaacatcaccagcatcccccagggcctgccccccagcctgacagagctgcacctggatggcaacaagatcagccgggtggatgctgccagcctgaagggcctgaacaacctggccaagctgggcctgtccttcaacagcatctctgctgtggacaatggcagcctggccaacaccccccacctgcgggagctgcacctggacaacaacaagctgaccagggtgcctgggggcctggccgagcacaagtacatccaggtggtgtacctgcacaacaacaacatctctgtggtgggcagcagtgacttctgccccccaggccacaacaccaagaaggccagctacagcggcgtgtccctcttcagcaaccctgtgcagtactgggagatccagcccagcaccttccgctgtgtgtatgtgcgcagcgccatccagctgggcaactacaagtag

SEQ ID NO: 149630 - DNA, 7092 bp, Artificial Sequence
  Description of Artificial Sequence: Synthetic coding sequence
atgcctgtgctgggcgtggccagcaagctgcggcagcctgctgtgggcagcaagcctgtgcacacagccctgcccatccccaacctgggcaccaccggcagccagcactgcagcagccggcccctggagctgacagaaacagagagctccatgctgagctgccagctggccctgaagagcacctgtgaatttggagagaagaagcccctgcagggcaaggccaaggagaaggaggacagcaagatctacacagactgggccaaccactacctggccaagagcggccacaagaggctcatcaaggacctgcagcaggacattgctgatggagtgctgctggccgagatcatccagatcatcgccaatgagaaggtggaggacatcaatggctgccccaggagccagagccagatgattgaaaatgtggatgtgtgcctgtccttcctggccgcccggggcgtgaatgtgcagggcctgtctgctgaggagatcagaaatggaaacctgaaggccatcctgggcctcttcttcagcctgagccgctacaagcagcagcagcaccaccagcagcagtactaccagagcctggtggagctgcagcagagggtgacccacgccagcccccccagcgaggccagccaggccaagacccagcaggacatgcagagcagcctggccgcccgctatgccacccagagcaaccacagcggcatcgccaccagccagaagaagcccacccggctgcccggccccagccgggtgcctgctgctggcagcagcagcaaggtgcagggcgccagcaacctgaacagaagaagccagagcttcaacagcattgacaagaacaagccacccaactatgccaatggaaatgagaaggacagcagcaagggcccccagagcagcagtggagtgaatggaaatgtgcagccccccagcacagctggccagcccccagccagcgccatccccagccccagcgccagcaagccctggaggagcaagtccatgaatgtgaagcacagcgccaccagcaccatgctgactgtgaagcagagcagcacagccaccagccccacccccagcagtgaccggctgaagccccctgtgtctgaaggagtgaagacagcccccagcggccagaagtccatgctggagaagttcaagctggtgaatgccaggacagccctgcggcccccccagccccccagcagcggccccagtgatggcggcaaggatgatgatgccttcagcgagagcggggagatggagggcttcaacagcggcctgaacagcggcggcagcaccaacagcagccccaaggtgagccccaagctggccccacccaaggccggcagcaagaacctgagcaacaagaagagcctgctgcagcccaaggagaaggaggagaagaacagagacaagaacaaggtgtgcacagagaagcctgtgaaggaggagaaggaccaggtgacagagatggcccccaagaagaccagcaagatcgccagcctcatccccaagggcagcaagaccacagctgccaagaaggagagcctcatccccagcagcagcggcatccccaagccaggcagcaaggtgcccaccgtgaagcagaccatcagccctggcagcacagccagcaaggagagcgagaagttccgcaccaccaagggcagccccagccagagcctgagcaagcccatcaccatggagaaggccagcgccagcagctgcccagcccccctggagggccgggaggccggccaggccagccccagcggcagctgcaccatgacagtggcccagagcagcggccagagcactggaaatggagctgtgcagctgccccagcagcagcagcacagccaccccaacacagccaccgtggcccccttcatctaccgggcccacagtgaaaatgaaggaacagccctgcccagcgctgacagctgcaccagccccaccaagatggacctgagctacagcaagacagccaagcagtgcctggaggagatcagcggggaggaccctgagaccaggaggatgaggacagtgaagaacattgctgacctgcggcagaacctggaggagaccatgagcagcctgcggggcacccagatcagccacagcaccctggagaccacctttgacagcacagtgaccacagaggtgaatggccgcaccatccccaacctgaccagccggcccacccccatgacctggaggctgggccaggcctgcccccggctgcaggccggagatgcccccagcctgggcgccggctaccccaggagcggcaccagccgcttcatccacacagaccccagccgcttcatgtacaccacccccctgcggcgggctgctgtgtcccggctgggcaacatgagccagattgacatgtctgagaaggccagcagtgacctggacatgagcagcgaggtggatgtgggcggctacatgtctgatggagacatcctgggcaagagcctgaggacagatgacatcaacagcggctacatgacagatggcggcctgaacctgtacaccaggagcctgaaccgcatcccagacacagccaccagccgggacatcatccagaggggcgtgcatgatgtgacagtggatgctgacagctgggatgacagcagctctgtgagcagcggcctgagtgacaccctggacaacatcagcacagatgacctgaacaccaccagctctgtgagcagctacagcaacatcaccgtgcccagcaggaagaacacccagctgaggacagacagcgagaagaggagcaccacagatgagacctgggacagccctgaggagctgaagaagccagaagaagattttgacagccatggagatgctgggggcaagtggaagacagtgagcagcggcctgcctgaggaccctgagaaggccggccagaaggccagcctgtctgtgtcccagacaggctcctggaggcggggcatgtctgcccagggcggggcccccagccggcagaaggccggcaccagcgccctgaagaccccaggcaagacagatgatgccaaggccagcgagaagggcaaggcccccctgaagggcagcagcctgcagaggagccccagtgatgctgggaagagcagtggagatgagggcaagaagccacccagcggcatcggccgcagcacagccaccagcagctttggcttcaagaagcccagcggcgtgggcagcagcgccatgatcaccagcagcggggccaccatcaccagcggcagcgccaccctgggcaagatccccaagtctgctgccatcggcggcaagagcaatgccggcaggaagaccagcctggatggcagccagaaccaggatgatgtggtgctgcacgtgagcagcaagaccaccctgcagtaccgcagcctgccccggcccagcaagagcagcaccagcggcatccctggccggggcggccacaggagcagcaccagcagcattgacagcaatgtgagcagcaagtctgctggggccaccaccagcaagctgcgggagcccaccaagattggcagcggccgcagcagccctgtgacagtgaaccagacagacaaggagaaggagaaggtggccgtgtctgattctgagagcgtgtccctgagcggcagccccaagagcagccccaccagcgccagcgcctgtggggcccagggcctgcggcagcccggcagcaagtacccagacatcgccagccccaccttcagaagactctttggagccaaggccggcggcaagagcgccagcgcccccaacacagagggcgtgaagagcagctctgtgatgcccagccccagcaccaccctggcccggcagggcagcctggagagccccagcagcggcaccggctccatgggcagcgctgggggcctgagcggcagcagcagccccctcttcaacaagcccagcgacctgaccacagatgtgatcagcctgagccacagcctggccagcagccctgcctctgtgcacagcttcaccagcggcggcctggtgtgggccgccaacatgagcagcagcagcgctggcagcaaggacacccccagctaccagagcatgaccagcctgcacaccagcagcgagagcattgacctgcccctgagccaccacggcagcctgagcggcctgaccaccggcacccatgaggtgcagagcctgctgatgaggactggatctgtgcgcagcaccctgtctgagagcatgcagctggacaggaacaccctgcccaagaagggcctgcgctacacccccagcagccggcaggccaaccaggaggagggcaaggagtggctgcggagccacagcactggaggcctgcaggacaccggcaaccagagccccctggtgagccccagcgccatgagcagcagcgctgctgggaagtaccacttcagcaacctggtgagccccaccaacctgagccagttcaacctgcccggccccagcatgatgaggagcaacagcatcccagcccaggacagcagctttgacctgtatgatgacagccagctgtgtggcagcgccaccagcctggaggagcggccccgggccatcagccacagcggcagcttccgggacagcatggaggaggtgcacggcagcagcctgagcctggtgagcagcaccagcagcctgtacagcacagctgaggccggcggcagcctggagcagatccacaagctgcggcgggagctggtggccagccaggagaaggtggccaccctgaccagccagctgagcgccaatgcccacctggtggccgcctttgagaagagcctgggcaacatgacaggccgcctgcagagcctgaccatgacagctgagcagaaggagagcgagctgattgagctgcgggagaccatcgagatgctgaaggcccagaacagcgctgcccaggccgccatccagggcgccctgaatggaccagaccacccccccaaggacctgcgcatccggcggcagcacagcagcgagagcgtgagcagcatcaacagcgccaccagccacagcagcatcggcagcggaaatgatgctgacagcaagaagaagaagaagaagaactgggtgaacagccggggcagcgagctgcggagcagcttcaagcaggccttcggcaagaagaagagcaccaagccacccagcagccacagcgacatcgaggagctgacagacagcagcctgcctgccagccccaagctgccccacaatgctggggactgtggcagcgcctccatgaagcccagccagagcgccagcgccatctgtgaatgtacagaagctgaggccgagatcatcctgcagctgaagtctgagctgcgggagaaggagctgaagctgacagacatccggctggaggccctgagcagcgcccaccacctggaccagatccgggaggccatgaacaggatgcagaatgaaattgagatcctgaaggccgagaatgaccggctgaaggccgagaccggcaacacagccaagcccaccaggcctccttctgagagcagcagcagcaccagcagcagcagcagccggcagagcctgggcctgagcctgaacaacctgaacatcacagaggccgtgtccagtgacatcctgctggatgatgctggagatgccaccggccacaaggatggccgctctgtgaagatcatcgtgtccatcagcaagggctacggccgggccaaggaccagaagagccaggcctacctgattggcagcattggagtgtctgggaagaccaagtgggatgtgctggatggagtcatccggcggctcttcaaggagtatgtgttcagaattgacaccagcaccagcctgggcctgagcagtgactgcatcgccagctactgcatcggggacctgatccgcagccacaacctggaggtgcctgagctgctgccctgtggctacctggtgggggacaacaacatcatcaccgtgaacctgaagggcgtggaggagaacagcctggacagctttgtgtttgacaccctcatccccaagcccatcacccagcgctacttcaacctgctgatggagcaccaccgcatcatcctgagcggccccagcggcaccgggaagacctacctggccaacaagctggccgagtatgtgatcaccaagagcggcaggaagaagacagaagatgccatcgccaccttcaacgtggaccacaagagcagcaaggagctgcagcagtacctggccaacctggccgagcagtgcagcgctgacaacaatggagtggagctgcctgtggtgatcatcctggacaacctgcaccacgtgggcagcctgagtgacatcttcaacggcttcctgaactgcaagtacaacaagtgcccctacatcatcggcaccatgaaccagggcgtgagcagcagccccaacctggagctgcaccacaacttccgctgggtgctgtgtgccaaccacacagagcctgtgaagggcttcctgggccgctacctgcggaggaagctgattgaaattgaaattgaaagaaacatccggaacaatgacctggtgaagatcatcgactggatccccaagacctggcaccacctgaacagcttcctggagacccacagcagcagtgatgtgaccatcggccccaggctcttcctgccctgccccatggatgtggagggcagccgggtgtggttcatggacctgtggaactacagcctggtgccctacatcctggaggccgtgcgggagggcctgcagatgtatggcaagaggaccccctgggaggaccccagcaagtgggtgctggacacctacccctggagcagcgccaccctgccccaggagagccctgccctgctgcagctgcggccagaagatgtgggctatgagagctgcaccagcaccaaggaggccaccaccagcaagcacatcccccagacagacacagaaggagaccccctgatgaacatgctgatgaagctgcaggaggccgccaactacagcagcacccagagctgtgacagcgagagcaccagccaccacgaggacatcctggacagcagcctggagagcaccctgtag

SEQ ID NO: 149631 - DNA, 519 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgtggtgtacctgcacaacaacaacatctctgtggtgggcagcagtgacttctgccccccaggccacaacaccaagaaggccagctacagcggcgtgtccctcttcagcaaccctgtgcagtactgggagatccagcccagcaccttccgctgtgtgtatgtgcgcagcgccatccagctgggcaactacaagtag

SEQ ID NO: 149632 - DNA, 1080 bp, Artificial Sequence; identical to SEQ ID NO: 149629
  Description of Artificial Sequence: Synthetic coding sequence

SEQ ID NO: 149633 - DNA, 753 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctggagctgggcaccaaccccctgaagagcagcggcattgaaaatggagccttccagggcatgaagaagctgagctacatcagaattgctgacaccaacatcaccagcatcccccagggcctgccccccagcctgacagagctgcacctggatggcaacaagatcagccgggtggatgctgccagcctgaagggcctgaacaacctggccaagctgggcctgtccttcaacagcatctctgctgtggacaatggcagcctggccaacaccccccacctgcgggagctgcacctggacaacaacaagctgaccagggtgcctgggggcctggccgagcacaagtacatccaggtggtgtacctgcacaacaacaacatctctgtggtgggcagcagtgacttctgccccccaggccacaacaccaagaaggccagctacagcggcgtgtccctcttcagcaaccctgtgcagtactgggagatccagcccagcaccttccgctgtgtgtatgtgcgcagcgccatccagctgggcaactacaagtag

SEQ ID NO: 149634 - DNA, 639 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctgccccccagcctgacagagctgcacctggatggcaacaagatcagccgggtggatgctgccagcctgaagggcctgaacaacctggccaagctgggcctgtccttcaacagcatctctgctgtggacaatggcagcctggccaacaccccccacctgcgggagctgcacctggacaacaacaagctgaccagggtgcctgggggcctggccgagcacaagtacatccaggtggtgtacctgcacaacaacaacatctctgtggtgggcagcagtgacttctgccccccaggccacaacaccaagaaggccagctacagcggcgtgtccctcttcagcaaccctgtgcagtactgggagatccagcccagcaccttccgctgtgtgtatgtgcgcagcgccatccagctgggcaactacaagtag

SEQ ID NO: 149635 - DNA, 519 bp, Artificial Sequence; identical to SEQ ID NO: 149631
  Description of Artificial Sequence: Synthetic coding sequence

SEQ ID NO: 149636 - DNA, 228 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggctgcctgcccagctag

SEQ ID NO: 149637 - DNA, 639 bp, Artificial Sequence; identical to SEQ ID NO: 149634
  Description of Artificial Sequence: Synthetic coding sequence

SEQ ID NO: 149638 - DNA, 540 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgccctgatcctggtgaacaacaagatcagcaaggtgtcccctggggccttcacccccctggtgaagctggagcggctgtacctgagcaagaaccagctgaaggagctgcctgagaagatgcccaagaccctgcaggagctgcgggcccatgaaaatgagatcaccaaggtgaggaaggtgaccttcaacggcctgaaccagatgatcgtcatctag

SEQ ID NO: 149639 - DNA, 360 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgccctgatcctggtgaacaacaagatcagcaagtag

SEQ ID NO: 149640 - DNA, 525 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgccctgatcctggtgaacaacaagatcagcaaggtgtcccctggggccttcacccccctggtgaagctggagcggctgtacctgagcaagaaccagctgaaggagctgcctgagaagatgcccaagaccctgcaggagctgcgggcccatgaaaatgagatcaccaaggtgaggaaggtgaccttcaacggcctgaactag

SEQ ID NO: 149641 - DNA, 537 bp, Artificial Sequence
  Description of Artificial Sequence: Synthetic coding sequence
atgaaggccaccatcatcctgctgctgctggcccaggtgtcctgggccggccccttccagcagaggggcctgtttgacttcatgctggaggatgaggccagcggcatcggccctgaggtgcctgatgaccgggactttgagcccagcctgggccctgtgtgccccttccgctgccagtgccacctgcgggtggtgcagtgcagcgacctgggcctggacaaggtgcccaaggacctgcccccagacaccaccctgctggacctgcagaacaacaagatcacagagatcaaggatggagacttcaagaacctgaagaacctgcacgccctgatcctggtgaacaacaagatcagcaaggtgtcccctggggccttcacccccctggtgaagctggagcggctgtacctgagcaagaaccagctgaaggagctgcctgagaagatgcccaagaccctgcaggagctgcgggcccatgaaaatgagatcaccaaggtgaggaaggtgaccttcaacggcctgaaccagatgattgtgtag

SEQ ID NO: 149642 - DNA, 1080 bp, Artificial Sequence; identical to SEQ ID NO: 149629
  Description of Artificial Sequence: Synthetic coding sequence

SEQ ID NO: 149643 - DNA, 5598 bp, Artificial Sequence
  Description of Artificial Sequence: Synthetic coding sequence
atgacccgctgggtgcccaccaagcgggaggagaagtatggagtggccttctacaactatgatgcccggggagcagatgagctgagcctgcagatcggggacacagtgcacatcctggagacctatgagggctggtaccggggctacaccctgaggaagaagagcaagaagggcatcttccctgccagctacatccacctgaaggaggccatcgtggagggcaagggccagcacgagaccgtcatccctggggacctgcccctcatccaggaggtgaccaccaccctgcgggagtggagcaccatctggaggcagctgtatgtgcaggacaaccgggagatgttccgctctgtgcgccacatgatctatgacctgattgagtggaggagccagatcctgagcggcaccctgccccaggatgagctgaaggagctgaagaagaaggtgacagccaagattgattatggcaaccgcatcctggacctggacctggtggtgagagatgaagatggcaacatcctggaccctgagctgaccagcaccatcagcctcttccgggcccacgagatcgccagcaagcaggtggaggagcggctgcaggaggagaagagccagaagcagaacatcgacatcaaccggcaggccaagtttgctgccacccccagcctggccctgtttgtgaacctgaagaatgtggtgtgcaagatcggggaggatgctgaggtgctgatgagcctgtatgaccctgtggagagcaagttcatcagcgagaactacctggtgcgctggagcagcagcggcctgcccaaggacatcgaccggctgcacaacctgcgggctgtgttcacagacctgggcagcaaggacctgaagcgggagaagatcagctttgtgtgccagatcgtgcgggtgggccgcatggagctgcgggacaacaacaccaggaagctgaccagcggcctgcggcggccctttggagtggccgtgatggatgtgacagacatcatcaatggcaaggtggatgatgaggacaagcagcacttcatccccttccagcctgtggccggagaaaatgacttcctgcagaccgtcatcaacaaggtgattgctgccaaggaggtgaaccacaagggccagggcctgtgggtgaccctgaagctgctgcccggggacatccaccagatcaggaaggagttcccccacctggtggacaggaccacagctgtggccaggaagacaggcttccctgagatcatcatgcctggagatgtgagaaatgacatctacgtgaccctggtgcagggcgactttgataaaggcagcaagaccacagccaagaatgtggaggtgacagtgtctgtgtatgatgaagatggcaagaggctggagcacgtgatcttccctggagctggagatgaggccatcagcgagtacaagagcgtcatctactaccaggtgaagcagccccgctggtttgagaccgtgaaggtggccatccccattgaagatgtgaacagaagccacctgcgcttcaccttccgccacaggagcagccaggacagcaaggacaagtctgagaagatctttgccctggcctttgtgaagctgatgagatatgatggcaccaccctgagagatggagaacatgacctgattgtgtacaaggccgaggccaagaagctggaggatgctgccacctacctgagcctgcccagcaccaaggccgagctggaggagaagggccacagcgccaccgggaagtccatgcagagcctgggcagctgcaccatcagcaaggacagcttccagatcagcaccctggtgtgcagcaccaagctgacccagaatgtggacctgctgggcctgctgaagtggaggagcaacaccagcctgctgcagcagaacctgcggcagctgatgaaggtggatggaggagaggtggtgaagttcctgcaggacaccctggatgccctcttcaacatcatgatggagaacagcgagagcgagacctttgacaccctggtgtttgatgccctggtgttcatcatcggcctgattgctgacaggaagttccagcacttcaaccctgtgctggagacctacatcaagaagcacttcagcgccaccctggcctacaccaagctgaccaaggtgctgaagaactacgtggatggagctgagaagccaggagtgaatgagcagctgtacaaggccatgaaggccctggagagcatcttcaagttcatcgtgcgcagccgcatcctcttcaaccagctgtatgaaaataaaggagaggccgactttgtggagagcctgctgcagctgttccgcagcatcaatgacatgatgagctccatgtctgaccagacagtgcgggtgaagggggccgccctgaagtacctgcccaccatcgtgaatgatgtgaagctggtgtttgaccccaaggagctgagcaagatgttcacagagttcatcctgaatgtgcccatgggcctgctgaccatccagaagctgtactgcctgattgagatcgtgcacagcgacctcttcacccagcacgactgccgggagatcctgctgcccatgatgacagaccagctgaagtaccacctggagcggcaggaggacctggaggcctgctgccagctgctgagccacatcctggaggtgctgtacaggaaggatgtgggccccacccagagacatgtgcagatcatcatggagaagctgctgaggacagtgaacagaactgtcatctccatgggccgggacagcgagctgattggcaactttgtggcctgcatgacagccatcctgcggcagatggaggactaccactacgcccacctgatcaagaccttcggcaagatgaggacagatgtggtggacttcctgatggagaccttcatcatgttcaagaacctgattggcaagaatgtgtacccctttgactgggtgatcatgaacatggtgcagaacaaggtgttcctgcgggccatcaaccagtatgctgacatgctgaacaagaagttcctggaccaggccaactttgagctgcagctgtggaacaactacttccacctggccgtggccttcctgacccaggagagcctgcagctggagaacttcagcagcgccaagagggccaagatcctgaacaagtatggagacatgaggcggcagatcggctttgagatccgggacatgtggtacaacctgggccagcacaagatcaagttcatccctgagatggtgggccccatcctggagatgaccctcatccctgagacagagctgaggaaggccaccatccccatcttctttgacatgatgcagtgtgagttccacagcaccaggagcttccagatgtttgaaaatgagatcatcaccaagctggaccacgaggtggagggcggcagaggagatgagcagtacaaggtgctgtttgacaagatcctgctggagcactgcaggaagcacaagtacctggccaagacaggagagacctttgtgaagctggtggtgcggctgatggagcggctgctggactaccgcaccatcatgcatgatgagaacaaggagaacaggatgagctgcaccgtgaatgtgctgaacttctacaaggagattgaaagagaggagatgtacatccgctacctgtacaagctgtgtgacctgcacaaggaatgtgacaactacacagaggccgcctacaccctgctgctgcacgccaagctgctgaagtggagcgaagatgtgtgtgtggcccacctgacccagagagatggctaccaggccaccacccagggccagctgaaggagcagctgtaccaggagatcatccactactttgacaagggcaagatgtgggaggaggccatcgccctgggcaaggagctggccgagcagtatgaaaatgagatgtttgattatgagcagctgtctgagctgctgaagaagcaggcccagttctatgagaacatcgtgaaggtgatccggcccaagccagactactttgctgtgggctactacggccagggcttccccaccttcctgcggggcaaggtgttcatctaccggggcaaggagtatgaaagaagagaggactttgaggcccggctgctgacccagttccccaatgctgagaagatgaagaccaccagccccccaggagatgacatcaagaacagccctggccagtacatccagtgcttcaccgtgaagcccaagctggacctgccccccaagttccacaggcctgtgtctgagcagatcgtgtccttctacagagtgaatgaggtgcagagatttgagtacagccggcccatcagaaaaggagagaagaacccagacaatgaatttgccaacatgtggattgaaagaaccatctacaccacagcctacaagctgcccggcatcctgcgctggtttgaggtgaagtctgtgttcatggtggagatcagccccctggagaatgccatcgagaccatgcagctgaccaatgacaagatcaacagcatggtgcagcagcacctggatgaccccagcctgcccatcaaccccctgtccatgctgctgaatggaattgtggaccctgctgtgatgggcggctttgccaactatgagaaggccttcttcacagaccgctacctgcaggagcaccctgaggcccacgagaagattgagaagctgaaggacctgattgcctggcagatccccttcctggccgagggcatccgcatccacggggacaaggtgacagaggccctgcggcccttccacgagaggatggaggcctgcttcaagcagctgaaggagaaggtggagaaggagtatggagtgcgcatcatgcccagcagcctggatgaccggcggggcagccggcccaggtccatggtgcgctccttcaccatgcccagcagcagccggcccctgtctgtggcctctgtgagcagcctgagcagtgacagcacccccagccggcccggcagtgatggctttgccctggagcccctgctgcccaagaagatgcacagccgcagccaggacaagctggacaaggatgacctggagaaggagaagaaggacaagaagaaggagaagaggaacagcaagcaccaggagatctttgagaaggagttcaagcccacagacatcagcctgcagcagagcgaggccgtcatcctgtctgagaccatcagccccctgcggccccagaggcccaagagccaggtgatgaatgtgattggcagcgagcggcgcttctctgtgagccccagcagccccagcagccagcagaccccacctcctgtgaccccccgggccaagctgtccttctccatgcagagcagcctggagctgaatggcatgactggagcagatgtggctgatgtgcccccacccctgcccctgaagggctctgtggccgactatggcaacctgatggagaaccaggacctgctgggcagccccaccccacctcctcctccaccccaccagaggcacctgcccccacccctgcccagcaagaccccacctcctcctccacccaagaccaccaggaagcaggcctctgtggacagcggcatcgtgcagtag

SEQ ID NO: 149644 - DNA, 6561 bp, Artificial Sequence
  Description of Artificial Sequence: Synthetic coding sequence
atggccggggagaggacccggcgcttcaccaggagcctgctgcggcccggccaggccgctgagctgcggcacagcgctgccagcgctgctgctgtggccgtgagcagccggcagcagcagaggcaggagaagccccggctgctggagcccctggactatgaaacagtgattgaggagctggagaagacctacagaaatgaccccctgcaggacctgctcttcttccccagtgatgacttctctgctgccaccgtgtcctgggacatccgcaccctgtacagcacagtgcctgaagatgctgagcacaaggccgagaacctgctggtgaaggaggcctgcaagttctacagcagccagtggcacgtggtgaactacaagtatgagcagtacagcggggacatccggcagctgcccagggctgagtacaagccagagaagctgcccagccacagctttgaaattgaccatgaagatgctgacaaggatgaggacaccaccagccacagcagcagcaagggcggcggcggggccggcggcaccggggtcttcaagagcggctggctgtacaagggcaacttcaacagcacagtgaacaacacagtgacagtgcgctccttcaagaagcgctacttccagctgacccagctgcctgacaacagctacatcatgaacttctacaaggatgagaagatcagcaaggagcccaagggctgcatcttcctggacagctgcacaggagtggtgcagaacaaccggctgaggaaatatgcctttgagctgaagatgaatgacctgacctactttgtgctggccgctgagacagaaagtgacatggatgagtggatccacaccctgaaccgcatcctgcagatcagccctgagggccccctgcagggccgccgcagcacagagctgacagacctgggcctggacagcctggacaacagcgtgacctgtgagtgcaccccagaggagacagacagcagcgagaacaacctgcatgctgactttgccaagtacctgacagaaacagaagatactgtgaagaccaccaggaacatggagcggctgaacctcttcagcctggaccctgacatcgacaccctgaagctgcagaagaaggacctgctggagcctgagagcgtcatcaagccctttgaggagaaggccgccaagaggatcatgatcatctgcaaggccctgaacagcaacctgcagggctgtgtgacagaaaatgaaaatgaccccatcaccaacatcgagcccttctttgtgtctgtggccctgtatgacctgcgggacagcaggaagatctctgctgacttccacgtggacctgaaccacgccgctgtgcggcagatgctgctgggcgcctctgtggccctggagaatggaaatattgacaccatcaccccccggcagagcgaggagccccacatcaagggcctgcctgaggagtggctgaagttccccaagcaggccgtgttttctgtgagcaacccccacagcgagatcgtgctggtggccaagattgagaaggtgctgatgggcaacatcgccagcggggctgagccctacatcaagaacccagacagcaacaagtatgcccagaagatcctgaagagcaaccggcagttctgcagcaagctgggcaagtacaggatgccctttgcctgggccgtgcgctctgtgttcaaggacaaccagggcaatgtggaccgggacagccgcttcagccccctcttccggcaggagagcagcaagatcagcacagaggacctggtgaagctggtgtctgactaccgccgggctgaccgcatcagcaagatgcagaccatccctggcagcctggacattgctgtggacaacgtgcccctggagcaccccaactgtgtgaccagcagcttcatccctgtgaagcccttcaacatgatggcccagacagagcccaccgtggaggtggaggagtttgtgtatgacagcaccaagtactgccggccctacagagtgtacaagaaccagatctacatctaccccaagcacctgaagtatgacagccagaagtgcttcaacaaggccaggaacatcaccgtgtgcatcgagttcaagaacagtgatgaggagagcgccaagcccctgaagtgcatctacggcaagccaggcggccccctcttcaccagcgctgcctacacagctgtgctgcaccacagccagaacccagacttcagtgatgaggtgaagattgagctgcccacccagctgcacgagaagcaccacatcctcttctccttctaccacgtgacctgtgacatcaatgccaaggccaatgccaagaagaaggaggccctggagacctctgtgggctacgcctggctgcccctgatgaagcatgaccagatcgccagccaggagtacaacatccccatcgccaccagcctgccccccaactacctgtccttccaggacagcgccagcggcaagcacggcggcagtgacatcaagtgggtggatggcggcaagcccctcttcaaggtgtccacctttgtggtgtccacagtgaacacccaggacccccacgtgaatgccttcttccaggagtgccagaagcgggagaaggacatgagccagagccccaccagcaacttcatccgcagctgcaagaacctgctgaatgtggagaagatccacgccatcatgtccttcctgcccatcatcctgaaccagctgttcaaggtgctggtgcagaatgaggaggatgagatcaccaccaccgtgaccagggtgctgacagacatcgtggccaagtgccacgaggagcagctggaccacagcgtgcagagctacatcaagtttgtgttcaagacccgggcctgcaaggagaggacagtgcatgaggagctggccaagaatgtgacaggcctgctgaagagcaatgacagcaccaccgtgaagcacgtgctgaagcacagctggttcttctttgccatcatcctgaagtccatggcccagcacctgattgacaccaacaagatccagctgccccggccccagcgcttccctgagagctaccagaatgagctggacaacctggtgatggtgctgagtgaccacgtgatctggaagtacaaggatgccctggaggagacccggcgggccaaccacagcgtggcccgcttcctgaagcgctgcttcaccttcatggaccggggctacgtgttcaagatggtgaacaactacatctccatgttcagcagcggggacctgaagaccctgtgccagtacaagtttgacttcctgcaggaggtgtgccagcacgagcacttcatccccctgtgcctgcccatccgcagcgccaacatcccagaccccctgaccccatctgagagcacccaggagctgcacgccagtgacatgcctgagtacagcgtgaccaatgagttctgcaggaagcacttcctgattggcatcctgctgcgggaggtgggctttgccctgcaggaggaccaggatgtgcgccacctggccctggccgtgctgaagaacctgatggccaagcacagctttgatgaccgctaccgggagcccaggaagcaggcccagatcgccagcctgtacatgcccctgtatggcatgctgctggacaacatgccccgcatctacctgaaggacctgtaccccttcaccgtgaacaccagcaaccagggcagcagagatgacctgagcaccaatggaggcttccagagccagacagccatcaagcacgccaacagcgtggacaccagcttcagcaaggatgtgctgaacagcattgctgccttcagcagcatcgccatcagcacagtgaaccacgccgacagccgggccagcctggccagcctggacagcaaccccagcaccaatgagaagagcagcgagaagacagacaactgtgagaagatcccccggcccctgagcctcatcggcagcaccctgcgctttgacaagctggaccaggccgagaccaggagcctgctgatgtgcttcctgcacatcatgaagaccatctcctatgagaccctcatcgcctactggcagagggcccccagccctgaggtgtctgacttcttcagcatcctggatgtgtgcctgcagaacttccgctacctgggcaagaggaacatcatcaggaagattgctgctgccttcaagtttgtgcagagcacccagaacaacggcaccctgaagggcagcaaccccagctgccagaccagcggcctgctgagccagtggatgcacagcaccagcagccatgagggccacaagcagcacaggagccagaccctgcccatcatccggggcaagaatgccctgagcaaccccaagctgctgcagatgctggacaacaccatgaccagcaacagcaatgaaattgacatcgtgcaccacgtggacacagaggccaacatcgccacagaggtgtgcctgaccatcctggacctgctgagcctcttcacccagacccaccagaggcagctgcagcagtgtgactgccagaacagcctgatgaagagggtgtttgacacctacatgctgttcttccaggtgaaccagagcgccacagccctgaagcacgtgtttgccagcctgcggctgtttgtgtgcaagttccccagcgccttcttccagggccctgctgacctgtgtggcagcttctgctatgaggtgctgaagtgctgcaaccacaggagccgcagcacccagacagaggccagcgccctgctgtacttcttcatgaggaagaactttgagttcaacaagcagaagagcatcgtgcgcagccacctgcagctgatcaaggctgtgtcccagctgattgctgatgctggcattggaggcagccgcttccagcacagcctggccatcaccaacaactttgccaacggggacaagcagatgaagaacagcaacttccctgctgaggtgaaggacctgaccaagaggatcagaacagtgctgatggccacagcccagatgaaggagcacgagaaggaccctgagatgctggtggacctgcagtacagcctggccaacagctatgccagcaccccagagctgcggaggacctggctggagagcatggccaagatccacgccagaaatggagacctgtctgaggccgccatgtgctacatccacatcgccgccctgattgctgagtacctgaagaggaagggctactggaaggtggagaagatctgcacagccagcctgctgtctgaggacacccacccctgtgacagcaacagcctgctgaccacccccagcggcggctccatgttctccatgggctggccagccttcctgagcatcacccccaacatcaaggaggagggcgccatgaaggaggacagcggcatgcaggacaccccctacaatgaaaacatcctggtggagcagctgtacatgtgtgtggagttcctgtggaagtcagaaagatatgagctgattgctgatgtgaacaagcccatcatcgctgtgtttgagaagcagagggacttcaagaagctgagtgacctgtactatgacatccacaggagctacctgaaggtggccgaggtggtgaacagcgagaagaggctgtttggccgctactacagagtggccttctacggccagggcttctttgaggaggaggagggcaaggagtacatctacaaggagcccaagctgaccggcctgtctgagatcagccagaggctgctgaagctgtatgctgacaagtttggagctgacaacgtgaagatcatccaggacagcaacaaggtgaaccccaaggacctggaccccaagtatgcctacatccaggtgacctacgtgacccccttctttgaggagaaggagattgaggacaggaagacagactttgagatgcaccacaacatcaacagatttgtgtttgagacccccttcaccctgagcggcaagaagcacggcggcgtggccgagcagtgcaagaggaggaccatcctgaccaccagccacctgttcccctacgtgaagaagaggatccaggtgatcagccagagcagcacagagctgaaccccatcgaggtggccattgatgagatgagcaagaaggtgtctgagctgaaccagctgtgcaccatggaggaggtggacatgatccggctgcagctgaagctgcagggctctgtgtctgtgaaggtgaatgccggccccatggcctatgcccgggccttcctggaggagaccaatgccaagaagtacccagacaaccaggtgaagctgctgaaggagatcttccggcagtttgctgatgcctgtggccaggccctggatgtgaatgaaagactcatcaaggaggaccagctggagtaccaggaggagctgcggagccactacaaggacatgctgtctgagctgagcacagtgatgaatgagcagatcaccggcagagatgacctgagcaagaggggcgtggaccagacctgcaccagggtcatcagcaaggccaccccagccctgcccaccgtgtccatcagcagcagcgctgaggtgtag

SEQ ID NO: 149645 - DNA, 2103 bp, Artificial Sequence
  Description of Artificial Sequence: Synthetic coding sequence
atgaccagcaacagcaatgaaattgacatcgtgcaccacgtggacacagaggccaacatcgccacagaggtgtgcctgaccatcctggacctgctgagcctcttcacccagacccaccagaggcagctgcagcagtgtgactgccagaacagcctgatgaagagggtgtttgacacctacatgctgttcttccaggtgaaccagagcgccacagccctgaagcacgtgtttgccagcctgcggctgtttgtgtgcaagttccccagcgccttcttccagggccctgctgacctgtgtggcagcttctgctatgaggtgctgaagtgctgcaaccacaggagccgcagcacccagacagaggccagcgccctgctgtacttcttcatgaggaagaactttgagttcaacaagcagaagagcatcgtgcgcagccacctgcagctgatcaaggctgtgtcccagctgattgctgatgctggcattggaggcagccgcttccagcacagcctggccatcaccaacaactttgccaacggggacaagcagatgaagaacagcaacttccctgctgaggtgaaggacctgaccaagaggatcagaacagtgctgatggccacagcccagatgaaggagcacgagaaggaccctgagatgctggtggacctgcagtacagcctggccaacagctatgccagcaccccagagctgcggaggacctggctggagagcatggccaagatccacgccagaaatggagacctgtctgaggccgccatgtgctacatccacatcgccgccctgattgctgagtacctgaagaggaagggcatgttctccatgggctggccagccttcctgagcatcacccccaacatcaaggaggagggcgccatgaaggaggacagcggcatgcaggacaccccctacaatgaaaacatcctggtggagcagctgtacatgtgtgtggagttcctgtggaagtcagaaagatatgagctgattgctgatgtgaacaagcccatcatcgctgtgtttgagaagcagagggacttcaagaagctgagtgacctgtactatgacatccacaggagctacctgaaggtggccgaggtggtgaacagcgagaagaggctgtttggccgctactacagagtggccttctacggccagggcgtgggcttctttgaggaggaggagggcaaggagtacatctacaaggagcccaagctgaccggcctgtctgagatcagccagaggctgctgaagctgtatgctgacaagtttggagctgacaacgtgaagatcatccaggacagcaacaaggtgaaccccaaggacctggaccccaagtatgcctacatccaggtgacctacgtgacccccttctttgaggagaaggagattgaggacaggaagacagactttgagatgcaccacaacatcaacagatttgtgtttgagacccccttcaccctgagcggcaagaagcatggaggagtggccgagcagtgcaagaggaggaccatcctgaccaccagccacctgttcccctacgtgaagaagaggatccaggtgatcagccagagcagcacagagctgaaccccatcgaggtggccattgatgagatgagcaagaaggtgtctgagctgaaccagctgtgcaccatggaggaggtggacatgatccggctgcagctgaagctgcagggctctgtgtctgtgaaggtgaatgccggccccatggcctatgcccgggccttcctggaggagaccaatgccaagaagtacccagacaaccaggtgaagctgctgaaggagatcttccggcagtttgctgatgcctgtggccaggccctggatgtgaatgaaagactcatcaaggaggaccagctggagtaccaggaggagctgcggagccactacaaggacatgctgtctgagctgagcacagtgatgaatgagcagctgtgccggggcccctgcctgtacagcttctgcagctctgtgagcagcatcagcctgagcacagtgtccaagagtgactatggccagggccggcctgtgaaggcccggagcggccccaacctgcacagcagcaactag

SEQ ID NO: 149646 - DNA, 6543 bp, Artificial Sequence
  Description of Artificial Sequence: Synthetic coding sequence
atgtccttccggggcaaggtgttcaagcgggagcccagcgagttctggaagaagagaagaacagtgagaagagtgaaccaggaggagatccaccgcttcagcagccaggagaagccccggctgctggagcccctggactatgaaacagtgattgaggagctggagaagacctacagaaatgaccccctgcaggacctgctcttcttccccagtgatgacttctctgctgccaccgtgtcctgggacatccgcaccctgtacagcacagtgcctgaagatgctgagcacaaggccgagaacctgctggtgaaggaggcctgcaagttctacagcagccagtggcacgtggtgaactacaagtatgagcagtacagcggggacatccggcagctgcccagggctgagtacaagccagagaagctgcccagccacagctttgaaattgaccatgaagatgctgacaaggatgaggacaccaccagccacagcagcagcaagggcggcggcggggccggcggcaccggggtcttcaagagcggctggctgtacaagggcaacttcaacagcacagtgaacaacacagtgacagtgcgctccttcaagaagcgctacttccagctgacccagctgcctgacaacagctacatcatgaacttctacaaggatgagaagatcagcaaggagcccaagggctgcatcttcctggacagctgcacaggagtggtgcagaacaaccggctgaggaaatatgcctttgagctgaagatgaatgacctgacctactttgtgctggccgctgagacagaaagtgacatggatgagtggatccacaccctgaaccgcatcctgcagatcagccctgagggccccctgcagggccgccgcagcacagagctgacagacctgggcctggacagcctggacaacagcgtgacctgtgagtgcaccccagaggagacagacagcagcgagaacaacctgcatgctgactttgccaagtacctgacagaaacagaagatactgtgaagaccaccaggaacatggagcggctgaacctcttcagcctggaccctgacatcgacaccctgaagctgcagaagaaggacctgctggagcctgagagcgtcatcaagccctttgaggagaaggccgccaagaggatcatgatcatctgcaaggccctgaacagcaacctgcagggctgtgtgacagaaaatgaaaatgaccccatcaccaacatcgagcccttctttgtgtctgtggccctgtatgacctgcgggacagcaggaagatctctgctgacttccacgtggacctgaaccacgccgctgtgcggcagatgctgctgggcgcctctgtggccctggagaatggaaatattgacaccatcaccccccggcagagcgaggagccccacatcaagggcctgcctgaggagtggctgaagttccccaagcaggccgtgttttctgtgagcaacccccacagcgagatcgtgctggtggccaagattgagaaggtgctgatgggcaacatcgccagcggggctgagccctacatcaagaacccagacagcaacaagtatgcccagaagatcctgaagagcaaccggcagttctgcagcaagctgggcaagtacaggatgccctttgcctgggccgtgcgctctgtgttcaaggacaaccagggcaatgtggaccgggacagccgcttcagccccctcttccggcaggagagcagcaagatcagcacagaggacctggtgaagctggtgtctgactaccgccgggctgaccgcatcagcaagatgcagaccatccctggcagcctggacattgctgtggacaacgtgcccctggagcaccccaactgtgtgaccagcagcttcatccctgtgaagcccttcaacatgatggcccagacagagcccaccgtggaggtggaggagtttgtgtatgacagcaccaagtactgccggccctacagagtgtacaagaaccagatctacatctaccccaagcacctgaagtatgacagccagaagtgcttcaacaaggccaggaacatcaccgtgtgcatcgagttcaagaacagtgatgaggagagcgccaagcccctgaagtgcatctacggcaagccaggcggccccctcttcaccagcgctgcctacacagctgtgctgcaccacagccagaacccagacttcagtgatgaggtgaagattgagctgcccacccagctgcacgagaagcaccacatcctcttctccttctaccacgtgacctgtgacatcaatgccaaggccaatgccaagaagaaggaggccctggagacctctgtgggctacgcctggctgcccctgatgaagcatgaccagatcgccagccaggagtacaacatccccatcgccaccagcctgccccccaactacctgtccttccaggacagcgccagcggcaagcacggcggcagtgacatcaagtgggtggatggcggcaagcccctcttcaaggtgtccacctttgtggtgtccacagtgaacacccaggacccccacgtgaatgccttcttccaggagtgccagaagcgggagaaggacatgagccagagccccaccagcaacttcatccgcagctgcaagaacctgctgaatgtggagaagatccacgccatcatgtccttcctgcccatcatcctgaaccagctgttcaaggtgctggtgcagaatgaggaggatgagatcaccaccaccgtgaccagggtgctgacagacatcgtggccaagtgccacgaggagcagctggaccacagcgtgcagagctacatcaagtttgtgttcaagacccgggcctgcaaggagaggacagtgcatgaggagctggccaagaatgtgacaggcctgctgaagagcaatgacagcaccaccgtgaagcacgtgctgaagcacagctggttcttctttgccatcatcctgaagtccatggcccagcacctgattgacaccaacaagatccagctgccccggccccagcgcttccctgagagctaccagaatgagctggacaacctggtgatggtgctgagtgaccacgtgatctggaagtacaaggatgccctggaggagacccggcgggccaaccacagcgtggcccgcttcctgaagcgctgcttcaccttcatggaccggggctacgtgttcaagatggtgaacaactacatctccatgttcagcagcggggacctgaagaccctgtgccagtacaagtttgacttcctgcaggaggtgtgccagcacgagcacttcatccccctgtgcctgcccatccgcagcgccaacatcccagaccccctgaccccatctgagagcacccaggagctgcacgccagtgacatgcctgagtacagcgtgaccaatgagttctgcaggaagcacttcctgattggcatcctgctgcgggaggtgggctttgccctgcaggaggaccaggatgtgcgccacctggccctggccgtgctgaagaacctgatggccaagcacagctttgatgaccgctaccgggagcccaggaagcaggcccagatcgccagcctgtacatgcccctgtatggcatgctgctggacaacatgccccgcatctacctgaaggacctgtaccccttcaccgtgaacaccagcaaccagggcagcagagatgacctgagcaccaatggaggcttccagagccagacagccatcaagcacgccaacagcgtggacaccagcttcagcaaggatgtgctgaacagcattgctgccttcagcagcatcgccatcagcacagtgaaccacgccgacagccgggccagcctggccagcctggacagcaaccccagcaccaatgagaagagcagcgagaagacagacaactgtgagaagatcccccggcccctgagcctcatcggcagcaccctgcgctttgacaagctggaccaggccgagaccaggagcctgctgatgtgcttcctgcacatcatgaagaccatctcctatgagaccctcatcgcctactggcagagggcccccagccctgaggtgtctgacttcttcagcatcctggatgtgtgcctgcagaacttccgctacctgggcaagaggaacatcatcaggaagattgctgctgccttcaagtttgtgcagagcacccagaacaacggcaccctgaagggcagcaaccccagctgccagaccagcggcctgctgagccagtggatgcacagcaccagcagccatgagggccacaagcagcacaggagccagaccctgcccatcatccggggcaagaatgccctgagcaaccccaagctgctgcagatgctggacaacaccatgaccagcaacagcaatgaaattgacatcgtgcaccacgtggacacagaggccaacatcgccacagaggtgtgcctgaccatcctggacctgctgagcctcttcacccagacccaccagaggcagctgcagcagtgtgactgccagaacagcctgatgaagagggtgtttgacacctacatgctgttcttccaggtgaaccagagcgccacagccctgaagcacgtgtttgccagcctgcggctgtttgtgtgcaagttccccagcgccttcttccagggccctgctgacctgtgtggcagcttctgctatgaggtgctgaagtgctgcaaccacaggagccgcagcacccagacagaggccagcgccctgctgtacttcttcatgaggaagaactttgagttcaacaagcagaagagcatcgtgcgcagccacctgcagctgatcaaggctgtgtcccagctgattgctgatgctggcattggaggcagccgcttccagcacagcctggccatcaccaacaactttgccaacggggacaagcagatgaagaacagcaacttccctgctgaggtgaaggacctgaccaagaggatcagaacagtgctgatggccacagcccagatgaaggagcacgagaaggaccctgagatgctggtggacctgcagtacagcctggccaacagctatgccagcaccccagagctgcggaggacctggctggagagcatggccaagatccacgccagaaatggagacctgtctgaggccgccatgtgctacatccacatcgccgccctgattgctgagtacctgaagaggaagggctactggaaggtggagaagatctgcacagccagcctgctgtctgaggacacccacccctgtgacagcaacagcctgctgaccacccccagcggcggctccatgttctccatgggctggccagccttcctgagcatcacccccaacatcaaggaggagggcgccatgaaggaggacagcggcatgcaggacaccccctacaatgaaaacatcctggtggagcagctgtacatgtgtgtggagttcctgtggaagtcagaaagatatgagctgattgctgatgtgaacaagcccatcatcgctgtgtttgagaagcagagggacttcaagaagctgagtgacctgtactatgacatccacaggagctacctgaaggtggccgaggtggtgaacagcgagaagaggctgtttggccgctactacagagtggccttctacggccagggcttctttgaggaggaggagggcaaggagtacatctacaaggagcccaagctgaccggcctgtctgagatcagccagaggctgctgaagctgtatgctgacaagtttggagctgacaacgtgaagatcatccaggacagcaacaaggtgaaccccaaggacctggaccccaagtatgcctacatccaggtgacctacgtgacccccttctttgaggagaaggagattgaggacaggaagacagactttgagatgcaccacaacatcaacagatttgtgtttgagacccccttcaccctgagcggcaagaagcacggcggcgtggccgagcagtgcaagaggaggaccatcctgaccaccagccacctgttcccctacgtgaagaagaggatccaggtgatcagccagagcagcacagagctgaaccccatcgaggtggccattgatgagatgagcaagaaggtgtctgagctgaaccagctgtgcaccatggaggaggtggacatgatccggctgcagctgaagctgcagggctctgtgtctgtgaaggtgaatgccggccccatggcctatgcccgggccttcctggaggagaccaatgccaagaagtacccagacaaccaggtgaagctgctgaaggagatcttccggcagtttgctgatgcctgtggccaggccctggatgtgaatgaaagactcatcaaggaggaccagctggagtaccaggaggagctgcggagccactacaaggacatgctgtctgagctgagcacagtgatgaatgagcagatcaccggcagagatgacctgagcaagaggggcgtggaccagacctgcaccagggtcatcagcaaggccaccccagccctgcccaccgtgtccatcagcagcagcgctgaggtgtag

SEQ ID NO: 149647 - DNA, 5493 bp, Artificial Sequence
  Description of Artificial Sequence: Synthetic coding sequence
atggccccctggaggaaggctgacaaggagagacatggagtggccatctacaacttccagggcagcggggccccccagctgagcctgcagattggagatgtggtgcgcatccaggagacctgtggggactggtaccggggctacctgatcaagcacaagatgctgcagggcatcttccccaagagcttcatccacatcaaggaggtgacagtggagaagagaagaaacacagagaacatcatcccagctgagatccccctggcccaggaggtgaccaccaccctgtgggagtggggcagcatctggaagcagctgtatgtggccagcaagaaggagcgcttcctgcaggtgcagagcatgatgtatgacctgatggagtggaggagccagctgctgagcggcaccctgcccaaggatgagctgaaggagctgaagcagaaggtgaccagcaagattgattatggcaacaagatcctggagctggacctgattgtgagagatgaagatggcaacatcctggaccctgacaacaccagcgtcatcagcctcttccacgcccacgaggaggccacagacaagatcacagagcgcatcaaggaggagatgagcaaggaccagcctgactatgccatgtacagccgcatcagcagcagccccacccacagcctgtatgtgtttgtgaggaactttgtgtgccgcatcggggaggatgctgagctgttcatgagcctgtatgaccccaacaagcagaccgtcatcagcgagaactacctggtgcgctggggcagccggggcttccccaaggagattgagatgctgaacaacctgaaggtggtgttcacagacctgggcaacaaggacctgaacagagacaagatctacctgatctgccagatcgtgcgggtgggcaagatggacctgaaggacaccggggccaagaagtgcacccagggcctgcggcggccctttggagtggccgtgatggacatcacagacatcatcaagggcaaggccgagagtgatgaggagaagcagcacttcatccccttccaccctgtgacagcagaaaatgacttcctgcacagcctgctgggcaaggtgattgccagcaaaggagacagcggcggccagggcctgtgggtgaccatgaagatgctggtgggggacatcatccagatcaggaaggactacccccacctggtggacaggaccaccgtggtggccaggaagctgggcttccctgagatcatcatgcctggagatgtgagaaatgacatctacatcaccctgctgcagggcgactttgacaagtacaacaagaccacccagagaaatgtggaggtgatcatgtgtgtgtgtgctgaagatggcaagaccctgcccaatgccatctgtgtgggcgctggggacaagcccatgaatgagtacagatctgtggtgtactaccaggtgaagcagccccgctggatggagaccgtgaaggtggccgtgcccatcgaggacatgcagaggatccacctgcgcttcatgttccgccacaggagcagcctggagagcaaggacaagggggagaagaactttgccatgtcctatgtgaagctgatgaaggaggatggcaccaccctgcatgatggcttccatgacctggtggtgctgaagggggacagcaagaagatggaggatgccagcgcctacctgaccctgcccagctaccgccaccacgtggagaacaagggggccaccctgagccgcagcagcagctctgtgggcggcctgtctgtgagcagcagagatgtgttcagcatcagcaccctggtgtgcagcaccaagctgacccagaatgtgggcctgctgggcctgctgaagtggaggatgaagccccagctgctgcaggagaacctggagaagctgaagatcgtggatggagaggaggtggtgaagttcctgcaggacaccctggatgccctcttcaacatcatgatggagcacagccagagtgatgaatatgacatcctggtgtttgatgccctgatctacatcatcggcctgattgctgacaggaagttccagcacttcaacacagtgctggaggcctacatccagcagcacttcagcgccaccctggcctacaagaagctgatgacagtgctgaagacctacctggacaccagcagcagaggagagcagtgtgagcccatcctgcggaccctgaaggccctggagtatgtgttcaagttcatcgtgcgcagcaggaccctcttcagccagctgtatgagggcaaggagcagatggagtttgaggagagcatgagaagactctttgagagcatcaacaacctgatgaagagccagtacaagaccaccatcctgctgcaggtggccgccctgaagtacatccccagcgtgctgcatgatgtggagatggtgtttgatgccaagctgctgagccagctgctgtatgagttctacacctgcatcccccctgtgaagctgcagaagcagaaggtgcagagcatgaatgagatcgtgcagagcaacctcttcaagaagcaggagtgccgggacatcctgctgcctgtgatcaccaaggagctgaaggagctgctggagcagaaggatgacatgcagcaccaggtgctggagaggaagtactgtgtggagctgctgaacagcatcctggaggtgctgagctaccaggatgctgccttcacctaccaccacatccaggagatcatggtgcagctgctgaggacagtgaacagaactgtcatcaccatgggccgggaccacatcctgatcagccactttgtggcctgcatgacagccatcctgaaccagatgggagaccagcactacagcttctacatcgagaccttccagaccagcagcgagctggtggacttcctgatggagaccttcatcatgttcaaggacctgattggcaagaatgtgtacccaggggactggatggccatgtccatggtgcagaacagagtcttcctgcgggccatcaacaagtttgctgagaccatgaaccagaagttcctggagcacaccaactttgagttccagctgtggaacaactacttccacctggccgtggccttcatcacccaggacagcctgcagctggagcagttcagccacgccaagtacaacaagatcctgaacaagtatggagacatgagaagactcatcggcttcagcatccgggacatgtggtacaagctgggccagaacaagatctgcttcatccctggcatggtgggccccatcctggagatgaccctcatccctgaggccgagctgaggaaggccaccatccccatcttctttgacatgatgctgtgtgagtaccagaggtctggggacttcaagaagtttgaaaatgagatcatcctgaagctggaccacgaggtggagggcggcagaggagatgagcagtacatgcagctgctggagagcatcctgatggagtgtgccgctgagcaccccaccatcgccaagtctgtggagaactttgtgaacctggtgaagggcctgctggagaagctgctggactaccggggcgtgatgacagatgagagcaaggacaacaggatgagctgcaccgtgaacctgctgaacttctacaaggacaacaaccgggaggagatgtacatccgctacctgtacaagctgcgggacctgcacctggactgtgacaactacacagaggccgcctacaccctgctgctgcacacctggctgctgaagtggagcgatgagcagtgtgccagccaggtgatgcagacaggccagcagcacccccagacccaccggcagctgaaggagaccctgtatgagaccatcatcggctactttgacaagggcaagatgtgggaggaggccatcagcctgtgcaaggagctggccgagcagtatgagatggagatctttgattatgagctgctgagccagaacctgatccagcaggccaagttctatgagagcatcatgaagatcctgcggcccaagccagactactttgctgtgggctactacggccagggcttccccagcttcctgaggaacaaggtgttcatctaccggggcaaggagtatgaaagaagagaggacttccagatgcagctgatgacccagttccccaatgctgagaagatgaacaccaccagcgcccctggagatgatgtgaagaatgcccctggccagtacatccagtgcttcaccgtgcagcctgtgctggatgagcacccccgcttcaagaacaagcctgtgcctgaccagatcatcaacttctacaagagcaactacgtgcagcgcttccactacagcaggcctgtgagaagaggcaccgtggaccctgaaaatgaatttgcctccatgtggattgaaagaaccagctttgtgacagcctacaagctgcccggcatcctgcgctggtttgaggtggtgcacatgagccagaccaccatcagccccctggagaatgccatcgagaccatgagcacagccaatgagaagatcctgatgatgatcaaccagtaccagagtgatgagaccctgcccatcaaccccctgtccatgctgctgaatggcatcgtggaccctgctgtgatgggcggctttgccaagtatgagaaggccttcttcacagaggagtatgtgcgggaccaccctgaggaccaggacaagctgacccacctgaaggacctgattgcctggcagatccccttcctgggcgccggcatcaagatccacgagaagagggtgtctgacaacctgcggcccttccatgacaggatggaggagtgcttcaagaacctgaagatgaaggtggagaaggagtatggagtgcgggagatgccagactttgatgaccggcgggtgggccggcccaggtccatgctgcggagctaccggcagatgagcatcatcagcctggcctccatgaacagcgactgcagcacccccagcaagcccaccagcgagagctttgacctggagctggccagccccaagaccccccgggtggagcaggaggagcccatcagccctggcagcaccctgcctgaggtgaagctgcggcgcagcaagaagaggaccaagaggagctctgtggtgtttgctgatgagaaggctgctgctgagagtgacctgaagaggctgagcaggaagcatgagttcatgtctgacaccaacctgtctgagcacgccgccatccccctgaaggcctctgtgctgagccagatgagctttgccagccagagcatgcccaccatcccagccctggccctgtctgtggccggcatccctggcctggatgaggccaacaccagcccccggctgagccagaccttcctgcagctgagtgatggagacaagaagaccctgaccaggaagaaggtgaaccagttcttcaagaccatgctggccagcaagtctgctgaggagggcaagcagatcccagacagcctgagcacagacctgtag

SEQ ID NO: 149648 - DNA, 1011 bp, Artificial Sequence
  Description of Artificial Sequence: Synthetic coding sequence
atgtgtgtgtgtgccgaggatggcaagaccctgcctgtggccgtgcccatcgaggacatgcagaggatccacctgcgcttcatgttccgccacaggagcagcctggagagcaaggacaagggggagaagaactttgccatgtcctatgtgaagctgatgaaggaggatggcaccaccctgcatgatggcttccatgacctggtggtgctgaagggggacagcaagaagatggaggatgccagcgcctacctgaccctgcccagctaccgccaccacgtggagaacaagggggccaccctgagccgcagcagcagctctgtgggcggcctgtctgtgagcagcagagatgtgttcagcatcagcaccctggtgtgcagcaccaagctgacccagaatgtgggcctgctgggcctgctgaagtggaggatgaagccccagctggaggagagcatgaggcggctgtttgagagcatcaacaacctgatgaagagccagtacaagaccaccatcctgctgcaggtggccgccctgaagtacatccccagcgtgctgcatgatgtggagatggtgtttgatgccaagctgctgagccagctgctgtatgagttctacacctgcatcccccctgtgaagctgcagaagcagaaggtgcagagcatgaatgaaattgtgcagagcaacctcttcaagaagcaggagtgccgggacatcctgctgcccgtcatcaccaaggagctgaaggagctgctggagcagaaggatgacatgcagcaccaggtgctggagaggaagtactgtgtggagctgctgaacagcatcctggaggtgctgagctaccaggatgctgccttcacctaccaccacatccaggagatcatggtgcagctgctgaggacagtgaacagaactgtcatcaccatgggccgggaccacatcctgattggagcctgctgcaactgtggcttccccagcagcaccccccacagcctcatccagtggctgtggggctag

SEQ ID NO: 149649 - DNA, 2676 bp, Artificial Sequence
  Description of Artificial Sequence: Synthetic coding sequence
atgacagccatcctgaaccagatgggagaccagcactacagcttctacatcgagaccttccagaccagcagcgagctggtggacttcctgatggagaccttcatcatgttcaaggacctgattggcaagaatgtgtacccaggggactggatggccatgtccatggtgcagaacagagtcttcctgcgggccatcaacaagtttgctgagaccatgaaccagaagttcctggagcacaccaactttgagttccagctgtggaacaactacttccacctggccgtggccttcatcacccaggacagcctgcagctggagcagttcagccacgccaagtacaacaagatcctgaacaagtacggggacatgaggcggctgattggcttcagcatccgggacatgtggtacaagctgggccagaacaagatctgcttcatccctggcatggtgggccccatcctggagatgaccctcatccctgaggccgagctgaggaaggccaccatccccatcttctttgacatgatgctgtgtgagtaccagaggtctggggacttcaagaagtttgaaaatgagatcatcctgaagctggaccacgaggtggagggcggcagaggagatgagcagtacatgcagctgctggagagcatcctgatggagtgtgccgctgagcaccccaccatcgccaagtctgtggagaactttgtgaacctggtgaagggcctgctggagaagctgctggactacagaggagtgatgacagatgagagcaaggacaacaggatgagctgcaccgtgaacctgctgaacttctacaaggacaacaaccgggaggagatgtacatccgctacctgtacaagctgcgggacctgcacctggactgtgacaactacacagaagctgcctacaccctgctgctgcacacctggctgctgaagtggagcgatgagcagtgtgccagccaggtgatgcagacaggccagcagcacccccagacccaccggcagctgaaggagaccctgtatgagaccatcatcggctactttgataaaggcaagatgtgggaggaggccatcagcctgtgcaaggagctggccgagcagtatgagatggagatctttgattatgagctgctgagccagaacctgatccagcaggccaagttctatgagagcatcatgaagatcctgcggcccaagccagactactttgctgtgggctactacggccagggcttccccagcttcctgaggaacaaggtgttcatctaccggggcaaggagtatgaaagaagagaggacttccagatgcagctgatgacccagttccccaatgctgagaagatgaacaccaccagcgcccctggagatgatgtgaagaatgcccctggccagtacatccagtgcttcaccgtgcagcctgtgctggatgagcacccccgcttcaagaacaagcctgtgcctgaccagatcatcaacttctacaagagcaactacgtgcagcgcttccactacagcaggcctgtgcggcggggcaccgtggaccctgaaaatgaatttgcctccatgtggattgaaagaaccagctttgtgacagcctacaagctgcccggcatcctgcgctggtttgaggtggtgcacatgagccagaccaccatcagccccctggagaatgccatcgagaccatgagcacagccaatgagaagatcctgatgatgatcaaccagtaccagagtgatgagaccctgcccatcaaccccctgtccatgctgctgaatggaattgtggaccctgctgtgatgggcggctttgccaagtatgagaaggccttcttcacagaggagtatgtgcgggaccaccctgaggaccaggacaagctgacccacctgaaggacctgattgcctggcagatccccttcctgggcgccggcatcaagatccacgagaagagggtgtctgacaacctgcggcccttccatgacaggatggaggagtgcttcaagaacctgaagatgaaggtggagaaggagtatggagtgcgggagatgccagactttgatgacagaagagtgggccggcccaggtccatgctgcggagctaccggcagatgagcatcatcagcctggcctccatgaacagcgactgcagcacccccagcaagcccaccagcgagagctttgacctggagctggccagccccaagaccccccgggtggagcaggaggagcccatcagccctggcagcaccctgcctgaggtgaagctgcggcgcagcaagaagaggaccaagaggagctctgtggtgtttgctgatgagaaggctgctgctgagagtgacctgaagaggctgagcaggaagcatgagttcatgtctgacaccaacctgtctgaacatgctgccatccccctgaaggcctctgtgctgagccagatgagctttgccagccagagcatgcccaccatcccagccctggccctgtctgtggccggcatccctggcctggatgaggccaacaccagcccccggctgagccagaccttcctgcagctgagtgatggagacaagaagaccctgaccaggaagaaggtgaaccagttcttcaagaccatgctggccagcaagtctgctgaggagggcaagcagatcccagacagcctgagcacagacctgtag

SEQ ID NO: 149650 - DNA, 6093 bp, Artificial Sequence
  Description of Artificial Sequence: Synthetic coding sequence
atgtggacccccacagaggaggagaagtatggagtggtgatctgcagcttccggggctctgtgccccagggcctggtgctggagattggagagaccgtgcagatcctggagaagtgtgagggctggtacagaggagtgtccaccaagaagcccaacgtgaagggcatcttccctgccaactacatccacctgaagaaggccatcgtgagcaacagaggccagtatgaaacagtggtgcccctggaggacagcatcgtgacagaggtgacagccaccctgcaggagtgggccagcctgtggaagcagctgtatgtgaagcacaaggtggacctcttctacaagctgcggcacgtgatgaatgagctgattgacctgcggcggcagctgctgagcggccacctgacccaggaccaggtgcgggaggtgaagaggcacatcaccgtgcggctggactggggcaatgagcacctgggcctggacctggtgcccaggaaggactttgaggtggtggacagcgaccagatctctgtgtctgacctgtacaagatgcacctgagcagccggcagagcgtgcagcagagcaccagccaggtggacaccatgaggcccaggcatggagagacctgcaggatgcctgtgccccaccacttcttcctgagcctgaagagcttcacctacaacaccatcggggaggacacagatgtgttcttcagcctgtatgacatgagggagggcaagcagatcagcgagcgcttcctggtgcggctgaacaagaatggaggccccagaaatcctgagaagattgaaagaatgtgtgccctcttcacagacctgagcagcaaggacatgaagagggacctgtacatcgtggcccacgtgatccgcatcggccgcatgctgctgaatgacagcaagaagggccccccccacctgcactaccgccggccctacggctgtgctgtgctgagcatcctggatgtgctgcagagcctgacagaggtgaaggaggagaaggactttgtgctgaaggtgtacacctgcaacaatgaaagtgagtggagccagatccacgagaacatcatcaggaagagcagcgccaagtacagcgcccccagcgccagccacggcctcatcatcagcctgcagctgctgcggggggacatggagcagatccggcgggagaaccccatgatcttcaacagaggcctggccatcaccaggaagctgggcttcccagatgtgatcatgcctggggacatcagaaatgacctgtacctgaccctggagaagggggactttgagcggggcggcaagtctgtgcagaagaacatcgaggtgaccatgtatgtgctgtatgcagatggagagatcctgaaggactgcatcagcctgggcagcggggagcccaacagaagcagctaccacagctttgtgctgtaccacagcaacagcccccgctggggcgagatcatcaagctgcccatccccatcgaccgcttccggggcagccacctgcgctttgagttccgccactgcagcaccaaggacaagggggagaagaagctgtttggatttgccttcagcaccctgatgagagatgatggcaccaccctgagtgatgacatccacgagctgtatgtgtacaagtgtgatgagaacagcaccttcaacaaccacgccctgtacctgggcctgccctgctgcaaggaggactacaacggctgccccaacatccccagcagcctcatcttccagaggagcaccaaggagagcttcttcatcagcacccagctgagcagcaccaagctgacccagaatgtggacctgctggccctgctgaagtggaaggccttcccagaccgcatcatggatgtgctgggccgcctgcggcacgtgtctggagaggagatcgtgaagttcctgcaggacatcctggacaccctgtttgtgatcctggatgacaacacagagaagtatggcctgctggtgttccagagcctggtgttcatcatcaacctgctgcgggacatcaagtacttccacttccggcctgtgatggacacctacatccagaagcactttgctggggccctggcctacaaggagctgatccgctgcctgaagtggtacatggactgcagcgctgagctgatccggcaggaccacatccaggaggccatgagggccctggagtacctgttcaagttcatcgtgcagagccgcatcctgtacagccgggccacctgtggcatggaggaggagcagttccgcagcagcatccaggagctgttccagagcatccgctttgtgctgagcctggacagcaggaacagcgagaccctgctcttcacccaggccgccctgctgaacagcttccccaccatctttgatgagctgctgcagatgttcaccgtgcaggaggtggccgagtttgtgcggggcaccctgggctccatgcccagcacagtgcacatcggccagagcatggatgtggtgaagctgcagagcatcgccaggacagtggacagccgcctcttctccttcagcgagagccgccgcatcctgctgcctgtggtgctgcaccacatccacctgcacctgcggcagcagaaggagctgctgatctgcagcggcatcctgggcagcatcttcagcatcgtgaagaccagcagcctggaggctgatgtgatggaggaggtggagatgatggtggagagcctgctggatgtgctgctgcagaccctgctgaccatcatgagcaagagccacgcccaggaggccgtgcggggccagcgctgcccccagtgcacagctgagatcactggagaatatgtgtcctgcctgctgagcctgctgcggcagatgtgtgacacccacttccagcacctgctggacaacttccagagcaaggatgagctgaaggagttcctgctgaagatcttctgtgtgttcaggaacctgatgaagatgtctgtgttcccccgggactggatggtgatgaggctgctgaccagcaacatcatcgtgaccaccgtgcagtacctgagcagcgccctgcacaagaacttcacagaaacagactttgacttcaaggtgtggaacagctacttcagcctggccgtgctcttcatcaaccagcccagcctgcagctggagatcatcaccagcgccaagaggaagaagatcctggacaagtacggggacatgagggtgatgatggcctatgagctgttctccatgtggcagaacctgggggagcacaagatccacttcatccctggcatgattggccccttcctgggcgtgaccctggtgccccagcctgaggtgaggaacatcatgatccccatcttccatgacatgatggactgggagcagaggaagaatggaaacttcaagcaggtggaggccgagctgattgacaagctggacagcatggtgtctgagggcaaaggagatgagagctaccgggagctgttcagcctgctgacccagctgtttggcccctaccccagcctgctggagaaggtggagcaggagacctggagggagaccggcatcagctttgtgacctctgtgacccggctgatggagcggctgctggactacagagactgcatgaagggggaggagacagagaacaagaagattggctgcaccgtgaacctgatgaacttctacaagtctgagatcaacaaggaggagatgtacatccgctacatccacaagctgtgtgacatgcacctgcaggccgagaactacacagaagctgccttcaccctgctgctgtactgtgagctgctgcagtgggaggaccggcccctgcgggagttcctgcactaccccagccagacagagtggcagaggaaggagggcctgtgcaggaagatcatccactacttcaacaagggcaagtcctgggagtttggcatccccctgtgccgggagctggcctgccagtatgagagcctgtatgactaccagagcctgtcctggatcaggaagatggaggccagctactatgacaacatcatggagcagcagaggctggagcctgagttcttccgggtgggcttctacggcaggaagttccccttcttcctgaggaacaaggagtatgtgtgccggggccatgactatgaaaggctggaggccttccagcagaggatgctgtctgagttcccccaggccgtggccatgcagcaccccaaccacccagatgatgccatcctgcagtgtgatgcccagtacctgcagatctatgctgtgacccccatcccagactatgtggatgtgctgcagatggacagagtgcctgacagagtgaagagcttctacagagtgaacaacgtgaggaagttccgctatgaccggcccttccacaagggccccaaggacaaggaaaatgagttcaagagcctgtggattgaaagaaccaccctgaccctgacccacagcctgcccggcatcagccgctggtttgaggtggagcggcgggagctggtggaggtgagccccctggagaatgccatccaggtggtggagaacaagaaccaggagctgcggagcctcatcagccagtaccagcacaagcaggtgcacggcaacatcaacctgctgtccatgtgcctgaatggagtgattgatgctgctgtgaatggaggcatcgcccgctaccaggaggccttctttgacaaggactacatcaacaagcaccctggagatgctgagaagatcacccagctgaaggagctgatgcaggagcaggtgcacgtgctgggcgtgggcctggccgtgcatgagaagtttgtgcaccctgagatgaggcccctgcacaagaagctgattgaccagttccagatgatgagggccagcctgtaccacgagttccctggcctggacaagctgagccctgcctgcagcggcaccagcaccccaagaggaaatgtgctggccagccacagccccatgagccctgagagcatcaagatgacccaccgccacagccccatgaacctgatgggcaccggccgccacagcagcagcagcctgagcagccacgccagcagcgaggccggcaacatggtgatgctgggagatggctccatgggagatgcccctgaggacctgtaccaccacatgcagctggcctaccccaacccccgctaccagggctctgtgaccaacgtgtctgtgctgagcagcagccaggccagccccagcagcagcagcctgagcagcacccacagcgcccccagccagatgatcaccagcgcccccagcagcgcccggggcagccccagcctgcctgacaagtacagacatgcccgggagatgatgctgctgctgcccacctacagagaccggcccagcagcgccatgtacccagctgccatcctggagaatggccagccccccaacttccagagggccctcttccagcaggtggtgggcgcctgcaagccctgcagcgaccccaacctgtctgtggccgagaagggccactacagcctgcactttgatgccttccaccaccccctgggggacaccccaccagccctgcctgcccggaccctgaggaagagccccctgcaccccatcccagccagccccaccagcccccagagcggcctggatggcagcaacagcaccctgagcggcagcgccagcagtggagtgagcagcctgtctgagagcaactttggccacagcagcgaggccccacccaggacagacaccatggacagcatgcccagccaggcctggaatgctgatgaggacctggagcccccctacctgcctgtgcactacagcctgtctgagagcgctgtgctggacagcatcaaggcccagccctgccgcagccacagcgcccctggctgtgtgatcccccaggaccccatggaccccccagccctgccccccaagccctaccacccccggctgcctgccctggagcatgatgagggcgtgctgctgcgggaggagacagagcggccccggggcctgcacaggaaggcccccctgcccccaggcagcgccaaggaggagcaggccaggatggcctgggagcacggccgcggggagcagtag

SEQ ID NO: 149651 - DNA, 1785 bp, Artificial Sequence
  Description of Artificial Sequence: Synthetic coding sequence
atgcccaagtggctggaggagacagagaacaagaagattggctgcaccgtgaacctgatgaacttctacaagtctgagatcaacaaggaggagatgtacatccgctacatccacaagctgtgtgacatgcacctgcaggccgagaactacacagaagctgccttcaccctgctgctgtactgtgagctgctgcagtgggaggaccggcccctgcgggagttcctgcactaccccagccagacagagtggcagaggaaggagggcctgtgcaggaagatcatccactacttcaacaagggcaagtcctgggagtttggcatccccctgtgccgggagctggcctgccagtatgagagcctgtatgactaccagagcctgtcctggatcaggaagatggaggccagctactatgacaacatcatggagcagcagaggctggagcctgagttcttccgggtgggcttctacggcaggaagttccccttcttcctgaggaacaaggagtatgtgtgccggggccatgactatgaaaggctggaggccttccagcagaggatgctgtctgagttcccccaggccgtggccatgcagcaccccaaccacccagatgatgccatcctgcagtgtgatgcccagtacctgcagatctatgctgtgacccccatcccagactatgtggatgtgctgcagatggacagagtgcctgacagagtgaagagcttctacagagtgaacaacgtgaggaagttccgctatgaccggcccttccacaagggccccaaggacaaggaaaatgagttcaagagcctgtggattgaaagaaccaccctgaccctgacccacagcctgcccggcatcagccgctggtttgaggtggagcggcgggagctggtggaggtgagccccctggagaatgccatccaggtggtggagaacaagaaccaggagctgcggagcctcatcagccagtaccagcacaagcaggtgcacggcaacatcaacctgctgtccatgtgcctgaatggagtgattgatgctgctgtgaatggaggcatcgcccgctaccaggaggccttctttgacaaggactacatcaacaagcaccctggagatgctgagaagatcacccagctgaaggagctgatgcaggagcaggtgcacgtgctgggcgtgggcctggccgtgcatgagaagtttgtgcaccctgagatgaggcccctgcacaagaagctgattgaccagttccagatgatgagggccagcctgtaccacgagttccctggcctggacaagctgagccctgcctgcagcggcaccagcaccccaagaggaaatgtgctggccagccacagccccatgagccctgagagcatcaagatgacccaccgccacagccccatgaacctgatgggcaccggccgccacagcagcagcagcctgagcagccacgccagcagcgaggccggcaacatggtgatgctgggagatggctccatgggagatgcccctgaggacctgtaccaccacatgcagctggcctaccccaacccccgctaccagggctctgtgaccaacgtgtctgtgctgagcagcagccaggccagccccagcagcagcagcctgagcagcacccacagcgcccccagccagatgatcaccagcgcccccagcagcgcccggggcagccccagcctgcctgacaagtacagacatgcccgggagatgatgctgctgctgcccacctacagagaccggcccagcagcgccatgtacccagctgcctag

SEQ ID NO: 149652 - DNA, 5778 bp, Artificial Sequence
  Description of Artificial Sequence: Synthetic coding sequence
gtcatcgccagcttccggggcaccgtgccctacggcctgagcctggagattggagacacagtgcagatcctggagaagtgtgatggctggtaccggggctttgccctgaagaaccccaacatcaagggcatcttccccagcagctatgtgcacctgaagaatgcctgtgtgaagaacaagggccagtttgagatggtgatccccacagaggacagcgtcatcacagagatgaccagcaccctgcgggactggggcaccatgtggaagcagctgtatgtgagaaatgaaggagacctcttccaccggctgtggcacatcatgaatgagatcctggacctgcggcggcaggtgctggtgggccacctgacccatgacaggatgaaggatgtgaagaggcacatcacagcccggctggactggggcaatgagcagctgggcctggacctggtgcccaggaaggagtatgccatggtggaccctgaggacatcagcatcacagagctgtaccgcctgatggagcaccgccacaggaagaaggacacccctgtgcaggccagcagccaccacctgtttgtgcagatgaagagcctgatgtgcagcaacctgggggaggagctggaggtgatcttcagcctgtttgacagcaaagaaaatcggcccatcagcgagcgcttcttcctgcggctgaacagaaatggcctgcccaaggccccagacaagccagagcggcactgcagcctgtttgtggacctgggcagcagcgagctgaggaaggacatctacatcaccgtgcacatcatcagaattggaaggatgggcgctggggagaagaagaatgcctgcagcgtgcagtaccgccggcccttcggctgtgctgtgctgagcattgctgacctgctgactggagagaccaaggatgacctgatcctgaaggtgtacatgtgcaacacagaaagtgagtggtaccagatccacgagaacatcatcaagaagctgaatgcccgctacaacctgaccggcagcaatgccggcctggccgtgtccctgcagctgctgcatggagacatcgagcagatccggcgggagtacagctctgtgttcagccatggagtgtccatcaccaggaagctgggcttcagcaacatcatcatgcctggagagatgagaaatgacctgtacatcaccatcgagcggggggagtttgagaagggcggcaagtctgtggccagaaatgtggaggtgaccatgttcatcgtggacagcagcggccagaccctgaaggacttcatcagctttggcagcggggagcccccagccagcgagtaccacagctttgtgctgtaccacaacaacagcccccgctggagcgagctgctgaagctgcccatccctgtggacaagttccggggggcccacatccgctttgagttccgccactgcagcaccaaggagaagggggagaagaagctgtttggcttctcctttgtgcccctgatgcaggaggatggccgcaccctgcctgatggcacccatgagctgattgtgcacaagtgtgaggagaacaccaacctgcaggacaccacccgctacctgaagctgcccttcagcaagggcatcttcctgggcaacaacaaccaggccatgaaggccaccaaggagagcttctgcatcaccagcttcctgtgcagcaccaagctgacccagaatggagacatgctggacctgctgaagtggaggacccacccagacaagatcaccggctgcctgagcaagctgaaggagattgatggcagcgagatcgtgaagttcctgcaggacaccctggacaccctgtttggcatcctggatgagaacagccagaagtatggcagcaaggtgtttgacagcctggtgcacatcatcaacctgctgcaggacagcaagttccaccacttcaagcctgtgatggacacctacatcgagagccactttgctggggccctggcctacagagacctgatcaaggtgctgaagtggtacgtggaccgcatcacagaggccgagcggcaggagcacatccaggaggtgctgaaggcccaggagtacatcttcaagtacatcgtgcagagccggcggctcttcagcctggccactggaggccagaatgaggaggagttccgctgctgcatccaggagctgctgatgtctgtgcgcttcttcctgagccaggagagcaaaggaagtggggccctgagccagagccaggccgtgttcctgagcagcttccctgctgtgtacagcgagctgctgaagctgtttgatgtgcgggaggtggccaacctggtgcaggacaccctgggcagcctgcccaccatcctgcacgtggatgacagcctgcaggccatcaagctgcagtgcatcggcaagacagtggagagccagctgtacaccaacccagacagccgctacatcctgctgcctgtggtgctgcaccacctgcacatccacctgcaggagcagaaggacctgatcatgtgtgcccgcatcctgagcaatgtgttctgcctgatcaagaagaacagcagcgagaagtctgtgctggaggagattgatgtgattgtggccagcctgctggacatcctgctgcggaccatcctggagatcaccagccggccccagcccagcagcagcgccatgaggttccagttccaggatgtgactggagaatttgtggcctgcctgctgagcctgctgcggcagatgacagacagacactaccagcagctgctggacagcttcaacaccaaggaggagctgcgggacttcctgctgcagatcttcaccgtcttccgcatcctgatccggcctgagatgttccccaaggactggacagtgatgaggctggtggccaacaacgtcatcatcaccaccgtgctgtacctgagtgatgccctgaggaagaacttcctgaatgaaaattttgactacaagatctgggacagctacttctacctggccgtcatcttcatcaaccagctgtgcctgcagctggagatgttcacccccagcaagaagaagaaggtgctggagaagtatggagacatgagggtgaccatgggctgtgagatcttctccatgtggcagaacctgggggagcacaagctgcacttcatcccagccctgattggccccttcctggaggtgaccctcatcccccagcctgacctgagaaatgtgatgatccccatcttccatgacatgatggactgggagcagaggaggagcggcaacttcaagcaggtggaggccaagctgattgacaagctggacagcctgatgtctgagggcaaaggagatgagacctaccgggagctgttcaacagcatcatccccctgtttggcccctaccccagcctgctgaagaagattgaaagagagacctggagggagagcggcgtgtccctgattgccaccgtgacccggctgatggagcggctgctggactacagagactgcatgaagatgggagaggtggatggcaagaagattggctgcaccgtgtccctgctgaacttctacaagacagagctgaacaaggaggagatgtacatccgctacatccacaagctgtatgacctgcacctgaaggcccagaacttcacagaggccgcctacaccctgctgctgtatgatgagctgctggagtggagcgaccggcccctgcgggagttcctgacctaccccatgcagacagagtggcagaggaaggagcacctgcacctgaccatcatccagaactttgaccggggcaagtgctgggagaatggcatcatcctgtgcaggaagattgctgagcagtatgagagctactatgactacagaaacctgagcaagatgaggatgatggaggccagcctgtatgacaagatcatggaccagcagaggctggagcctgagttcttccgggtgggcttctacggcaagaagttccccttcttcctgaggaacaaggagtttgtgtgccggggccatgactatgagcggctggaggccttccagcagaggatgctgaatgagttcccccacgccatcgccatgcagcacgccaaccagccagatgagaccatcttccaggccgaggcccagtacctgcagatctatgctgtgacccccatccctgagagccaggaggtgctgcagcgggagggcgtgcctgacaacatcaagagcttctacaaggtgaaccacatctggaagttccgctatgaccggcccttccacaagggcaccaaggacaaggaaaatgagttcaagagcctgtgggtggagaggaccagcctgtacctggtgcagagcctgcccggcatcagccgctggtttgaggtggagaagcgggaggtggtggagatgagccccctggagaatgccatcgaggtgctggagaacaagaaccagcagctgaagaccctcatcagccagtgccagacccggcagatgcagaacatcaaccccctgaccatgtgcctgaatggagtgattgatgctgctgtgaatggaggagtgagccgctaccaggaggccttctttgtgaaggagtacatcctgagccacccagaagatggagagaagatcgcccggctgcgggagctgatgctggagcaggcccagatcctggagtttggcctggccgtgcatgagaagtttgtgccccaggacatgaggcccctgcacaagaagctggtggaccagttctttgtgatgaagagcagcctgggcatccaggagttcagcgcctgcatgcaggccagccctgtgcacttccccaacggcagcccccgggtgtgcagaaattctgccccagcctctgtgtccccagatggcaccagggtcatcccccggcgcagccccctgagctacccagctgtgaaccgctacagcagcagcagcctgagcagccaggccagcgctgaggtgagcaacatcaccggccagagcgagagcagtgatgaggtgttcaacatgcagcccagccccagcaccagcagcctgagcagcacccacagcgccagccccaacgtgaccagcagcgcccccagcagcgcccgggccagccccctgctgagtgacaagcacaagcacagccgggagaacagctgcctgagcccccgggagcggccctgcagcgccatctaccccacccctgtggagcccagccagaggatgctgttcaaccacatcggagatggagccctgcccaggagtgaccccaacctgagcgcccctgagaaggccagccctgcccggcacaccacctctgtgagccccagccctgctggccgcagccccctgaagggctctgtgcagagcttcacccccagccctgtggagtaccacagccctggcctcatcagcaacagccctgtgctgagcggcagctacagcagcggcatcagcagcctgagccgctgcagcaccagcgagaccagcggctttgagaaccaggtgaatgagcagagcgcccccctgcctgtgcctgtgcctgtgcctgtgcccagctatggaggagaggagcctgtgaggaaggagagcaagaccccaccaccctacagcgtgtatgaaagaaccctgcggcggcctgtgcccctgccccacagcctgagcatccctgtgaccagcgagcccccagccctgccccccaagcccctggccgcccggagcagccacctggagaatggagccaggagaacagatcctggcccccggccccggcccctgcccaggaaggtgtcccagctgtag

SEQ ID NO: 149653 - DNA, 5865 bp, Artificial Sequence
  Description of Artificial Sequence: Synthetic coding sequence
gtcatcgccagcttccggggcaccgtgccctacggcctgagcctggagattggagacacagtgcagatcctggagaagtgtgatggctggtaccggggctttgccctgaagaaccccaacatcaagggcatcttccccagcagctatgtgcacctgaagaatgcctgtgtgaagaacaagggccagtttgagatggtgatccccacagaggacagcgtcatcacagagatgaccagcaccctgcgggactggggcaccatgtggaagcagctgtatgtgagaaatgaaggagacctcttccaccggctgtggcacatcatgaatgagatcctggacctgcggcggcaggtgctggtgggccacctgacccatgacaggatgaaggatgtgaagaggcacatcacagcccggctggactggggcaatgagcagctgggcctggacctggtgcccaggaaggagtatgccatggtggaccctgaggacatcagcatcacagagctgtaccgcctgatggagcaccgccacaggaagaaggacacccctgtgcaggccagcagccaccacctgtttgtgcagatgaagagcctgatgtgcagcaacctgggggaggagctggaggtgatcttcagcctgtttgacagcaaagaaaatcggcccatcagcgagcgcttcttcctgcggctgaacagaaatggcctgcccaaggccccagacaagccagagcggcactgcagcctgtttgtggacctgggcagcagcgagctgaggaaggacatctacatcaccgtgcacatcatcagaattggaaggatgggcgctggggagaagaagaatgcctgcagcgtgcagtaccgccggcccttcggctgtgctgtgctgagcattgctgacctgctgactggagagaccaaggatgacctgatcctgaaggtgtacatgtgcaacacagaaagtgagtggtaccagatccacgagaacatcatcaagaagctgaatgcccgctacaacctgaccggcagcaatgccggcctggccgtgtccctgcagctgctgcatggagacatcgagcagatccggcgggagtacagctctgtgttcagccatggagtgtccatcaccaggaagctgggcttcagcaacatcatcatgcctggagagatgagaaatgacctgtacatcaccatcgagcggggggagtttgagaagggcggcaagtctgtggccagaaatgtggaggtgaccatgttcatcgtggacagcagcggccagaccctgaaggacttcatcagctttggcagcggggagcccccagccagcgagtaccacagctttgtgctgtaccacaacaacagcccccgctggagcgagctgctgaagctgcccatccctgtggacaagttccggggggcccacatccgctttgagttccgccactgcagcaccaaggagaagggggagaagaagctgtttggcttctcctttgtgcccctgatgcaggaggatggccgcaccctgcctgatggcacccatgagctgattgtgcacaagtgtgaggagaacaccaacctgcaggacaccacccgctacctgaagctgcccttcagcaagggcatcttcctgggcaacaacaaccaggccatgaaggccaccaaggagagcttctgcatcaccagcttcctgtgcagcaccaagctgacccagaatggagacatgctggacctgctgaagtggaggacccacccagacaagatcaccggctgcctgagcaagctgaaggagattgatggcagcgagatcgtgaagttcctgcaggacaccctggacaccctgtttggcatcctggatgagaacagccagaagtatggcagcaaggtgtttgacagcctggtgcacatcatcaacctgctgcaggacagcaagttccaccacttcaagcctgtgatggacacctacatcgagagccactttgctggggccctggcctacagagacctgatcaaggtgctgaagtggtacgtggaccgcatcacagaggccgagcggcaggagcacatccaggaggtgctgaaggcccaggagtacatcttcaagtacatcgtgcagagccggcggctcttcagcctggccactggaggccagaatgaggaggagttccgctgctgcatccaggagctgctgatgtctgtgcgcttcttcctgagccaggagagcaaaggaagtggggccctgagccagagccaggccgtgttcctgagcagcttccctgctgtgtacagcgagctgctgaagctgtttgatgtgcgggaggtggccaacctggtgcaggacaccctgggcagcctgcccaccatcctgcacgtggatgacagcctgcaggccatcaagctgcagtgcatcggcaagacagtggagagccagctgtacaccaacccagacagccgctacatcctgctgcctgtggtgctgcaccacctgcacatccacctgcaggagcagaaggacctgatcatgtgtgcccgcatcctgagcaatgtgttctgcctgatcaagaagaacagcagcgagaagtctgtgctggaggagattgatgtgattgtggccagcctgctggacatcctgctgcggaccatcctggagatcaccagccggccccagcccagcagcagcgccatgaggttccagttccaggatgtgactggagaatttgtggcctgcctgctgagcctgctgcggcagatgacagacagacactaccagcagctgctggacagcttcaacaccaaggaggagctgcgggacttcctgctgcagatcttcaccgtcttccgcatcctgatccggcctgagatgttccccaaggactggacagtgatgaggctggtggccaacaacgtcatcatcaccaccgtgctgtacctgagtgatgccctgaggaagaacttcctgaatgaaaattttgactacaagatctgggacagctacttctacctggccgtcatcttcatcaaccagctgtgcctgcagctggagatgttcacccccagcaagaagaagaaggtgctggagaagtatggagacatgagggtgaccatgggctgtgagatcttctccatgtggcagaacctgggggagcacaagctgcacttcatcccagccctgattggccccttcctggaggtgaccctcatcccccagcctgacctgagaaatgtgatgatccccatcttccatgacatgatggactgggagcagaggaggagcggcaacttcaagcaggtggaggccaagctgattgacaagctggacagcctgatgtctgagggcaaaggagatgagacctaccgggagctgttcaacagcatcctgctgaagaagattgagcgggagacctggagggagagcggcgtgtccctcatcgccaccgtgacccggctgatggagcggctgctggactacagagactgcatgaagatgggagaggtggatggcaagaagattggctgcaccgtgtccctgctgaacttctacaagacagagctgaacaaggaggagatgtacatccgctacatccacaagctgtatgacctgcacctgaaggcccagaacttcacagaagctgcctacaccctgctgctgtatgatgagctgctggagtggagcgaccggcccctgcgggagttcctgacctaccccatgcagacagagtggcagaggaaggagcacctgcacctgaccatcatccagaactttgaccggggcaagtgctgggagaatggcatcatcctgtgcaggaagattgctgagcagtatgagagctactatgactacagaaacctgagcaagatgaggatgatggaggccagcctgtatgacaagatcatggaccagcagaggctggagcctgagttcttccgggtgggcttctacggcaagaagttccccttcttcctgaggaacaaggagtttgtgtgccggggccatgactatgaaaggctggaggccttccagcagaggatgctgaatgagttcccccacgccatcgccatgcagcacgccaaccagccagatgagaccatcttccaggccgaggcccagtacctgcagatctatgctgtgacccccatccctgagagccaggaggtgctgcagcgggagggcgtgcctgacaacatcaagagcttctacaaggtgaaccacatctggaagttccgctatgaccggcccttccacaagggcaccaaggacaaggaaaatgagttcaagagcctgtgggtggagaggaccagcctgtacctggtgcagagcctgcccggcatcagccgctggtttgaggtggagaagcgggaggtggtggagatgagccccctggagaatgccatcgaggtgctggagaacaagaaccagcagctgaagaccctcatcagccagtgccagacccggcagatgcagaacatcaaccccctgaccatgtgcctgaatggagtgattgatgctgctgtgaatggaggagtgagccgctaccaggaggccttctttgtgaaggagtacatcctgagccacccagaagatggagagaagatcgcccggctgcgggagctgatgctggagcaggcccagatcctggagtttggcctggccgtgcatgagaagtttgtgccccaggacatgaggcccctgcacaagaagctggtggaccagttctttgtgatgaagagcagcctgggcatccaggagttcagcgcctgcatgcaggccagccctgtgcacttccccaacggcagcccccgggtgtgcaggaacagcgccccagcctctgtgtccccagatggcaccagggtcatccccaggaggagccccctgagctacccagctgtgaaccgctacagcagcagcagcctgagcagccaggccagcgctgaggtgagcaacatcaccggccagagcgagagcagtgatgaggtgttcaacatgcagcccagccccagcaccagcagcctgagcagcacccacagcgccagccccaacgtgaccagcagcgcccccagcagcgcccgggccagccccctgctgagtgacaagcacaagcacagccgggagaacagctgcctgagcccccgggagcggccctgcagcgccatctaccccacccctgtggagcccagccagaggatgctgttcaaccacatcggagatggagccctgcccaggagtgaccccaacctgagcgcccctgagaaggctgtgaaccccacccccagctcctggagcctggacagcggcaaggaggccaagaacatgtctgacagcggcaagctgatcagcccccctgtgcccccccggcccacccagacagccagccctgcccggcacaccacctctgtgagccccagccctgctggccgcagccccctgaagggctctgtgcagagcttcacccccagccctgtggagtaccacagccctggcctcatcagcaacagccctgtgctgagcggcagctacagcagcggcatcagcagcctgagccgctgcagcaccagcgagaccagcggctttgagaaccaggtgaatgagcagagcgcccccctgcctgtgcctgtgcctgtgcctgtgcccagctatggaggagaggagcctgtgaggaaggagagcaagaccccaccaccctacagcgtgtatgaaagaaccctgcggcggcctgtgcccctgccccacagcctgagcatccctgtgaccagcgagcccccagccctgccccccaagcccctggccgcccggagcagccacctggagaatggagcccggaggacagaccccggcccccggccccggcccctgcccaggaaggtgtcccagctgtag

SEQ ID NO: 149654 - DNA, 5928 bp, Artificial Sequence
  Description of Artificial Sequence: Synthetic coding sequence
atgtggatccccacagaacatgagaagtatggagtggtgattgccagcttccggggcaccgtgccctacggcctgagcctggagattggagacacagtgcagatcctggagaagtgtgatggctggtaccggggctttgccctgaagaaccccaacatcaagggcatcttccccagcagctatgtgcacctgaagaatgcctgtgtgaagaacaagggccagtttgagatggtgatccccacagaggacagcgtcatcacagagatgaccagcaccctgcgggactggggcaccatgtggaagcagctgtatgtgagaaatgaaggagacctcttccaccggctgtggcacatcatgaatgagatcctggacctgcggcggcaggtgctggtgggccacctgacccatgacaggatgaaggatgtgaagaggcacatcacagcccggctggactggggcaatgagcagctgggcctggacctggtgcccaggaaggagtatgccatggtggaccctgaggacatcagcatcacagagctgtaccgcctgatggagcaccgccacaggaagaaggacacccctgtgcaggccagcagccaccacctgtttgtgcagatgaagagcctgatgtgcagcaacctgggggaggagctggaggtgatcttcagcctgtttgacagcaaagaaaatcggcccatcagcgagcgcttcttcctgcggctgaacagaaatggcctgcccaaggccccagacaagccagagcggcactgcagcctgtttgtggacctgggcagcagcgagctgaggaaggacatctacatcaccgtgcacatcatcagaattggaaggatgggcgctggggagaagaagaatgcctgcagcgtgcagtaccgccggcccttcggctgtgctgtgctgagcattgctgacctgctgactggagagaccaaggatgacctgatcctgaaggtgtacatgtgcaacacagaaagtgagtggtaccagatccacgagaacatcatcaagaagctgaatgcccgctacaacctgaccggcagcaatgccggcctggccgtgtccctgcagctgctgcatggagacatcgagcagatccggcgggagtacagctctgtgttcagccatggagtgtccatcaccaggaagctgggcttcagcaacatcatcatgcctggagagatgagaaatgacctgtacatcaccatcgagcggggggagtttgagaagggcggcaagtctgtggccagaaatgtggaggtgaccatgttcatcgtggacagcagcggccagaccctgaaggacttcatcagctttggcagcggggagcccccagccagcgagtaccacagctttgtgctgtaccacaacaacagcccccgctggagcgagctgctgaagctgcccatccctgtggacaagttccggggggcccacatccgctttgagttccgccactgcagcaccaaggagaagggggagaagaagctgtttggcttctcctttgtgcccctgatgcaggaggatggccgcaccctgcctgatggcacccatgagctgattgtgcacaagtgtgaggagaacaccaacctgcaggacaccacccgctacctgaagctgcccttcagcaagggcatcttcctgggcaacaacaaccaggccatgaaggccaccaaggagagcttctgcatcaccagcttcctgtgcagcaccaagctgacccagaatggagacatgctggacctgctgaagtggaggacccacccagacaagatcaccggctgcctgagcaagctgaaggagattgatggcagcgagatcgtgaagttcctgcaggacaccctggacaccctgtttggcatcctggatgagaacagccagaagtatggcagcaaggtgtttgacagcctggtgcacatcatcaacctgctgcaggacagcaagttccaccacttcaagcctgtgatggacacctacatcgagagccactttgctggggccctggcctacagagacctgatcaaggtgctgaagtggtacgtggaccgcatcacagaggccgagcggcaggagcacatccaggaggtgctgaaggcccaggagtacatcttcaagtacatcgtgcagagccggcggctcttcagcctggccactggaggccagaatgaggaggagttccgctgctgcatccaggagctgctgatgtctgtgcgcttcttcctgagccaggagagcaaaggaagtggggccctgagccagagccaggccgtgttcctgagcagcttccctgctgtgtacagcgagctgctgaagctgtttgatgtgcgggaggtggccaacctggtgcaggacaccctgggcagcctgcccaccatcctgcacgtggatgacagcctgcaggccatcaagctgcagtgcatcggcaagacagtggagagccagctgtacaccaacccagacagccgctacatcctgctgcctgtggtgctgcaccacctgcacatccacctgcaggagcagaaggacctgatcatgtgtgcccgcatcctgagcaatgtgttctgcctgatcaagaagaacagcagcgagaagtctgtgctggaggagattgatgtgattgtggccagcctgctggacatcctgctgcggaccatcctggagatcaccagccggccccagcccagcagcagcgccatgaggttccagttccaggatgtgactggagaatttgtggcctgcctgctgagcctgctgcggcagatgacagacagacactaccagcagctgctggacagcttcaacaccaaggaggagctgcgggacttcctgctgcagatcttcaccgtcttccgcatcctgatccggcctgagatgttccccaaggactggacagtgatgaggctggtggccaacaacgtcatcatcaccaccgtgctgtacctgagtgatgccctgaggaagaacttcctgaatgaaaattttgactacaagatctgggacagctacttctacctggccgtcatcttcatcaaccagctgtgcctgcagctggagatgttcacccccagcaagaagaagaaggtgctggagaagtatggagacatgagggtgaccatgggctgtgagatcttctccatgtggcagaacctgggggagcacaagctgcacttcatcccagccctgattggccccttcctggaggtgaccctcatcccccagcctgacctgagaaatgtgatgatccccatcttccatgacatgatggactgggagcagaggaggagcggcaacttcaagcaggtggaggccaagctgattgacaagctggacagcctgatgtctgagggcaaaggagatgagacctaccgggagctgttcaacagcatcatccccctgtttggcccctaccccagcctgctgaagaagattgaaagagagacctggagggagagcggcgtgtccctgattgccaccgtgacccggctgatggagcggctgctggactacagagactgcatgaagatgggagaggtggatggcaagaagattggctgcaccgtgtccctgctgaacttctacaagacagagctgaacaaggaggagatgtacatccgctacatccacaagctgtatgacctgcacctgaaggcccagaacttcacagaggccgcctacaccctgctgctgtatgatgagctgctggagtggagcgaccggcccctgcgggagttcctgacctaccccatgcagacagagtggcagaggaaggagcacctgcacctgaccatcatccagaactttgaccggggcaagtgctgggagaatggcatcatcctgtgcaggaagattgctgagcagtatgagagctactatgactacagaaacctgagcaagatgaggatgatggaggccagcctgtatgacaagatcatggaccagcagaggctggagcctgagttcttccgggtgggcttctacggcaagaagttccccttcttcctgaggaacaaggagtttgtgtgccggggccatgactatgagcggctggaggccttccagcagaggatgctgaatgagttcccccacgccatcgccatgcagcacgccaaccagccagatgagaccatcttccaggccgaggcccagtacctgcagatctatgctgtgacccccatccctgagagccaggaggtgctgcagcgggagggcgtgcctgacaacatcaagagcttctacaaggtgaaccacatctggaagttccgctatgaccggcccttccacaagggcaccaaggacaaggaaaatgagttcaagagcctgtgggtggagaggaccagcctgtacctggtgcagagcctgcccggcatcagccgctggtttgaggtggagaagcgggaggtggtggagatgagccccctggagaatgccatcgaggtgctggagaacaagaaccagcagctgaagaccctcatcagccagtgccagacccggcagatgcagaacatcaaccccctgaccatgtgcctgaatggagtgattgatgctgctgtgaatggaggagtgagccgctaccaggaggccttctttgtgaaggagtacatcctgagccacccagaagatggagagaagatcgcccggctgcgggagctgatgctggagcaggcccagatcctggagtttggcctggccgtgcatgagaagtttgtgccccaggacatgaggcccctgcacaagaagctggtggaccagttctttgtgatgaagagcagcctgggcatccaggagttcagcgcctgcatgcaggccagccctgtgcacttccccaacggcagcccccgggtgtgcagaaattctgccccagcctctgtgtccccagatggcaccagggtcatcccccggcgcagccccctgagctacccagctgtgaaccgctacagcagcagcagcctgagcagccaggccagcgctgaggtgagcaacatcaccggccagagcgagagcagtgatgaggtgttcaacatgcagcccagccccagcaccagcagcctgagcagcacccacagcgccagccccaacgtgaccagcagcgcccccagcagcgcccgggccagccccctgctgagtgacaagcacaagcacagccgggagaacagctgcctgagcccccgggagcggccctgcagcgccatctaccccacccctgtggagcccagccagaggatgctgttcaaccacatcggagatggagccctgcccaggagtgaccccaacctgagcgcccctgagaaggctgtgaaccccacccccagctcctggagcctggacagcggcaaggaggccaagaacatgtctgattctgggaagctgatcagcccccctgtgcccccccggcccacccagacagccagccctgcccggcacaccacctctgtgagccccagccctgctggccgcagccccctgaagggctctgtgcagagcttcacccccagccctgtggagtaccacagccctggcctcatcagcaacagccctgtgctgagcggcagctacagcagcggcatcagcagcctgagccgctgcagcaccagcgagaccagcggctttgagaaccaggtgaatgagcagagcgcccccctgcctgtgcctgtgcctgtgcctgtgcccagctatggaggagaggagcctgtgaggaaggagagcaagaccccaccaccctacagcgtgtatgaaagaaccctgcggcggcctgtgcccctgccccacagcctgagcatccctgtgaccagcgagcccccagccctgccccccaagcccctggccgcccggagcagccacctggagaatggagccaggagaacagatcctggcccccggccccggcccctgcccaggaaggtgtcccagctgtag

SEQ ID NO: 149655 - DNA, 5901 bp, Artificial Sequence
  Description of Artificial Sequence: Synthetic coding sequence
atgtggatccccacagaacatgagaagtatggagtggtgattgccagcttccggggcaccgtgccctacggcctgagcctggagattggagacacagtgcagatcctggagaagtgtgatggctggtaccggggctttgccctgaagaaccccaacatcaagggcatcttccccagcagctatgtgcacctgaagaatgcctgtgtgaagaacaagggccagtttgagatggtgatccccacagaggacagcgtcatcacagagatgaccagcaccctgcgggactggggcaccatgtggaagcagctgtatgtgagaaatgaaggagacctcttccaccggctgtggcacatcatgaatgagatcctggacctgcggcggcaggtgctggtgggccacctgacccatgacaggatgaaggatgtgaagaggcacatcacagcccggctggactggggcaatgagcagctgggcctggacctggtgcccaggaaggagtatgccatggtggaccctgaggacatcagcatcacagagctgtaccgcctgatggagcaccgccacaggaagaaggacacccctgtgcaggccagcagccaccacctgtttgtgcagatgaagagcctgatgtgcagcaacctgggggaggagctggaggtgatcttcagcctgtttgacagcaaagaaaatcggcccatcagcgagcgcttcttcctgcggctgaacagaaatggcctgcccaaggccccagacaagccagagcggcactgcagcctgtttgtggacctgggcagcagcgagctgaggaaggacatctacatcaccgtgcacatcatcagaattggaaggatgggcgctggggagaagaagaatgcctgcagcgtgcagtaccgccggcccttcggctgtgctgtgctgagcattgctgacctgctgactggagagaccaaggatgacctgatcctgaaggtgtacatgtgcaacacagaaagtgagtggtaccagatccacgagaacatcatcaagaagctgaatgcccgctacaacctgaccggcagcaatgccggcctggccgtgtccctgcagctgctgcatggagacatcgagcagatccggcgggagtacagctctgtgttcagccatggagtgtccatcaccaggaagctgggcttcagcaacatcatcatgcctggagagatgagaaatgacctgtacatcaccatcgagcggggggagtttgagaagggcggcaagtctgtggccagaaatgtggaggtgaccatgttcatcgtggacagcagcggccagaccctgaaggacttcatcagctttggcagcggggagcccccagccagcgagtaccacagctttgtgctgtaccacaacaacagcccccgctggagcgagctgctgaagctgcccatccctgtggacaagttccggggggcccacatccgctttgagttccgccactgcagcaccaaggagaagggggagaagaagctgtttggcttctcctttgtgcccctgatgcaggaggatggccgcaccctgcctgatggcacccatgagctgattgtgcacaagtgtgaggagaacaccaacctgcaggacaccacccgctacctgaagctgcccttcagcaagggcatcttcctgggcaacaacaaccaggccatgaaggccaccaaggagagcttctgcatcaccagcttcctgtgcagcaccaagctgacccagaatggagacatgctggacctgctgaagtggaggacccacccagacaagatcaccggctgcctgagcaagctgaaggagattgatggcagcgagatcgtgaagttcctgcaggacaccctggacaccctgtttggcatcctggatgagaacagccagaagtatggcagcaaggtgtttgacagcctggtgcacatcatcaacctgctgcaggacagcaagttccaccacttcaagcctgtgatggacacctacatcgagagccactttgctggggccctggcctacagagacctgatcaaggtgctgaagtggtacgtggaccgcatcacagaggccgagcggcaggagcacatccaggaggtgctgaaggcccaggagtacatcttcaagtacatcgtgcagagccggcggctcttcagcctggccactggaggccagaatgaggaggagttccgctgctgcatccaggagctgctgatgtctgtgcgcttcttcctgagccaggagagcaaaggaagtggggccctgagccagagccaggccgtgttcctgagcagcttccctgctgtgtacagcgagctgctgaagctgtttgatgtgcgggaggtggccaacctggtgcaggacaccctgggcagcctgcccaccatcctgcacgtggatgacagcctgcaggccatcaagctgcagtgcatcggcaagacagtggagagccagctgtacaccaacccagacagccgctacatcctgctgcctgtggtgctgcaccacctgcacatccacctgcaggagcagaaggacctgatcatgtgtgcccgcatcctgagcaatgtgttctgcctgatcaagaagaacagcagcgagaagtctgtgctggaggagattgatgtgattgtggccagcctgctggacatcctgctgcggaccatcctggagatcaccagccggccccagcccagcagcagcgccatgaggttccagttccaggatgtgactggagaatttgtggcctgcctgctgagcctgctgcggcagatgacagacagacactaccagcagctgctggacagcttcaacaccaaggaggagctgcgggacttcctgctgcagatcttcaccgtcttccgcatcctgatccggcctgagatgttccccaaggactggacagtgatgaggctggtggccaacaacgtcatcatcaccaccgtgctgtacctgagtgatgccctgaggaagaacttcctgaatgaaaattttgactacaagatctgggacagctacttctacctggccgtcatcttcatcaaccagctgtgcctgcagctggagatgttcacccccagcaagaagaagaaggtgctggagaagtatggagacatgagggtgaccatgggctgtgagatcttctccatgtggcagaacctgggggagcacaagctgcacttcatcccagccctgattggccccttcctggaggtgaccctcatcccccagcctgacctgagaaatgtgatgatccccatcttccatgacatgatggactgggagcagaggaggagcggcaacttcaagcaggtggaggccaagctgattgacaagctggacagcctgatgtctgagggcaaaggagatgagacctaccgggagctgttcaacagcatcctgctgaagaagattgagcgggagacctggagggagagcggcgtgtccctcatcgccaccgtgacccggctgatggagcggctgctggactacagagactgcatgaagatgggagaggtggatggcaagaagattggctgcaccgtgtccctgctgaacttctacaagacagagctgaacaaggaggagatgtacatccgctacatccacaagctgtatgacctgcacctgaaggcccagaacttcacagaagctgcctacaccctgctgctgtatgatgagctgctggagtggagcgaccggcccctgcgggagttcctgacctaccccatgcagacagagtggcagaggaaggagcacctgcacctgaccatcatccagaactttgaccggggcaagtgctgggagaatggcatcatcctgtgcaggaagattgctgagcagtatgagagctactatgactacagaaacctgagcaagatgaggatgatggaggccagcctgtatgacaagatcatggaccagcagaggctggagcctgagttcttccgggtgggcttctacggcaagaagttccccttcttcctgaggaacaaggagtttgtgtgccggggccatgactatgaaaggctggaggccttccagcagaggatgctgaatgagttcccccacgccatcgccatgcagcacgccaaccagccagatgagaccatcttccaggccgaggcccagtacctgcagatctatgctgtgacccccatccctgagagccaggaggtgctgcagcgggagggcgtgcctgacaacatcaagagcttctacaaggtgaaccacatctggaagttccgctatgaccggcccttccacaagggcaccaaggacaaggaaaatgagttcaagagcctgtgggtggagaggaccagcctgtacctggtgcagagcctgcccggcatcagccgctggtttgaggtggagaagcgggaggtggtggagatgagccccctggagaatgccatcgaggtgctggagaacaagaaccagcagctgaagaccctcatcagccagtgccagacccggcagatgcagaacatcaaccccctgaccatgtgcctgaatggagtgattgatgctgctgtgaatggaggagtgagccgctaccaggaggccttctttgtgaaggagtacatcctgagccacccagaagatggagagaagatcgcccggctgcgggagctgatgctggagcaggcccagatcctggagtttggcctggccgtgcatgagaagtttgtgccccaggacatgaggcccctgcacaagaagctggtggaccagttctttgtgatgaagagcagcctgggcatccaggagttcagcgcctgcatgcaggccagccctgtgcacttccccaacggcagcccccgggtgtgcaggaacagcgccccagcctctgtgtccccagatggcaccagggtcatccccaggaggagccccctgagctacccagctgtgaaccgctacagcagcagcagcctgagcagccaggccagcgctgaggtgagcaacatcaccggccagagcgagagcagtgatgaggtgttcaacatgcagcccagccccagcaccagcagcctgagcagcacccacagcgccagccccaacgtgaccagcagcgcccccagcagcgcccgggccagccccctgctgagtgacaagcacaagcacagccgggagaacagctgcctgagcccccgggagcggccctgcagcgccatctaccccacccctgtggagcccagccagaggatgctgttcaaccacatcggagatggagccctgcccaggagtgaccccaacctgagcgcccctgagaaggctgtgaaccccacccccagctcctggagcctggacagcggcaaggaggccaagaacatgtctgacagcggcaagctgatcagcccccctgtgcccccccggcccacccagacagccagccctgcccggcacaccacctctgtgagccccagccctgctggccgcagccccctgaagggctctgtgcagagcttcacccccagccctgtggagtaccacagccctggcctcatcagcaacagccctgtgctgagcggcagctacagcagcggcatcagcagcctgagccgctgcagcaccagcgagaccagcggctttgagaaccaggtgaatgagcagagcgcccccctgcctgtgcctgtgcctgtgcctgtgcccagctatggaggagaggagcctgtgaggaaggagagcaagaccccaccaccctacagcgtgtatgaaagaaccctgcggcggcctgtgcccctgccccacagcctgagcatccctgtgaccagcgagcccccagccctgccccccaagcccctggccgcccggagcagccacctggagaatggagcccggaggacagaccccggcccccggccccggcccctgcccaggaaggtgtcccagctgtag

SEQ ID NO: 149656 - DNA, 2550 bp, Artificial Sequence
  Description of Artificial Sequence: Synthetic coding sequence
atgaagatgcacagcacagagcgcatccccctgtttggcccctaccccagcctgctgaagaagattgaaagagagacctggagggagagcggcgtgtccctgattgccaccgtgacccggctgatggagcggctgctggactacagagactgcatgaagatgggagaggtggatggcaagaagattggctgcaccgtgtccctgctgaacttctacaagacagagctgaacaaggaggagatgtacatccgctacatccacaagctgtatgacctgcacctgaaggcccagaacttcacagaggccgcctacaccctgctgctgtatgatgagctgctggagtggagcgaccggcccctgcgggagttcctgacctaccccatgcagacagagtggcagaggaaggagcacctgcacctgaccatcatccagaactttgaccggggcaagtgctgggagaatggcatcatcctgtgcaggaagattgctgagcagtatgagagctactatgactacagaaacctgagcaagatgaggatgatggaggccagcctgtatgacaagatcatggaccagcagaggctggagcctgagttcttccgggtgggcttctacggcaagaagttccccttcttcctgaggaacaaggagtttgtgtgccggggccatgactatgagcggctggaggccttccagcagaggatgctgaatgagttcccccacgccatcgccatgcagcacgccaaccagccagatgagaccatcttccaggccgaggcccagtacctgcagatctatgctgtgacccccatccctgagagccaggaggtgctgcagcgggagggcgtgcctgacaacatcaagagcttctacaaggtgaaccacatctggaagttccgctatgaccggcccttccacaagggcaccaaggacaaggaaaatgagttcaagagcctgtgggtggagaggaccagcctgtacctggtgcagagcctgcccggcatcagccgctggtttgaggtggagaagcgggaggtggtggagatgagccccctggagaatgccatcgaggtgctggagaacaagaaccagcagctgaagaccctcatcagccagtgccagacccggcagatgcagaacatcaaccccctgaccatgtgcctgaatggagtgattgatgctgctgtgaatggaggagtgagccgctaccaggaggccttctttgtgaaggagtacatcctgagccacccagaagatggagagaagatcgcccggctgcgggagctgatgctggagcaggcccagatcctggagtttggcctggccgtgcatgagaagtttgtgccccaggacatgaggcccctgcacaagaagctggtggaccagttctttgtgatgaagagcagcctgggcatccaggagttcagcgcctgcatgcaggccagccctgtgcacttccccaacggcagcccccgggtgtgcagaaattctgccccagcctctgtgtccccagatggcaccagggtcatcccccggcgcagccccctgagctacccagctgtgaaccgctacagcagcagcagcctgagcagccaggccagcgctgaggtgagcaacatcaccggccagagcgagagcagtgatgaggtgttcaacatgcagcccagccccagcaccagcagcctgagcagcacccacagcgccagccccaacgtgaccagcagcgcccccagcagcgcccgggccagccccctgctgagtgacaagcacaagcacagccgggagaacagctgcctgagcccccgggagcggccctgcagcgccatctaccccacccctgtggagcccagccagaggatgctgttcaaccacatcggagatggagccctgcccaggagtgaccccaacctgagcgcccctgagaaggctgtgaaccccacccccagctcctggagcctggacagcggcaaggaggccaagaacatgtctgattctgggaagctgatcagcccccctgtgcccccccggcccacccagacagccagccctgcccggcacaccacctctgtgagccccagccctgctggccgcagccccctgaagggctctgtgcagagcttcacccccagccctgtggagtaccacagccctggcctcatcagcaacagccctgtgctgagcggcagctacagcagcggcatcagcagcctgagccgctgcagcaccagcgagaccagcggctttgagaaccaggtgaatgagcagagcgcccccctgcctgtgcctgtgcctgtgcctgtgcccagctatggaggagaggagcctgtgaggaaggagagcaagaccccaccaccctacagcgtgtatgaaagaaccctgcggcggcctgtgcccctgccccacagcctgagcatccctgtgaccagcgagcccccagccctgccccccaagcccctggccgcccggagcagccacctggagaatggagccaggagaacagatcctggcccccggccccggcccctgcccaggaaggtgtcccagctgtag

SEQ ID NO: 149657 - DNA, 3318 bp, Artificial Sequence
  Description of Artificial Sequence: Synthetic coding sequence
tggatccccagcgagaagcagaccttcttcaccgtgattgccagcttccggggcaccgtgccctacggcctgagcctggagatcggggacacagtgcagatcctggagaagtgtgatggctggtaccggggctttgccctgaagaaccccaacatcaagggcatcttccccagcagctatgtgcacctgaagaatgcctgtgtgaagaacaagggccagtttgagatggtgatccccacagaagattctgtcatcacagagatgaccagcaccctgcgggactggggcaccatgtggaagcagctgtatgtgagaaatgaaggagacctcttccaccggctgtggcacatcatgaatgagatcctggacctgcggcggcaggtgctggtgggccacctgacccatgacaggatgaaggatgtgaagaggcacatcacagcccggctggactggggcaatgagcagctgggcctggacctggtgcccaggaaggagtatgccatggtggaccctgaggacatcagcatcacagagctgtaccgcctgatggagcaccgccacaggaagaaggacacccctgtgcaggccagcagccaccacctgtttgtgcagatgaagagcctgatgtgcagcaacctgggggaggagctggaggtgatcttcagcctgtttgacagcaaggagaaccggcccatcagcgagcgcttcttcctgcggctgaacagaaatggcctgcccaaggccccagacaagccagagcggcactgcagcctgtttgtggacctgggcagcagcgagctgaggaaggacatctacatcaccgtgcacatcatccgcatcggccgcatgggcgctggggagaagaagaatgcctgcagcgtgcagtacagaagacccttcggctgtgctgtgctgagcattgctgacctgctgaccggggagaccaaggatgacctgatcctgaaggtgtacatgtgcaacacagagagcgagtggtaccagatccacgagaacatcatcaagaagctgaatgcccgctacaacctgaccggcagcaatgccggcctggccgtgtccctgcagctgctgcacggggacatcgagcagatcagaagagagtacagcagcgtcttcagccacggcgtgtccatcaccaggaagctgggcttcagcaacatcatcatgcctggagagatgagaaatgacctgtacatcaccatcgagcggggggagtttgagaagggcggcaagtctgtggccagaaatgtggaggtgaccatgtttattgtggacagcagcggccagaccctgaaggacttcatcagctttggaagtggagagcccccagccagcgagtaccacagctttgtgctgtaccacaacaacagcccccgctggagcgagctgctgaagctgcccatccctgtggacaagttccggggggcccacatccgctttgagttccgccactgcagcaccaaggagaagggggagaagaagctgtttggcttctcctttgtgcccctgatgcaggaggatggccgcaccctgcctgatggcacccatgagctgattgtgcacaagtgtgaggagaacaccaacctgcaggacaccacccgctacctgaagctgcccttcagcaagggcatcttcctgggcaacaacaaccaggccatgaaggccaccaaggagagcttctgcatcaccagcttcctgtgcagcaccaagctgacccagaatggagacatgctggacctgctgaagtggaggacccacccagacaagatcaccggctgcctgagcaagctgaaggagattgatggcagcgagatcgtgaagttcctgcaggacaccctggacaccctgtttggcatcctggatgagaacagccagaagtatggcagcaaggtgtttgacagcctggtgcacatcatcaacctgctgcaggacagcaagttccaccacttcaagcctgtgatggacacctacatcgagagccactttgctggggccctggcctacagagacctgatcaaggtgctgaagtggtacgtggaccgcatcacagaagctgagcggcaggagcacatccaggaggtgctgaaggcccaggagtacatcttcaagtacatcgtgcagagcagaagactcttcagcctggccaccggcggccagaatgaggaggagttccgctgctgcatccaggagctgctgatgtctgtgcgcttcttcctgagccaggagagcaagggcagcggggccctgagccagagccaggccgtgttcctgagcagcttccctgctgtgtacagcgagctgctgaagctgtttgatgtgcgggaggtggccaacctggtgcaggacaccctgggcagcctgcccaccatcctgcacgtggatgacagcctgcaggccatcaagctgcagtgcatcggcaagacagtggagagccagctgtacaccaacccagacagccgctacatcctgctgcctgtggtgctgcaccacctgcacatccacctgcaggagcagaaggacctgatcatgtgtgcccgcatcctgagcaatgtgttctgcctgatcaagaagaacagcagcgagaagtctgtgctggaggagattgatgtgattgtggccagcctgctggacatcctgctgcggaccatcctggagatcaccagccggccccagcccagcagcagcgccatgaggttccagttccaggatgtgactggagaatttgtggcctgcctgctgagcctgctgcggcagatgacagacagacactaccagcagctgctggacagcttcaacaccaaggaggagctgcgggacttcctgctgcagatcttcaccgtcttccgcatcctgatccggcctgagatgttccccaaggactggacagtgatgaggctggtggccaacaacgtcatcatcaccaccgtgctgtacctgagtgatgccctgaggaagaacttcctgaatgaaaattttgactacaagatctgggacagctacttctacctggccgtcatcttcatcaaccagctgtgcctgcagctggagatgttcacccccagcaagaagaagaaggtgctggagaagtacggggacatgagggtgaccatgggctgtgagatcttctccatgtggcagaacctgggggagcacaagctgcacttcatcccagccctgcggcaggagaaccggctgaacctgggcggcggcggctgcagcgagccccgggcctgccactgcaccccagcctgggccaccaagagggactgtgtgtccaagaagaaggagaagaagacctag

SEQ ID NO: 149658 - DNA, 6144 bp, Artificial Sequence
  Description of Artificial Sequence: Synthetic coding sequence
atggccgccagcgagcggcgggcctttgcccacaagatcaacagaacagtggccgctgaggtgaggaagcaggtgtcccgggagaggagcggcagcccccacagcagccgccgctgcagcagcagcctgggcgtgcccctgacagaggtggtggagcccctggactttgaagatgtgctgctgagccggcccccagatgctgagcccggccccctgcgggacctggtggagttcccagcagatgacctggagctgctgctgcagcccagagaatgtaggaccacagagcccggcatccccaaggatgagaagctggatgcccaggtgcgggctgctgtggagatgtacatcgaggactgggtgattgtgcaccggcgctaccagtacctgtctgctgcctacagccctgtgaccacagacacccagcgggagcggcagaagggcctgccccggcaggtgtttgagcaggatgccagcggagatgagaggagcggccctgaggacagcaatgacagcagaagaggcagcggcagccctgaggacacccccaggagcagcggggccagcagcatctttgacctgaggaacctggccgctgacagcctgctgcccagcctgctggagcgggccgccccagaagatgtggacagaagaaatgagaccctgcggcggcagcaccggcccccagccctgctgaccctgtacccagccccagatgaagatgaagctgtggagcgctgcagcaggcctgagcccccccgggagcacttcggccagaggatcctggtgaagtgcctgagcctgaagtttgaaattgaaattgagcccatcttcggcatcctggccctgtatgatgtgcgggagaagaagaagatcagcgagaacttctactttgacctgaacagcgacagcatgaagggcctgctgcgggcccacggcacccacccagccatcagcaccctggcccggagcgccatcttctctgtgacctaccccagcccagacatcttcctggtgatcaagctggagaaggtgctgcagcagggcgacatcagcgagtgctgtgagccctacatggtgctgaaggaggtggacacagccaagaacaaggagaagctggagaagctgcggctggccgctgagcagttctgcacccggctgggccgctacaggatgccctttgcctggacagctgtgcacctggccaacatcgtgtcctctgctggccagctggaccgggacagcgacagcgagggggagaggaggcctgcctggacagacagaagaagaagaggcccccaggaccgggccagcagtggagatgatgcctgcagcttcagcggcttccggcctgccaccctgactgtgaccaacttcttcaagcaggaggccgagcggctgagtgatgaggacctcttcaagttcctggccgacatgaggcggcccagcagcctgctgcggcggctgcggcctgtgacagcccagctgaagattgacatcagccctgcccctgagaacccccacttctgcctgagccctgagctgctgcacatcaagccctacccagacccccggggccggcccaccaaggagatcctggagttccctgcccgggaggtgtatgccccccacaccagctacagaaacctgctgtatgtgtacccccacagcctgaacttcagcagccggcagggctctgtgaggaacctggccgtgcgggtgcagtacatgaccggggaggaccccagccaggccctgcctgtgatctttgggaagagcagctgcagcgagttcacccgggaggccttcacccctgtggtgtaccacaacaagagccctgagttctatgaggagttcaagctgcacctgcctgcctgtgtgacagagaaccaccacctgctcttcaccttctaccacgtgtcctgccagccccggcccggcacagccctggagacccctgtgggcttcacctggatccccctgctgcagcacggccgcctgaggacaggccccttctgcctgcctgtgtctgtggaccagcccccacccagctacagcgtgctgaccccagatgtggccctgcccggcatgcgctgggtggatggccacaagggcgtcttctctgtggagctgacagctgtgtcctctgtgcacccccaggacccctacctggacaagttcttcaccctggtgcacgtgctggaggagggcgccttccccttccggctgaaggacacagtgctgtctgagggcaatgtggagcaggagctgcgggccagcctggccgccctgcggctggccagccctgagcccctggtggccttcagccaccacgtgctggacaagctggtgcggctggtgatccggccccccatcatcagcggccagatcgtgaacctgggccgcggggcctttgaggccatggcccacgtggtgtccctggtgcacaggagcctggaggccgcccaggatgcccggggccactgcccccagctggccgcctacgtgcactacgccttccggctgcctggaacagagcccagcctgcctgatggagcccctcctgtgacagtgcaggccgccaccctggcccggggcagcggccggcctgccagcctgtacctggcccggagcaagagcatcagcagcagcaacccagacctggccgtggcccctggctctgtggatgatgaggtgagccgcatcctggccagcaagctgctgcacgaggagctggccctgcagtgggtggtgagcagcagcgctgtgcgggaggccatcctgcagcacgcctggttcttcttccagctgatggtgaagtccatggccctgcacctgctgctgggccagaggctggacacccccaggaagctgcgcttccctggccgcttcctggatgacatcacagccctggtgggctctgtgggcctggaggtgatcaccagggtgcacaaggatgtggagctggccgagcacctgaatgccagcctggccttcttcctgagtgacctgctgagcctggtggaccggggctttgtgttcagcctggtgcgggcccactacaagcaggtggccacccggctgcagagcagccccaacccagctgccctgctgaccctgaggatggagttcacccgcatcctgtgcagccatgagcactacgtgaccctgaacctgccctgctgccccctgagccccccagccagccccagccccagcgtgagcagcaccaccagccagagcagcaccttcagcagccaggccccagaccccaaggtgacctccatgtttgagctgagcggccccttccggcagcagcacttcctggccggcctgctgctgacagagctggccctggccctggagcctgaggccgagggcgccttcctgctgcacaagaaggccatctctgctgtgcacagcctgctgtgtggccatgacacagaccccaggtatgcagaggccaccgtgaaggcccgggtggccgagctgtacctgcccctgctgagcatcgcccgggacaccctgccccggctgcatgactttgctgagggccctggccagaggagccggctggcctccatgctggacagcgacacagaaggagagggggacattgctggcaccatcaaccccagcgtggccatggccatcgccggcggccccctggcccctggcagccgggccagcatcagccagggccccccaacagccagcagagctggctgtgccctgtctgctgagagcagcaggaccctgctggcctgtgtgctgtgggtgctgaagaacacagagcccgccctgctgcagcgctgggccacagacctgaccctgccccagctgggccgcctgctggacctgctgtacctgtgcctggccgcctttgagtacaagggcaagaaggcctttgagcgcatcaacagcctgaccttcaagaagagcctggacatgaaggcccggctggaggaggccatcctgggcaccatcggggcccggcaggagatggtgagaagaagccgggagaggagcccctttggaaatccagaaaatgtgcgctggaggaagtctgtgacccactggaagcagaccagtgacagagtggacaagaccaaggatgagatggagcacgaggccctggtggagggcaacctggccacagaggccagcctggtggtgctggacaccctggagatcatcgtgcagacagtgatgctgtctgaggcccgggagagcgtgctgggcgctgtgctgaaggtggtgctgtacagcctgggcagcgcccagagcgccctcttcctgcagcacggcctggccacccagagggccctggtgtccaagtttcctgagctgctgtttgaggaggacacagagctgtgtgccgacctgtgcctgcggctgctgcggcactgcggcagccgcatcagcaccatccgcacccacgccagcgccagcctgtacctgctgatgaggcagaactttgaaattggccacaactttgcccgggtgaagatgcaggtgaccatgagcctgagcagcctggtgggcaccacccagaacttcagcgaggagcacctgcggcgcagcctgaagaccatcctgacctacgccgaggaggacatgggcctgcgggacagcacctttgctgagcaggtgcaggacctgatgttcaacctgcacatgatcctgacagacacagtgaagatgaaggagcaccaggaggaccctgagatgctgattgacctgatgtacagaattgcccggggctaccagggcagcccagacctgcggctgacctggctgcagaacatggccggcaagcacgccgagctgggcaaccacgccgaggccgcccagtgcatggtgcatgctgctgccctggtggccgagtacctggccctgctggaggaccaccgccacctgcctgtgggctgtgtgtccttccagaacatcagcagcaatgtgctggaggagagcgccatcagtgatgacatcctgagcccagatgaggagggcttctgcagcggcaagcacttcacagagctgggcctggtgggcctgctggagcaggccgccggctacttcaccatgggcggcctgtatgaggccgtgaatgaggtgtacaagaacctgatccccatcctggaggcccaccgggactacaagaagctggccgctgtgcacggcaagctgcaggaggccttcaccaagatcatgcaccagagcagcggctgggagcgggtgtttggcacctacttccgggtgggcttctatggagcccactttggagacctggatgagcaggagtttgtgtacaaggagcccagcatcaccaagctggccgagatcagccaccggctggaggagttctacacagaaagatttggagatgatgtggtggagatcatcaaggacagcaaccctgtggacaagagcaagctggacagccagaaggcctacatccagatcacctacgtggagccctactttgacacctatgagctgaaggacagagtgacctactttgacagaaattatggcctgcggaccttcctgttctgcacccccttcaccccagatggccgggcccatggagagctgcctgagcagcacaagaggaagaccctgctgagcacagaccacgccttcccctacatcaagacccgcatccgggtgtgccaccgggaggagaccgtgctgacccctgtggaggtggccatcgaggacatgcagaagaagacccgggagctggcctttgccacagagcaggaccccccagatgccaagatgctgcagatggtgctgcagggctctgtgggccccaccgtgaaccagggccccctggaggtggcccaggtgttcctggccgagatccctgaggaccccaagctgttccgccaccacaacaagctgcggctgtgcttcaaggacttctgcaagaagtgtgaagatgccctgaggaagaacaaggccctgattggccctgaccagaaggagtaccaccgggagctggagaggaactactgccgcctgcgggaggccctgcagcccctgctgacccagaggctgccccagctgatggcccccaccccacctggcctgaggaacagcctgaacagagccagcttcaggaaggctgacctgtag

SEQ ID NO: 149659 - DNA, 4161 bp, Artificial Sequence
  Description of Artificial Sequence: Synthetic coding sequence
atgcgctgggtggatggccacaagggcgtcttctctgtggagctgacagctgtgtcctctgtgcacccccaggacccctacctggacaagttcttcaccctggtgcacgtgctggaggagggcgccttccccttccggctgaaggacacagtgctgtctgagggcaatgtggagcaggagctgcgggccagcctggccgccctgcggctggccagccctgagcccctggtggccttcagccaccacgtgctggacaagctggtgcggctggtgatccggccccccatcatcagcggccagatcgtgaacctgggccgcggggcctttgaggccatggcccacgtggtgtccctggtgcacaggagcctggaggccgcccaggatgcccggggccactgcccccagctggccgcctacgtgcactacgccttccggctgcctggaacagagcccagcctgcctgatggagcccctcctgtgacagtgcaggccgccaccctggcccggggcagcggccggcctgccagcctgtacctggcccggagcaagagcatcagcagcagcaacccagacctggccgtggcccctggctctgtggatgatgaggtgagccgcatcctggccagcaagggcatcgacaggagccacagctgggtgaacagcgcctatgcccctgggggcagcaaggctgtgctgcggcgggccccaccctactgtggggctgacccccggcagctgctgcacgaggagctggccctgcagtgggtggtgagcagcagcgctgtgcgggaggccatcctgcagcacgcctggttcttcttccagctgatggtgaagtccatggccctgcacctgctgctgggccagaggctggacacccccaggaagctgcgcttccctggccgcttcctggatgacatcacagccctggtgggctctgtgggcctggaggtgatcaccagggtgcacaaggatgtggagctggccgagcacctgaatgccagcctggccttcttcctgagtgacctgctgagcctggtggaccggggctttgtgttcagcctggtgcgggcccactacaagcaggtggccacccggctgcagagcagccccaacccagctgccctgctgaccctgaggatggagttcacccgcatcctgtgcagccatgagcactacgtgaccctgaacctgccctgctgccccctgagccccccagccagccccagccccagcgtgagcagcaccaccagccagagcagcaccttcagcagccaggccccagaccccaaggtgacctccatgtttgagctgagcggccccttccggcagcagcacttcctggccggcctgctgctgacagagctggccctggccctggagcctgaggccgagggcgccttcctgctgcacaagaaggccatctctgctgtgcacagcctgctgtgtggccatgacacagaccccaggtatgcagaggccaccgtgaaggcccgggtggccgagctgtacctgcccctgctgagcatcgcccgggacaccctgccccggctgcatgactttgctgagggccctggccagaggagccggctggcctccatgctggacagcgacacagaaggagagggggacattgctggcaccatcaaccccagcgtggccatggccatcgccggcggccccctggcccctggcagccgggccagcatcagccagggccccccaacagccagccgggccggctgtgccctgtctgctgagagcagcaggaccctgctggcctgtgtgctgtgggtgctgaagaacacagagcccgccctgctgcagcgctgggccacagacctgaccctgccccagctgggccgcctgctggacctgctgtacctgtgcctggccgcctttgagtacaagggcaagaaggcctttgagcgcatcaacagcctgaccttcaagaagagcctggacatgaaggcccggctggaggaggccatcctgggcaccatcggggcccggcaggagatggtgcggcgcagccgggagaggagccccttcggcaacccagaaaatgtgcgctggaggaagtctgtgacccactggaagcagaccagtgacagagtggacaagaccaaggatgagatggagcacgaggccctggtggagggcaacctggccacagaggccagcctggtggtgctggacaccctggagatcatcgtgcagacagtgatgctgtctgaggcccgggagagcgtgctgggcgctgtgctgaaggtggtgctgtacagcctgggcagcgcccagagcgccctcttcctgcagcacggcctggccacccagagggccctggtgtccaagtttcctgagctgctgtttgaggaggacacagagctgtgtgccgacctgtgcctgcggctgctgcggcactgcggcagccgcatcagcaccatccgcacccacgccagcgccagcctgtacctgctgatgaggcagaactttgagatcggccacaactttgcccgggtgaagatgcaggtgaccatgagcctgagcagcctggtgggcaccacccagaacttcagcgaggagcacctgcggcgcagcctgaagaccatcctgacctatgcagaggaggacatgggcctgcgggacagcacctttgctgagcaggtgcaggacctgatgttcaacctgcacatgatcctgacagacacagtgaagatgaaggagcaccaggaggaccctgagatgctgattgacctgatgtaccgcatcgcccggggctaccagggcagcccagacctgcggctgacctggctgcagaacatggccggcaagcatgctgagctgggcaaccacgccgaggccgcccagtgcatggtgcacgccgccgccctggtggccgagtacctggccctgctggaggaccaccgccacctgcctgtgggctgtgtgtccttccagaacatcagcagcaatgtgctggaggagagcgccatcagtgatgacatcctgagcccagatgaggagggcttctgcagcggcaagcacttcacagagctgggcctggtgggcctgctggagcaggccgccggctacttcaccatgggcggcctgtatgaagctgtgaatgaggtgtacaagaacctgatccccatcctggaggcccaccgggactacaagaagctggccgctgtgcacggcaagctgcaggaggccttcaccaagatcatgcaccagagcagcggctgggagcgggtgtttggcacctacttccgggtgggcttctacggggcccactttggagacctggatgagcaggagtttgtgtacaaggagcccagcatcaccaagctggccgagatcagccaccggctggaggagttctacacagaaagatttggagatgatgtggtggagatcatcaaggacagcaaccctgtggacaagagcaagctggacagccagaaggcctacatccagatcacctacgtggagccctactttgacacctatgagctgaaggacagagtgacctactttgacaggaactacggcctgcggaccttcctgttctgcacccccttcaccccagatggccgggcccacggggagctgcctgagcagcacaagaggaagaccctgctgagcacagaccacgccttcccctacatcaagacccgcatccgggtgtgccaccgggaggagaccgtgctgacccctgtggaggtggccatcgaggacatgcagaagaagacccgggagctggcctttgccacagagcaggaccccccagatgccaagatgctgcagatggtgctgcagggctctgtgggccccaccgtgaaccagggccccctggaggtggcccaggtgttcctggccgagatccctgaggaccccaagctgttccgccaccacaacaagctgcggctgtgcttcaaggacttctgcaagaagtgtgaagatgccctgaggaagaacaaggccctgattggaccagaccagaaggagtaccaccgggagctggagaggaactactgccgcctgcgggaggccctgcagcccctgctgacccagaggctgccccagctgatggcccccaccccacctggcctgaggaacagcctgaacagagccagcttcaggaaggctgacctgtag

SEQ ID NO: 149660 - DNA, 5973 bp, Artificial Sequence
  Description of Artificial Sequence: Synthetic coding sequence
atggccaccctgcccagcgctgagcggcgggcctttgccctgaagatcaaccgctacagcagcgctgagatcaggaagcagttcaccctgccccccaacctgggccagtaccaccggcagagcatcagcaccagcggcttccccagcctgcagctgccccagttctatgaccctgtggagcctgtggactttgagggcctgctgatgacccacctgaacagcctggatgtgcagctggcccaggagctgggggacttcacagatgatgacctggatgtggtgttcacccccaaggaatgtaggaccctgcagcccagcctgcctgaggagggcgtggagctggacccccacgtgcgggactgtgtgcagacctacatccgggagtggctgattgtgaacaggaagaaccagggcagccctgagatctgtggcttcaagaagacaggcagcaggaaggacttccacaagaccctgcccaagcagacctttgaaagtgagaccctggagtgcagcgagcctgctgcccaggccggccccaggcacctgaatgtgctgtgtgatgtgtctggaaaaggacctgtgacagcctgtgactttgacctgcggagcctgcagcctgacaagaggctggagaacctgctgcagcaggtgtctgctgaggactttgagaagcagaatgaggaggcccggaggaccaaccggcaggccgagctgtttgccctgtaccccagcgtggatgaggaggatgctgtggagatccggcctgtgcctgagtgccccaaggagcacctgggcaaccgcatcctggtgaagctgctgaccctgaagtttgaaattgaaattgagcccctgtttgccagcatcgccctgtatgatgtgaaggagaggaagaagatcagcgagaacttccactgtgacctgaacagcgaccagttcaagggcttcctgcgggcccacacccccagcgtggccgccagcagccaggcccggtctgctgtgttttctgtgacctaccccagcagtgacatctacctggtggtgaagattgagaaggtgctgcagcagggcgagatcggggactgtgccgagccctacaccgtcatcaaggagagtgatggcggcaagagcaaggagaagattgagaagctgaagctgcaggccgagagcttctgccagaggctgggcaagtacaggatgccctttgcctgggcccccatcagcctgagcagcttcttcaacgtgtccaccctggagcgggaggtgacagatgtggacagcgtggtgggccgcagctctgtgggggagaggaggaccctggcccagagccggcggctgtctgagcgggccctgagcctggaggagaatggagtgggcagcaacttcaagaccagcaccctgtctgtgagcagcttcttcaagcaggagggggaccggctgagtgatgaggacctcttcaagttcctggccgactacaagaggagcagcagcctgcagaggagagtgaagagcatccctggcctgctgcggctggagatcagcacagcccctgagatcatcaactgctgcctgaccccagagatgctgcctgtgaagcccttcccagaaaatagaacccggccccacaaggagatcctggagttccccacccgggaggtgtatgtgccccacacagtgtacagaaacctgctgtatgtgtacccccagaggctgaactttgtgaacaagctggccagcgccaggaacatcaccatcaagatccagttcatgtgtggggaggatgccagcaatgccatgcctgtgatctttgggaagagcagcggccctgagttcctgcaggaggtgtacacagctgtgacctaccacaacaagagcccagacttctatgaggaggtgaagatcaagctgcctgccaagctgactgtgaaccaccacctgctcttcaccttctaccacatcagctgccagcagaagcagggcgcctctgtggagaccctgctgggctacagctggctgcccatcctgctgaatgaaaggctgcagacaggcagctactgcctgcctgtggccctggagaagctgccccccaactacagcatgcacagcgctgagaaggtgcccctgcagaacccccccatcaagtgggccgagggccacaagggcgtcttcaacatcgaggtgcaggccgtgtcctctgtgcacacccaggacaaccacctggagaagttcttcaccctgtgccacagcctggagagccaggtgaccttccccatccgggtgctggaccagaagatcagcgagatggccctggagcacgagctgaagctgagcatcatctgcctgaacagcagccggctggagcccctggtgctcttcctgcacctggtgctggacaagctgttccagctgtctgtgcagcccatggtgattgctggccagacagccaacttcagccagtttgcctttgaatctgtggtggccatcgccaacagcctgcacaacagcaaggacctgagcaaggaccagcacggcaggaactgcctgctggccagctatgtgcactacgtgttccggctgcctgaggtgcagagagatgtgcccaagagcggggcccccacagccctgctggaccccaggagctaccacacctacggccgcaccagcgctgctgctgtgagcagcaagctgctgcaggcccgggtgatgagcagcagcaacccagacctggccggcacccacagcgctgctgatgaggaggtgaagaacatcatgagcagcaagcacttccacgaggagctggccctgcagatggtggtgtccacaggcatggtgcgggagaccgtcttcaagtatgcctggttcttctttgagctgctggtgaagtccatggcccagcacgtgcacaacatggacaagagggacagcttccggaggacccgcttcagtgaccgcttcatggatgacatcaccaccatcgtgaatgtggtgaccagcgagattgctgccctgctggtgaagccccagaaggaaaatgagcaggccgagaagatgaacatcagcctggccttcttcctgtatgacctgctgagcctgatggaccggggctttgtgttcaacctgatccgccactactgcagccagctgagcgccaagctgagcaacctgcccaccctcatctccatgaggctggagttcctgcgcatcctgtgcagccatgagcactacctgaacctgaacctcttcttcatgaatgctgacacagcccccaccagcccctgccccagcatcagcagccagaacagcagcagctgcagcagcttccaggaccagaagatcgcctccatgtttgacctgaccagcgagtaccggcagcagcacttcctgaccggcctgctcttcacagagctggccgccgccctggatgctgagggggagggcatcagcaaggtgcagaggaaggctgtgtctgccatccacagcctgctgagcagccatgacctggacccccgctgtgtgaagccagaggtgaaggtgaagattgctgccctgtacctgcccctggtgggcatcatcctggatgccctgccccagctgtgtgacttcaccgtggccgacacccggcgctaccgcaccagcggcagtgatgaggagcaggagggcgctggggccatcaaccagaatgtggccctggccatcgccggcaacaacttcaacctgaagaccagcggcatcgtgctgagcagcctgccctacaagcagtacaacatgctgaatgctgacaccaccaggaacctgatgatctgcttcctgtggatcatgaagaatgctgaccagagcctcatcaggaagtggattgctgacctgcccagcacccagctgaaccgcatcctggacctgctcttcatctgtgtgctgtgctttgagtacaagggcaagcagagcagtgacaaggtgtccacccaggtgctgcagaagagcagagatgtgaaggcccggctggaggaggccctgctgcggggggagggcgcccggggggagatgatgagaagaagagcccctggaaatgaccgcttccctggcctgaatgaaaacctgcgctggaagaaggagcagacccactggaggcaggccaatgagaagctggacaagaccaaggccgagctggaccaggaggccctgatcagcggcaacctggccacagaggcccacctgatcatcctggacatgcaggagaacatcatccaggccagcagcgccctggactgcaaggacagcctgctgggcggcgtgctgcgggtgctggtgaacagcctgaactgtgaccagagcaccacctacctgacccactgctttgccaccctgcgggccctgattgccaagtttggagacctgctgtttgaggaggaggtggagcagtgctttgacctgtgccaccaggtgctgcaccactgcagcagctccatggatgtgaccaggagccaggcctgtgccaccctgtacctgctgatgaggttctcctttggagccaccagcaactttgcccgggtgaagatgcaggtgaccatgagcctggccagcctggtgggccgggccccagacttcaatgaggagcacctgcggcgcagcctgcggaccatcctggcctacagcgaggaggacacagccatgcagatgacccccttccccacccaggtggaggagctgctgtgcaacctgaacagcatcctgtatgacacagtgaagatgagggagttccaggaggaccctgagatgctgatggacctgatgtaccgcatcgccaagagctaccaggccagcccagacctgcggctgacctggctgcagaacatggccgagaagcacaccaagaagaagtgctacacagaagctgccatgtgcctggtgcacgccgccgccctggtggccgagtacctgtccatgctggaggaccacagctacctgcctgtgggctctgtgtccttccagaacatcagcagcaatgtgctggaggagagcgtggtgtctgaggacaccctgagcccagatgaagatggagtgtgtgccggccagtacttcacagagagcggcctggtgggcctgctggagcaggccgctgagctgttcagcactggaggcctgtatgaaacagtgaatgaggtgtacaagctggtgatccccatcctggaggcccaccgggagttcaggaagctgaccctgacccacagcaagctgcagagggcctttgacagcatcgtgaacaaggaccacaagaggatgtttggcacctacttccgggtgggcttcttcggcagcaagtttggagacctggatgagcaggagtttgtgtacaaggagcccgccatcaccaagctgcctgagatcagccaccggctggaggccttctacggccagtgctttggagctgagtttgtggaggtgatcaaggacagcacccctgtggacaagaccaagctggaccccaacaaggcctacatccagatcacctttgtggagccctactttgatgaatatgagatgaaggacagagtgacctactttgagaagaacttcaacctgcggcgcttcatgtacaccacccccttcaccctggagggccggcccagaggagagctgcacgagcagtacagaagaaacacagtgctgaccaccatgcacgccttcccctacatcaagacccgcatcagcgtcatccagaaggaggagtttgtgctgacccccatcgaggtggccatcgaggacatgaagaagaagaccctgcagctggccgtggccatcaaccaggagcccccagatgccaagatgctgcagatggtgctgcagggctctgtgggcgccaccgtgaaccagggccccctggaggtggcccaggtgttcctggccgagatcccagctgaccccaagctgtaccgccaccacaacaagctgcggctgtgcttcaaggagttcatcatgtag

SEQ ID NO: 149661 - DNA, 6096 bp, Artificial Sequence
  Description of Artificial Sequence: Synthetic coding sequence
atgacccacctgaacagcctggatgtgcagctggcccaggagctgggggacttcacagatgatgacctggatgtggtgttcacccccaaggaatgtaggaccctgcagcccagcctgcctgaggagggcgtggagctggacccccacgtgcgggactgtgtgcagacctacatccgggagtggctgattgtgaacaggaagaaccagggcagccctgagatctgtggcttcaagaagacaggcagcaggaaggacttccacaagaccctgcccaagcagacctttgaaagtgagaccctggagtgcagcgagcctgctgcccaggccggccccaggcacctgaatgtgctgtgtgatgtgtctggaaaaggacctgtgacagcctgtgactttgacctgcggagcctgcagcctgacaagaggctggagaacctgctgcagcaggtgtctgctgaggactttgagaagcagaatgaggaggcccggaggaccaaccggcaggccgagctgtttgccctgtaccccagcgtggatgaggaggatgctgtggagatccggcctgtgcctgagtgccccaaggagcacctgggcaaccgcatcctggtgaagctgctgaccctgaagtttgaaattgaaattgagcccctgtttgccagcatcgccctgtatgatgtgaaggagaggaagaagatcagcgagaacttccactgtgacctgaacagcgaccagttcaagggcttcctgcgggcccacacccccagcgtggccgccagcagccaggcccggtctgctgtgttttctgtgacctaccccagcagtgacatctacctggtggtgaagattgagaaggtgctgcagcagggcgagatcggggactgtgccgagccctacaccgtcatcaaggagagtgatggcggcaagagcaaggagaagattgagaagctgaagctgcaggccgagagcttctgccagaggctgggcaagtacaggatgccctttgcctgggcccccatcagcctgagcagcttcttcaacgtgtccaccctggagcgggaggtgacagatgtggacagcgtggtgggccgcagctctgtgggggagaggaggaccctggcccagagccggcggctgtctgagcgggccctgagcctggaggagaatggagtgggcagcaacttcaagaccagcaccctgtctgtgagcagcttcttcaagcaggagggggaccggctgagtgatgaggacctcttcaagttcctggccgactacaagaggagcagcagcctgcagaggagagtgaagagcatccctggcctgctgcggctggagatcagcacagcccctgagatcatcaactgctgcctgaccccagagatgctgcctgtgaagcccttcccagaaaatagaacccggccccacaaggagatcctggagttccccacccgggaggtgtatgtgccccacacagtgtacagaaacctgctgtatgtgtacccccagaggctgaactttgtgaacaagctggccagcgccaggaacatcaccatcaagatccagttcatgtgtggggaggatgccagcaatgccatgcctgtgatctttgggaagagcagcggccctgagttcctgcaggaggtgtacacagctgtgacctaccacaacaagagcccagacttctatgaggaggtgaagatcaagctgcctgccaagctgactgtgaaccaccacctgctcttcaccttctaccacatcagctgccagcagaagcagggcgcctctgtggagaccctgctgggctacagctggctgcccatcctgctgaatgaaaggctgcagacaggcagctactgcctgcctgtggccctggagaagctgccccccaactacagcatgcacagcgctgagaaggtgcccctgcagaacccccccatcaagtgggccgagggccacaagggcgtcttcaacatcgaggtgcaggccgtgtcctctgtgcacacccaggacaaccacctggagaagttcttcaccctgtgccacagcctggagagccaggtgaccttccccatccgggtgctggaccagaagatcagcgagatggccctggagcacgagctgaagctgagcatcatctgcctgaacagcagccggctggagcccctggtgctcttcctgcacctggtgctggacaagctgttccagctgtctgtgcagcccatggtgattgctggccagacagccaacttcagccagtttgcctttgaatctgtggtggccatcgccaacagcctgcacaacagcaaggacctgagcaaggaccagcacggcaggaactgcctgctggccagctatgtgcactacgtgttccggctgcctgaggtgcagagagatgtgcccaagagcggggcccccacagccctgctggaccccaggagctaccacacctacggccgcaccagcgctgctgctgtgagcagcaagctgctgcaggcccgggtgatgagcagcagcaacccagacctggccggcacccacagcgctgctgatgaggaggtgaagaacatcatgagcagcaagattgctgacaggaactgcagcaggatgagctactactgcagcggcagcagtgatgcccccagcagccctgctgcccccaggcctgccagcaagaagcacttccacgaggagctggccctgcagatggtggtgtccacaggcatggtgcgggagaccgtcttcaagtatgcctggttcttctttgagctgctggtgaagtccatggcccagcacgtgcacaacatggacaagagggacagcttccggaggacccgcttcagtgaccgcttcatggatgacatcaccaccatcgtgaatgtggtgaccagcgagattgctgccctgctggtgaagccccagaaggaaaatgagcaggccgagaagatgaacatcagcctggccttcttcctgtatgacctgctgagcctgatggaccggggctttgtgttcaacctgatccgccactactgcagccagctgagcgccaagctgagcaacctgcccaccctcatctccatgaggctggagttcctgcgcatcctgtgcagccatgagcactacctgaacctgaacctcttcttcatgaatgctgacacagcccccaccagcccctgccccagcatcagcagccagaacagcagcagctgcagcagcttccaggaccagaagatcgcctccatgtttgacctgaccagcgagtaccggcagcagcacttcctgaccggcctgctcttcacagagctggccgccgccctggatgctgagggggagggcatcagcaaggtgcagaggaaggctgtgtctgccatccacagcctgctgagcagccatgacctggacccccgctgtgtgaagccagaggtgaaggtgaagattgctgccctgtacctgcccctggtgggcatcatcctggatgccctgccccagctgtgtgacttcaccgtggccgacacccggcgctaccgcaccagcggcagtgatgaggagcaggagggcgctggggccatcaaccagaatgtggccctggccatcgccggcaacaacttcaacctgaagaccagcggcatcgtgctgagcagcctgccctacaagcagtacaacatgctgaatgctgacaccaccaggaacctgatgatctgcttcctgtggatcatgaagaatgctgaccagagcctcatcaggaagtggattgctgacctgcccagcacccagctgaaccgcatcctggacctgctcttcatctgtgtgctgtgctttgagtacaagggcaagcagagcagtgacaaggtgtccacccaggtgctgcagaagagcagagatgtgaaggcccggctggaggaggccctgctgcggggggagggcgcccggggggagatgatgagaagaagagcccctggaaatgaccgcttccctggcctgaatgaaaacctgcgctggaagaaggagcagacccactggaggcaggccaatgagaagctggacaagaccaaggccgagctggaccaggaggccctgatcagcggcaacctggccacagaggcccacctgatcatcctggacatgcaggagaacatcatccaggccagcagcgccctggactgcaaggacagcctgctgggcggcgtgctgcgggtgctggtgaacagcctgaactgtgaccagagcaccacctacctgacccactgctttgccaccctgcgggccctgattgccaagtttggagacctgctgtttgaggaggaggtggagcagtgctttgacctgtgccaccaggtgctgcaccactgcagcagctccatggatgtgaccaggagccaggcctgtgccaccctgtacctgctgatgaggttctcctttggagccaccagcaactttgcccgggtgaagatgcaggtgaccatgagcctggccagcctggtgggccgggccccagacttcaatgaggagcacctgcggcgcagcctgcggaccatcctggcctacagcgaggaggacacagccatgcagatgacccccttccccacccaggtggaggagctgctgtgcaacctgaacagcatcctgtatgacacagtgaagatgagggagttccaggaggaccctgagatgctgatggacctgatgtaccgcatcgccaagagctaccaggccagcccagacctgcggctgacctggctgcagaacatggccgagaagcacaccaagaagaagtgctacacagaagctgccatgtgcctggtgcacgccgccgccctggtggccgagtacctgtccatgctggaggaccacagctacctgcctgtgggctctgtgtccttccagaacatcagcagcaatgtgctggaggagagcgtggtgtctgaggacaccctgagcccagatgaagatggagtgtgtgccggccagtacttcacagagagcggcctggtgggcctgctggagcaggccgctgagctgttcagcactggaggcctgtatgaaacagtgaatgaggtgtacaagctggtgatccccatcctggaggcccaccgggagttcaggaagctgaccctgacccacagcaagctgcagagggcctttgacagcatcgtgaacaaggaccacaagaggatgtttggcacctacttccgggtgggcttcttcggcagcaagtttggagacctggatgagcaggagtttgtgtacaaggagcccgccatcaccaagctgcctgagatcagccaccggctggaggccttctacggccagtgctttggagctgagtttgtggaggtgatcaaggacagcacccctgtggacaagaccaagctggaccccaacaaggcctacatccagatcacctttgtggagccctactttgatgaatatgagatgaaggacagagtgacctactttgagaagaacttcaacctgcggcgcttcatgtacaccacccccttcaccctggagggccggcccagaggagagctgcacgagcagtacagaagaaacacagtgctgaccaccatgcacgccttcccctacatcaagacccgcatcagcgtcatccagaaggaggagtttgtgctgacccccatcgaggtggccatcgaggacatgaagaagaagaccctgcagctggccgtggccatcaaccaggagcccccagatgccaagatgctgcagatggtgctgcagggctctgtgggcgccaccgtgaaccagggccccctggaggtggcccaggtgttcctggccgagatcccagctgaccccaagctgtaccgccaccacaacaagctgcggctgtgcttcaaggagttcatcatgagatgtggggaggccgtggagaagaacaagaggctcatcacagctgaccagcgggagtaccagcaggagctgaagaagaactacaacaagctgaaggagaacctgcggcccatgattgaaaggaagatccctgagctgtacaagcccatcttccgggtggagagccagaagagggacagcttccacaggagcagcttcagaaaatgtgagacccagctgagccagggcagctag

SEQ ID NO: 149662 - DNA, 6300 bp, Artificial Sequence
  Description of Artificial Sequence: Synthetic coding sequence
atggccaccctgcccagcgctgagcggcgggcctttgccctgaagatcaaccgctacagcagcgctgagatcaggaagcagttcaccctgccccccaacctgggccagtaccaccggcagagcatcagcaccagcggcttccccagcctgcagctgccccagttctatgaccctgtggagcctgtggactttgagggcctgctgatgacccacctgaacagcctggatgtgcagctggcccaggagctgggggacttcacagatgatgacctggatgtggtgttcacccccaaggaatgtaggaccctgcagcccagcctgcctgaggagggcgtggagctggacccccacgtgcgggactgtgtgcagacctacatccgggagtggctgattgtgaacaggaagaaccagggcagccctgagatctgtggcttcaagaagacaggcagcaggaaggacttccacaagaccctgcccaagcagacctttgaaagtgagaccctggagtgcagcgagcctgctgcccaggccggccccaggcacctgaatgtgctgtgtgatgtgtctggaaaaggacctgtgacagcctgtgactttgacctgcggagcctgcagcctgacaagaggctggagaacctgctgcagcaggtgtctgctgaggactttgagaagcagaatgaggaggcccggaggaccaaccggcaggccgagctgtttgccctgtaccccagcgtggatgaggaggatgctgtggagatccggcctgtgcctgagtgccccaaggagcacctgggcaaccgcatcctggtgaagctgctgaccctgaagtttgaaattgaaattgagcccctgtttgccagcatcgccctgtatgatgtgaaggagaggaagaagatcagcgagaacttccactgtgacctgaacagcgaccagttcaagggcttcctgcgggcccacacccccagcgtggccgccagcagccaggcccggtctgctgtgttttctgtgacctaccccagcagtgacatctacctggtggtgaagattgagaaggtgctgcagcagggcgagatcggggactgtgccgagccctacaccgtcatcaaggagagtgatggcggcaagagcaaggagaagattgagaagctgaagctgcaggccgagagcttctgccagaggctgggcaagtacaggatgccctttgcctgggcccccatcagcctgagcagcttcttcaacgtgtccaccctggagcgggaggtgacagatgtggacagcgtggtgggccgcagctctgtgggggagaggaggaccctggcccagagccggcggctgtctgagcgggccctgagcctggaggagaatggagtgggcagcaacttcaagaccagcaccctgtctgtgagcagcttcttcaagcaggagggggaccggctgagtgatgaggacctcttcaagttcctggccgactacaagaggagcagcagcctgcagaggagagtgaagagcatccctggcctgctgcggctggagatcagcacagcccctgagatcatcaactgctgcctgaccccagagatgctgcctgtgaagcccttcccagaaaatagaacccggccccacaaggagatcctggagttccccacccgggaggtgtatgtgccccacacagtgtacagaaacctgctgtatgtgtacccccagaggctgaactttgtgaacaagctggccagcgccaggaacatcaccatcaagatccagttcatgtgtggggaggatgccagcaatgccatgcctgtgatctttgggaagagcagcggccctgagttcctgcaggaggtgtacacagctgtgacctaccacaacaagagcccagacttctatgaggaggtgaagatcaagctgcctgccaagctgactgtgaaccaccacctgctcttcaccttctaccacatcagctgccagcagaagcagggcgcctctgtggagaccctgctgggctacagctggctgcccatcctgctgaatgaaaggctgcagacaggcagctactgcctgcctgtggccctggagaagctgccccccaactacagcatgcacagcgctgagaaggtgcccctgcagaacccccccatcaagtgggccgagggccacaagggcgtcttcaacatcgaggtgcaggccgtgtcctctgtgcacacccaggacaaccacctggagaagttcttcaccctgtgccacagcctggagagccaggtgaccttccccatccgggtgctggaccagaagatcagcgagatggccctggagcacgagctgaagctgagcatcatctgcctgaacagcagccggctggagcccctggtgctcttcctgcacctggtgctggacaagctgttccagctgtctgtgcagcccatggtgattgctggccagacagccaacttcagccagtttgcctttgaatctgtggtggccatcgccaacagcctgcacaacagcaaggacctgagcaaggaccagcacggcaggaactgcctgctggccagctatgtgcactacgtgttccggctgcctgaggtgcagagagatgtgcccaagagcggggcccccacagccctgctggaccccaggagctaccacacctacggccgcaccagcgctgctgctgtgagcagcaagctgctgcaggcccgggtgatgagcagcagcaacccagacctggccggcacccacagcgctgctgatgaggaggtgaagaacatcatgagcagcaagattgctgacaggaactgcagcaggatgagctactactgcagcggcagcagtgatgcccccagcagccctgctgcccccaggcctgccagcaagaagcacttccacgaggagctggccctgcagatggtggtgtccacaggcatggtgcgggagaccgtcttcaagtatgcctggttcttctttgagctgctggtgaagtccatggcccagcacgtgcacaacatggacaagagggacagcttccggaggacccgcttcagtgaccgcttcatggatgacatcaccaccatcgtgaatgtggtgaccagcgagattgctgccctgctggtgaagccccagaaggaaaatgagcaggccgagaagatgaacatcagcctggccttcttcctgtatgacctgctgagcctgatggaccggggctttgtgttcaacctgatccgccactactgcagccagctgagcgccaagctgagcaacctgcccaccctcatctccatgaggctggagttcctgcgcatcctgtgcagccatgagcactacctgaacctgaacctcttcttcatgaatgctgacacagcccccaccagcccctgccccagcatcagcagccagaacagcagcagctgcagcagcttccaggaccagaagatcgcctccatgtttgacctgaccagcgagtaccggcagcagcacttcctgaccggcctgctcttcacagagctggccgccgccctggatgctgagggggagggcatcagcaaggtgcagaggaaggctgtgtctgccatccacagcctgctgagcagccatgacctggacccccgctgtgtgaagccagaggtgaaggtgaagattgctgccctgtacctgcccctggtgggcatcatcctggatgccctgccccagctgtgtgacttcaccgtggccgacacccggcgctaccgcaccagcggcagtgatgaggagcaggagggcgctggggccatcaaccagaatgtggccctggccatcgccggcaacaacttcaacctgaagaccagcggcatcgtgctgagcagcctgccctacaagcagtacaacatgctgaatgctgacaccaccaggaacctgatgatctgcttcctgtggatcatgaagaatgctgaccagagcctcatcaggaagtggattgctgacctgcccagcacccagctgaaccgcatcctggacctgctcttcatctgtgtgctgtgctttgagtacaagggcaagcagagcagtgacaaggtgtccacccaggtgctgcagaagagcagagatgtgaaggcccggctggaggaggccctgctgcggggggagggcgcccggggggagatgatgagaagaagagcccctggaaatgaccgcttccctggcctgaatgaaaacctgcgctggaagaaggagcagacccactggaggcaggccaatgagaagctggacaagaccaaggccgagctggaccaggaggccctgatcagcggcaacctggccacagaggcccacctgatcatcctggacatgcaggagaacatcatccaggccagcagcgccctggactgcaaggacagcctgctgggcggcgtgctgcgggtgctggtgaacagcctgaactgtgaccagagcaccacctacctgacccactgctttgccaccctgcgggccctgattgccaagtttggagacctgctgtttgaggaggaggtggagcagtgctttgacctgtgccaccaggtgctgcaccactgcagcagctccatggatgtgaccaggagccaggcctgtgccaccctgtacctgctgatgaggttctcctttggagccaccagcaactttgcccgggtgaagatgcaggtgaccatgagcctggccagcctggtgggccgggccccagacttcaatgaggagcacctgcggcgcagcctgcggaccatcctggcctacagcgaggaggacacagccatgcagatgacccccttccccacccaggtggaggagctgctgtgcaacctgaacagcatcctgtatgacacagtgaagatgagggagttccaggaggaccctgagatgctgatggacctgatgtaccgcatcgccaagagctaccaggccagcccagacctgcggctgacctggctgcagaacatggccgagaagcacaccaagaagaagtgctacacagaagctgccatgtgcctggtgcacgccgccgccctggtggccgagtacctgtccatgctggaggaccacagctacctgcctgtgggctctgtgtccttccagaacatcagcagcaatgtgctggaggagagcgtggtgtctgaggacaccctgagcccagatgaagatggagtgtgtgccggccagtacttcacagagagcggcctggtgggcctgctggagcaggccgctgagctgttcagcactggaggcctgtatgaaacagtgaatgaggtgtacaagctggtgatccccatcctggaggcccaccgggagttcaggaagctgaccctgacccacagcaagctgcagagggcctttgacagcatcgtgaacaaggaccacaagaggatgtttggcacctacttccgggtgggcttcttcggcagcaagtttggagacctggatgagcaggagtttgtgtacaaggagcccgccatcaccaagctgcctgagatcagccaccggctggaggccttctacggccagtgctttggagctgagtttgtggaggtgatcaaggacagcacccctgtggacaagaccaagctggaccccaacaaggcctacatccagatcacctttgtggagccctactttgatgaatatgagatgaaggacagagtgacctactttgagaagaacttcaacctgcggcgcttcatgtacaccacccccttcaccctggagggccggcccagaggagagctgcacgagcagtacagaagaaacacagtgctgaccaccatgcacgccttcccctacatcaagacccgcatcagcgtcatccagaaggaggagtttgtgctgacccccatcgaggtggccatcgaggacatgaagaagaagaccctgcagctggccgtggccatcaaccaggagcccccagatgccaagatgctgcagatggtgctgcagggctctgtgggcgccaccgtgaaccagggccccctggaggtggcccaggtgttcctggccgagatcccagctgaccccaagctgtaccgccaccacaacaagctgcggctgtgcttcaaggagttcatcatgagatgtggggaggccgtggagaagaacaagaggctcatcacagctgaccagcgggagtaccagcaggagctgaagaagaactacaacaagctgaaggagaacctgcggcccatgattgaaaggaagatccctgagctgtacaagcccatcttccgggtggagagccagaagagggacagcttccacaggagcagcttcagaaaatgtgagacccagctgagccagggcagctag

SEQ ID NO: 149663 - DNA, 6000 bp, Artificial Sequence
  Description of Artificial Sequence: Synthetic coding sequence
atgacccacctgaacagcctggatgtgcagctggcccaggagctgggggacttcacagatgatgacctggatgtggtgttcacccccaaggaatgtaggaccctgcagcccagcctgcctgaggagggcgtggagctggacccccacgtgcgggactgtgtgcagacctacatccgggagtggctgattgtgaacaggaagaaccagggcagccctgagatctgtggcttcaagaagacaggcagcaggaaggacttccacaagaccctgcccaagcagacctttgaaagtgagaccctggagtgcagcgagcctgctgcccaggccggccccaggcacctgaatgtgctgtgtgatgtgtctggaaaaggacctgtgacagcctgtgactttgacctgcggagcctgcagcctgacaagaggctggagaacctgctgcagcaggtgtctgctgaggactttgagaagcagaatgaggaggcccggaggaccaaccggcaggccgagctgtttgccctgtaccccagcgtggatgaggaggatgctgtggagatccggcctgtgcctgagtgccccaaggagcacctgggcaaccgcatcctggtgaagctgctgaccctgaagtttgaaattgaaattgagcccctgtttgccagcatcgccctgtatgatgtgaaggagaggaagaagatcagcgagaacttccactgtgacctgaacagcgaccagttcaagggcttcctgcgggcccacacccccagcgtggccgccagcagccaggcccggtctgctgtgttttctgtgacctaccccagcagtgacatctacctggtggtgaagattgagaaggtgctgcagcagggcgagatcggggactgtgccgagccctacaccgtcatcaaggagagtgatggcggcaagagcaaggagaagattgagaagctgaagctgcaggccgagagcttctgccagaggctgggcaagtacaggatgccctttgcctgggcccccatcagcctgagcagcttcttcaacgtgtccaccctggagcgggaggtgacagatgtggacagcgtggtgggccgcagctctgtgggggagaggaggaccctggcccagagccggcggctgtctgagcgggccctgagcctggaggagaatggagtgggcagcaacttcaagaccagcaccctgtctgtgagcagcttcttcaagcaggagggggaccggctgagtgatgaggacctcttcaagttcctggccgactacaagaggagcagcagcctgcagaggagagtgaagagcatccctggcctgctgcggctggagatcagcacagcccctgagatcatcaactgctgcctgaccccagagatgctgcctgtgaagcccttcccagaaaatagaacccggccccacaaggagatcctggagttccccacccgggaggtgtatgtgccccacacagtgtacagaaacctgctgtatgtgtacccccagaggctgaactttgtgaacaagctggccagcgccaggaacatcaccatcaagatccagttcatgtgtggggaggatgccagcaatgccatgcctgtgatctttgggaagagcagcggccctgagttcctgcaggaggtgtacacagctgtgacctaccacaacaagagcccagacttctatgaggaggtgaagatcaagctgcctgccaagctgactgtgaaccaccacctgctcttcaccttctaccacatcagctgccagcagaagcagggcgcctctgtggagaccctgctgggctacagctggctgcccatcctgctgaatgaaaggctgcagacaggcagctactgcctgcctgtggccctggagaagctgccccccaactacagcatgcacagcgctgagaaggtgcccctgcagaacccccccatcaagtgggccgagggccacaagggcgtcttcaacatcgaggtgcaggccgtgtcctctgtgcacacccaggacaaccacctggagaagttcttcaccctgtgccacagcctggagagccaggtgaccttccccatccgggtgctggaccagaagatcagcgagatggccctggagcacgagctgaagctgagcatcatctgcctgaacagcagccggctggagcccctggtgctcttcctgcacctggtgctggacaagctgttccagctgtctgtgcagcccatggtgattgctggccagacagccaacttcagccagtttgcctttgaatctgtggtggccatcgccaacagcctgcacaacagcaaggacctgagcaaggaccagcacggcaggaactgcctgctggccagctatgtgcactacgtgttccggctgcctgaggtgcagagagatgtgcccaagagcggggcccccacagccctgctggaccccaggagctaccacacctacggccgcaccagcgctgctgctgtgagcagcaagctgctgcaggcccgggtgatgagcagcagcaacccagacctggccggcacccacagcgctgctgatgaggaggtgaagaacatcatgagcagcaagcacttccacgaggagctggccctgcagatggtggtgtccacaggcatggtgcgggagaccgtcttcaagtatgcctggttcttctttgagctgctggtgaagtccatggcccagcacgtgcacaacatggacaagagggacagcttccggaggacccgcttcagtgaccgcttcatggatgacatcaccaccatcgtgaatgtggtgaccagcgagattgctgccctgctggtgaagccccagaaggaaaatgagcaggccgagaagatgaacatcagcctggccttcttcctgtatgacctgctgagcctgatggaccggggctttgtgttcaacctgatccgccactactgcagccagctgagcgccaagctgagcaacctgcccaccctcatctccatgaggctggagttcctgcgcatcctgtgcagccatgagcactacctgaacctgaacctcttcttcatgaatgctgacacagcccccaccagcccctgccccagcatcagcagccagaacagcagcagctgcagcagcttccaggaccagaagatcgcctccatgtttgacctgaccagcgagtaccggcagcagcacttcctgaccggcctgctcttcacagagctggccgccgccctggatgctgagggggagggcatcagcaaggtgcagaggaaggctgtgtctgccatccacagcctgctgagcagccatgacctggacccccgctgtgtgaagccagaggtgaaggtgaagattgctgccctgtacctgcccctggtgggcatcatcctggatgccctgccccagctgtgtgacttcaccgtggccgacacccggcgctaccgcaccagcggcagtgatgaggagcaggagggcgctggggccatcaaccagaatgtggccctggccatcgccggcaacaacttcaacctgaagaccagcggcatcgtgctgagcagcctgccctacaagcagtacaacatgctgaatgctgacaccaccaggaacctgatgatctgcttcctgtggatcatgaagaatgctgaccagagcctcatcaggaagtggattgctgacctgcccagcacccagctgaaccgcatcctggacctgctcttcatctgtgtgctgtgctttgagtacaagggcaagcagagcagtgacaaggtgtccacccaggtgctgcagaagagcagagatgtgaaggcccggctggaggaggccctgctgcggggggagggcgcccggggggagatgatgagaagaagagcccctggaaatgaccgcttccctggcctgaatgaaaacctgcgctggaagaaggagcagacccactggaggcaggccaatgagaagctggacaagaccaaggccgagctggaccaggaggccctgatcagcggcaacctggccacagaggcccacctgatcatcctggacatgcaggagaacatcatccaggccagcagcgccctggactgcaaggacagcctgctgggcggcgtgctgcgggtgctggtgaacagcctgaactgtgaccagagcaccacctacctgacccactgctttgccaccctgcgggccctgattgccaagtttggagacctgctgtttgaggaggaggtggagcagtgctttgacctgtgccaccaggtgctgcaccactgcagcagctccatggatgtgaccaggagccaggcctgtgccaccctgtacctgctgatgaggttctcctttggagccaccagcaactttgcccgggtgaagatgcaggtgaccatgagcctggccagcctggtgggccgggccccagacttcaatgaggagcacctgcggcgcagcctgcggaccatcctggcctacagcgaggaggacacagccatgcagatgacccccttccccacccaggtggaggagctgctgtgcaacctgaacagcatcctgtatgacacagtgaagatgagggagttccaggaggaccctgagatgctgatggacctgatgtaccgcatcgccaagagctaccaggccagcccagacctgcggctgacctggctgcagaacatggccgagaagcacaccaagaagaagtgctacacagaagctgccatgtgcctggtgcacgccgccgccctggtggccgagtacctgtccatgctggaggaccacagctacctgcctgtgggctctgtgtccttccagaacatcagcagcaatgtgctggaggagagcgtggtgtctgaggacaccctgagcccagatgaagatggagtgtgtgccggccagtacttcacagagagcggcctggtgggcctgctggagcaggccgctgagctgttcagcactggaggcctgtatgaaacagtgaatgaggtgtacaagctggtgatccccatcctggaggcccaccgggagttcaggaagctgaccctgacccacagcaagctgcagagggcctttgacagcatcgtgaacaaggaccacaagaggatgtttggcacctacttccgggtgggcttcttcggcagcaagtttggagacctggatgagcaggagtttgtgtacaaggagcccgccatcaccaagctgcctgagatcagccaccggctggaggccttctacggccagtgctttggagctgagtttgtggaggtgatcaaggacagcacccctgtggacaagaccaagctggaccccaacaaggcctacatccagatcacctttgtggagccctactttgatgaatatgagatgaaggacagagtgacctactttgagaagaacttcaacctgcggcgcttcatgtacaccacccccttcaccctggagggccggcccagaggagagctgcacgagcagtacagaagaaacacagtgctgaccaccatgcacgccttcccctacatcaagacccgcatcagcgtcatccagaaggaggagtttgtgctgacccccatcgaggtggccatcgaggacatgaagaagaagaccctgcagctggccgtggccatcaaccaggagcccccagatgccaagatgctgcagatggtgctgcagggctctgtgggcgccaccgtgaaccagggccccctggaggtggcccaggtgttcctggccgagatcccagctgaccccaagctgtaccgccaccacaacaagctgcggctgtgcttcaaggagttcatcatgagatgtggggaggccgtggagaagaacaagaggctcatcacagctgaccagcgggagtaccagcaggagctgaagaagaactacaacaagctgaaggagaacctgcggcccatgattgaaaggaagatccctgagctgtacaagcccatcttccgggtggagagccagaagagggacagcttccacaggagcagcttcagaaaatgtgagacccagctgagccagggcagctag

SEQ ID NO: 149664 - DNA, 1182 bp, Artificial Sequence
  Description of Artificial Sequence: Synthetic coding sequence
atgaagaggaccagagatgaggtggatgccaccctgcagatcgccaagctgaatgctgctgagctgctgcctgctgtgcactgcctgggctttggacctggggccagcggggctgctgctggggacttctgcctgctggagctggagcccaccctgtgccagcagctggaggatggccacagcctggtgatccggggggacaaggatgagcaggccgtgctgtgcagcaaggacaagacctatgacctgaagattgctgacaccagcaacatgctgctcttcatccctggctgcaagaccccagaccagctgaagaaggaggacagccactgcaacatcatccacacagagatcttcggcttcagcaacaactactgggagctgcggaggagaagacccaagctgaagaagctgaagaagctgctgatggagaacccctatgagggccctgacagccagaaggagaaggacagcaacagcagcaagtacaccacagaggacctgctggaccagatccaggccagcgaggaggagatcatgacccagctgcaggtgctgaatgcctgcaagattggaggctactggaggatcctggagtttgattatgagatgaagctgctgaaccacgtgacccagctggtggacagcgagagctggagctttgggaaggtgcccctgaacacctgcctgcaggagctgggccccctggagcctgaggagatgattgagcactgcctgaagtgctacggcaagaagtatgtggatgaaggagaggtgtactttgagctggatgctgacaagatctgcagagctgctgccaggatgctgctgcagaatgctgtgaagttcaacctggccgagttccaggaggtgtggcagcagagcgtgcctgagggcatggtgaccagcctggaccagctgaagggcctggccctggtggacagacacagcaggcctgagatcatcttcctgctgaaggtggatgacctgcctgaggacaaccaggagcgcttcaacagcctcttcagcctgcgggagaagtggacagaagaagatattgccccctacatccaggacctgtgtggggagaagcagaccatcggggccctgctgaccaagtacagccacagctccatgcagaatggagtgaaggtgtacaacagcagaagacccatctcctag

SEQ ID NO: 149665 - DNA, 342 bp, Artificial Sequence
  Description of Artificial Sequence: Synthetic coding sequence
atgtctgcctctgtggtgtctgtcatcagccgcttcctggaggagtacctgagcagcaccccccagaggctgaagctgctggatgcctacctgctgtacatcctgctgactggagccctgcagtttggctactgcctgctggtgggcaccttccccttcaacagcttcctgagcggcttcatcagctgtgtgggcagcttcatcctggccgtgtgcctgcgcatccagatcaacccccagaacaaggctgacttccagggcatcagccctgagcgggcctttgctgacttcctgtttgccagcaccatcctgcacctggtggtgatgaactttgtgggctag

SEQ ID NO: 149666 - DNA, 285 bp, Artificial Sequence
  Description of Artificial Sequence: Synthetic coding sequence
atgaggaccctggccatcctggccgccatcctgctggtggccctgcaggcccaggccgagcccctgcaggcccgggcagatgaggtggccgccgcccctgagcagattgctgctgacatccctgaggtggtggtgtccctggcctgggatgagagcctggcccccaagcaccctggcagcaggaagaacatggcctgctactgccgcatcccagcctgcatcgccggggagcggcgctatggcacctgcatctaccagggccgcctgtgggccttctgctgctag

SEQ ID NO: 149667 - DNA, 285 bp, Artificial Sequence; identical to SEQ ID NO: 149666
  Description of Artificial Sequence: Synthetic coding sequence

SEQ ID NO: 149668 - DNA, 294 bp, Artificial Sequence
  Description of Artificial Sequence: Synthetic coding sequence
atgaggatcatcgccctgctggccgccatcctgctggtggccctgcaggtgcgggccggccccctgcaggcccggggagatgaggcccctggccaggagcagaggggccctgaggaccaggacatcagcatcagctttgcctgggacaagagcagcgccctgcaggtgtctggcagcacccggggcatggtgtgcagctgccgcctggtgttctgcagaagaacagagctgcgggtgggcaactgcctgattggaggagtgtccttcacctactgctgcaccagggtggactag

SEQ ID NO: 149669 - DNA, 285 bp, Artificial Sequence
  Description of Artificial Sequence: Synthetic coding sequence
atgaggaccatcgccatcctggccgccatcctgctggtggccctgcaggcccaggccgagagcctgcaggagcgggcagatgaggccaccacccagaagcagagcggggaggacaaccaggacctggccatcagctttgctggaaatggcctgagcgccctgcggaccagcggcagccaggcccgggccacctgctactgcaggacaggccgctgtgccacccgggagagcctgtctggagtgtgtgagatcagcggccgcctgtaccgcctgtgctgcaggtag

SEQ ID NO: 149670 - DNA, 303 bp, Artificial Sequence
  Description of Artificial Sequence: Synthetic coding sequence
atgaggaccctgaccatcctgacagctgtgctgctggtggccctgcaggccaaggccgagcccctgcaggctgaagatgaccccctgcaggccaaggcctatgaagcagatgcccaggagcagagaggagccaatgaccaggactttgctgtgtcctttgctgaagatgccagcagcagcctgcgggccctgggcagcacccgggccttcacctgccactgcagaagaagctgctacagcacagagtacagctatggcacctgcaccgtgatgggcatcaaccaccgcttctgctgcctgtag

SEQ ID NO: 149671 - DNA, 207 bp, Artificial Sequence
  Description of Artificial Sequence: Synthetic coding sequence
atgaggaccagctacctgctgctcttcaccctgtgcctgctgctgtctgagatggccagcggcggcaacttcctgaccggcctgggccacagaagtgaccactacaactgtgtgagcagcggcggccagtgcctgtacagcgcctgccccatcttcaccaagatccagggcacctgctaccggggcaaggccaagtgctgcaagtag

SEQ ID NO: 149672 - DNA, 372 bp, Artificial Sequence
  Description of Artificial Sequence: Synthetic coding sequence
atgaagctgctgctgctggccctgcccatgctggtgctgctgccccaggtgatcccagcctacagcggggagaagaagtgctggaacagaagtggccactgcaggaagcagtgcaaggatggagaggccgtgaaggacacctgcaagaacctgcgggcctgctgcatccccagcaatgaagaccacagaagagtgcctgccaccagccccacccccctgagtgacagcaccccaggcatcattgatgacatcctgactgtgcgcttcaccacagactactttgaggtgagcagcaagaaggacatggtggaggagagcgaggccggccggggcacagagaccagcctgcccaacgtgcaccacagcagctag

SEQ ID NO: 149673 - DNA, 1002 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgcgggagatggcctggggcgtggagcagggcctgctggaccccagcgacatcagcgagagcctgctggacaagtgcctgtacaccaacagaagcccccacccagacatcctgatccgcaccagcggggaggtgcggctgagtgacttcctgctgtggcagaccagccacagctgcctggtgttccagcctgtgctgtggccagagtacaccttctggaacctgtttgaggccatcctgcagttccagatgaaccacagcgtgctgcagaaggcccgggacatgtatgcagaggagaggaagaggcagcagctggagcgggaccaggccaccgtgacagagcagctgctgcgggagggcctgcaggccagcggagatgcccagctgcggaggacccggctgcacaagctgagcgcccggcgggaggagcgggtgcagggcttcctgcaggccctggagctgaagagagctgactggctggcccggctgggcacagccagcgcctag

SEQ ID NO: 149674 - DNA, 1005 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgcgggagatggcctggggcgtggagcagggcctgctggaccccagcgacatcagcgagagcctgctggacaagtgcctgtacaccaacagaagcccccacccagacatcctgatccgcaccagcggggaggtgcggctgagtgacttcctgctgtggcagaccagccacagctgcctggtgttccagcctgtgctgtggccagagtacaccttctggaacctgtttgaggccatcctgcagttccagatgaaccacagcgtgctgcagcagaaggcccgggacatgtatgcagaggagaggaagaggcagcagctggagcgggaccaggccaccgtgacagagcagctgctgcgggagggcctgcaggccagcggagatgcccagctgcggaggacccggctgcacaagctgagcgcccggcgggaggagcgggtgcagggcttcctgcaggccctggagctgaagagagctgactggctggcccggctgggcacagccagcgcctag

SEQ ID NO: 149675 - DNA, 516 bp, Artificial Sequence
  Description of Artificial Sequence: Synthetic coding sequence
atggacctggcccggcagaagttcagccggctgatggaggagaaggagaagctgcagaagcatggagtgtgcatccgggtgctgggggacctgcacctgctgcccctggacctgcaggagctgattgcccaggccgtgcaggccaccaagaactacaacaatgacatcagcgagagcctgctggacaagtgcctgtacaccaacagaagcccccacccagacatcctgatccgcaccagcggggaggtgcggctgagtgacttcctgctgtggcagcagaaggcccgggacatgtatgcagaggagaggaagaggcagcagctggagcgggaccaggccaccgtgacagagcagctgctgcgggagggcctgcaggccagcggagatgcccagctgcggaggacccggctgcacaagctgagcgcccggcgggaggagcgggtgcagggcttcctgcaggccctggagctgaagagagctgactggctggcccggctgggcacagccagcgcctag

SEQ ID NO: 149676 - DNA, 501 bp, Artificial Sequence
  Description of Artificial Sequence: Synthetic coding sequence
atggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgcgggagatggcctggggcgtggagcagggcctgctggaccccagccgggaccgcttccaccacatcggccaggccagcctggagctgctgaccagctag

SEQ ID NO: 149677 - DNA, 546 bp, Artificial Sequence
  Description of Artificial Sequence: Synthetic coding sequence
atggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgcgggagatggcctggggcgtggagcagggcctgctggaccccagcgacatcagcgagagcctgctggacaagtgcctgtacaccaacagaagcccccacccagacatcctgatccgcaccagcggggaggtgcggctgagtgacttcctgctgtggcagaccagccacagctgcctggtgttccagcctgtgctgtggccagagtacaccttctggaacctgtttgaggccatcctgcagttccagatgaaccacagcgtgctgcagcaccctggcagcctgctgaccaaggcctggaagaagcccttccagcaggatggagagctgtatggcaactgcagcagccccaagagcagctag

SEQ ID NO: 149678 - DNA, 669 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgcgggagatggcctggggcgtggagcagggcctgctggacccccgctacccagatgacatcagcgagagcctgctggacaagtgcctgtacaccaacagaagcccccacccagacatcctgatccgcaccagcggggaggtgcggctgagtgacttcctgctgtggcagtag

SEQ ID NO: 149679 - DNA, 369 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggctag

SEQ ID NO: 149680 - DNA, 216 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctgtag

SEQ ID NO: 149681 - DNA, 258 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggtag

SEQ ID NO: 149682 - DNA, 885 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaagtgcttcctgaatgtgtgctttgcctacaccagcagacatgagatcagcaatgctgtgcgggagatggcctggggcgtggagcagggcctgctggaccccagcgacatcagcgagagcctgctggacaagtgcctgtacaccaacagaagcccccacccagacatcctgatccgcaccagcggggaggtgcggctgagtgacttcctgctgtggcagaccagccacagctgcctggtgttccagcctgtgctgtggccagagtacaccttctggaacctgtttgaggccatcctgcagttccagatgaaccacagcgtgctgcagaaggcccgggacatgtatgcagaggagaggaagaggcagcagctggagcgggaccaggccaccgtgacagagcagctgctgcgggagggcctgcaggccagcggagatgcccagctgcggaggacccggctgcacaagctgagcgcccggcgggaggagcgggtgcagggcttcctgcaggccctggagctgaagagagctgactggctggcccggctgggcacagccagcgcctag

SEQ ID NO: 149683 - DNA, 183 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagtag

SEQ ID NO: 149684 - DNA, 396 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgtag

SEQ ID NO: 149685 - DNA, 501 bp, Artificial Sequence
  Description of Artificial Sequence: Synthetic coding sequence
atgtcctggatcaaggagggggagctgagcctgtgggagcgcttctgtgccaacatcatcaaggccggccccatgcccaagcacatcgccttcatcatggatggcaacagaagatatgccaagaagtgccaggtggagcggcaggagggccacagccagggcttcaacaagctggccgagaccctgcgctggtgcctgaacctgggcatcctggaggtgacagtgtatgccttcagcattgagaacttcaagaggagcaagtctgaggtggatggcctgatggacctggcccggcagaagttcagccggctgatggaggagaaggagaagctgcagaagcacggcgtgtgcatccgggtgctgggggacctgcacctgctgcccctggacctgcaggagctgattgcccaggccgtgcaggccaccaagaactacaacaagtgcttcctgaatgtgtgctttgcctacaccagcagacatgagatcagcaatgctgtgtag

SEQ ID NO: 149686 - DNA, 909 bp, Artificial Sequence
  Description of Artificial Sequence: Synthetic coding sequence
atggtgtggaagaggctgggcgccctggtgatgttccccctgcagatgatctacctggtggtgaaggctgctgtgggcctggtgctgcctgccaagctgcgggacctgagcagagaaaatgtgctgatcaccggcggcggccggggcatcggccggcagctggcccgggagtttgctgagcggggggccaggaagatcgtgctgtggggccgcacagagaagtgcctgaaggagaccacagaggagatccggcagatgggcacagagtgccactacttcatctgtgatgtgggcaaccgggaggaggtgtaccagacagccaaggctgtgcgggagaaggtgggggacatcaccatcctggtgaacaatgctgctgtggtgcacggcaagagcctgatggacagtgatgatgatgccctgctgaagagccagcacatcaacaccctgggccagttctggaccaccaaggccttcctgcccaggatgctggagctgcagaatggccacatcgtgtgcctgaacagcgtgctggccctgagcgccatccctggggccatcgactactgcaccagcaaggccagcgcctttgccttcatggagagcctgaccctgggcctgctggactgccctggggtgtctgccaccaccgtgctgcccttccacaccagcacagagatgttccagggcatgagggtgcgcttccccaacctcttcccccccctgaagccagagaccgtggcccggaggacagtggaggccgtgcagctgaaccaggccctgctgctgctgccctggaccatgcacgccctggtgatcctgaagagcatcctgccccaggccgccctggaggagatccacaagttcagcggcacctacacctgcatgaacaccttcaagggccgcacctag

SEQ ID NO: 149687 - DNA, 444 bp, Artificial Sequence
  Description of Artificial Sequence: Synthetic coding sequence
atgggcacagagtgccactacttcatctgtgatgtgggcaaccgggaggaggtgtaccagacagccaaggctgtgcgggagaaggtgggggacatcaccatcctggtgaacaatgctgctgtggtgcacggcaagagcctgatggacagtgatgatgatgccctgctgaagagccagcacatcaacaccctgggccagttctggaccaccaaggccttcctgcccaggatgctggagctgcagaatggccacatcgtgtgcctgaacagcgtgctggccctgagcgccatccctggggccatcgactactgcaccagcaaggccagcgcctttgccttcatggagagcctgaccctgggcctgctggactgccctggggtgtctgccaccaccgtgctgcccttccacaccagcacagagatgttccagggcatgagggtgtag

SEQ ID NO: 149688 - DNA, 423 bp, Artificial Sequence
  Description of Artificial Sequence: Synthetic coding sequence
atggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccaccctgtggatggacaaggagaaggaggagagcatgaaggagaccctgcgcatccggcggctgggggagcctgaggactgtgccggcatcgtgtccttcctgtgcagtgaagatgccagctacatcaccggggagaccgtggtggtgggcggcggcacccccagccggctgtag

SEQ ID NO: 149689 - DNA, 837 bp, Artificial Sequence
  Description of Artificial Sequence: Synthetic coding sequence
atgcacaaggccggcctgctgggcctgtgtgcccgggcctggaacagcgtgaggatggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccacagctgtgaagctgcatggaggcatcgacatcctggtgtccaatgctgctgtgaaccccttcttcggcagcatcatggatgtgacagaggaggtgtgggacaagaccctggacatcaacgtgaaggccccagccctgatgaccaaggctgtggtgcctgagatggagaagaggggcggcggctctgtggtgattgtgagcagcattgctgccttcagccccagccctggcttcagcccctacaacgtgtccaagacagccctgctgggcctgaccaagaccctggccatcgagctggcccccaggaacatccgggtgaactgcctggcccctggcctcatcaagaccagcttcagcaggatgctgtggatggacaaggagaaggaggagagcatgaaggagaccctgcgcatccggcggctgggggagcctgaggactgtgccggcatcgtgtccttcctgtgcagtgaagatgccagctacatcaccggggagaccgtggtggtgggcggcggcacccccagccggctgtag

SEQ ID NO: 149690 - DNA, 513 bp, Artificial Sequence
  Description of Artificial Sequence: Synthetic coding sequence
atggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccacagctgtgaagctgcatggaggcatcgacatcctggtgtccaatgctgctgtgaaccccttcttcggcagcatcatggatgtgacagaggaggtgtgggacaagaggcggctgagcggggacagagtcttccacagcagcctgcagagcatcagcagcctggatggccagggcaagaggggcaagcatgagaggaacccagctgacaagaaggtgcggcgggcccggggcctgtgctggcacagggtcttccctgtgctgtag

SEQ ID NO: 149691 - DNA, 546 bp, Artificial Sequence
  Description of Artificial Sequence: Synthetic coding sequence
atggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccaccaccctggacatcaacgtgaaggccccagccctgatgaccaaggctgtggtgcctgagatggagaagaggggcggcggctctgtggtgattgtgagcagcattgctgccttcagccccagccccctgtggatggacaaggagaaggaggagagcatgaaggagaccctgcgcatccggcggctgggggagcctgaggactgtgccggcatcgtgtccttcctgtgcagtgaagatgccagctacatcactggagagaccgtggtggtgggcggcggcacccccagccggctgtag

SEQ ID NO: 149692 - DNA, 477 bp, Artificial Sequence
  Description of Artificial Sequence: Synthetic coding sequence
atgcacaaggccggcctgctgggcctgtgtgcccgggcctggaacagcgtgaggatggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccaccctgtggatggacaaggagaaggaggagagcatgaaggagaccctgcgcatccggcggctgggggagcctgaggactgtgccggcatcgtgtccttcctgtgcagtgaagatgccagctacatcaccggggagaccgtggtggtgggcggcggcacccccagccggctgtag

SEQ ID NO: 149693 - DNA, 579 bp, Artificial Sequence
  Description of Artificial Sequence: Synthetic coding sequence
atgcacaaggccggcctgctgggcctgtgtgcccgggcctggaacagcgtgaggatggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccacagctgtgaagctgcatggaggcatcgacatcctggtgtccaatgctgctgtgaaccccttcttcggcagcatcatggatgtgacagaggaggtgtgggacaagctgtggatggacaaggagaaggaggagagcatgaaggagaccctgcgcatccggcggctgggggagcctgaggactgtgccggcatcgtgtccttcctgtgcagtgaagatgccagctacatcaccggggagaccgtggtggtgggcggcggcacccccagccggctgtag

SEQ ID NO: 149694 - DNA, 681 bp, Artificial Sequence
  Description of Artificial Sequence: Synthetic coding sequence
atggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccaccaccctggacatcaacgtgaaggccccagccctgatgaccaaggctgtggtgcctgagatggagaagaggggcggcggctctgtggtgattgtgagcagcattgctgccttcagccccagccctggcttcagcccctacaacgtgtccaagacagccctgctgggcctgaccaagaccctggccatcgagctggcccccaggaacatccgggtgaactgcctggcccctggcctcatcaagaccagcttcagcaggatgctgtggatggacaaggagaaggaggagagcatgaaggagaccctgcgcatccggcggctgggggagcctgaggactgtgccggcatcgtgtccttcctgtgcagtgaagatgccagctacatcaccggggagaccgtggtggtgggcggcggcacccccagccggctgtag

SEQ ID NO: 149695 - DNA, 567 bp, Artificial Sequence
  Description of Artificial Sequence: Synthetic coding sequence
atgcacaaggccggcctgctgggcctgtgtgcccgggcctggaacagcgtgaggatggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccacagctgtgaagctgcatggaggcatcgacatcctggtgtccaatgctgctgtgaaccccttcttcggcagcatcatggatgtgacagaggaggtgtgggacaagaggcggctgagcggggacagagtcttccacagcagcctgcagagcatcagcagcctggatggccagggcaagaggggcaagcatgagaggaacccagctgacaagaaggtgcggcgggcccggggcctgtgctggcacagggtcttccctgtgctgtag

SEQ ID NO: 149696 - DNA, 600 bp, Artificial Sequence
  Description of Artificial Sequence: Synthetic coding sequence
atgcacaaggccggcctgctgggcctgtgtgcccgggcctggaacagcgtgaggatggccagcagcggcatgacccggcgggaccccctggccaacaaggtggccctggtgacagccagcacagatggcatcggctttgccatcgcccggcggctggcccaggatggagcccacgtggtggtgagcagcaggaagcagcagaatgtggaccaggccgtggccaccctgcagggcgagggcctgtctgtgacaggcaccgtgtgccacgtgggcaaggccgaggaccgggagcggctggtggccaccaccctggacatcaacgtgaaggccccagccctgatgaccaaggctgtggtgcctgagatggagaagaggggcggcggctctgtggtgattgtgagcagcattgctgccttcagccccagccccctgtggatggacaaggagaaggaggagagcatgaaggagaccctgcgcatccggcggctgggggagcctgaggactgtgccggcatcgtgtccttcctgtgcagtgaagatgccagctacatcactggagagaccgtggtggtgggcggcggcacccccagccggctgtag

SEQ ID NO: 149697 - DNA, 1374 bp, Artificial Sequence
  Description of Artificial Sequence: Synthetic coding sequence
atgaggtctgctgctgtgctggccctgctgctgtgtgccggccaggtgacagccctgcctgtgaacagccccatgaacaagggggacacagaggtgatgaagtgcatcgtggaggtgatcagtgacaccctgagcaagcccagccccatgcctgtgtcccaggagtgctttgagaccctgcggggagatgagcgcatcctgagcatcctgcggcaccagaacctgctgaaggagctgcaggacctggccctgcagggcgccaaggagcgggcccaccagcagaagaagcacagcggctttgaagatgagctgtctgaggtgctggagaaccagagcagccaggccgagctgaaggaggccgtggaggagcccagcagcaaggatgtgatggagaagcgggaggacagcaaggaggccgagaagagcggggaggccacagatggagcccggccccaggccctgcctgagcccatgcaggagagcaaggccgagggcaacaaccaggcccctggagaggaggaggaggaggaggaggaggccaccaacacccaccccccagccagcctgcccagccagaagtacccaggcccccaggccgagggggacagcgagggcctgagccagggcctggtggaccgggagaagggcctgtctgctgagcccggctggcaggccaagcgggaggaggaggaggaggaggaggaggaggccgaggccggggaggaggccgtgcctgaggaggagggccccaccgtggtgctgaacccccaccccagcctgggctacaaggagatcagaaaaggagagagccgctctgaggccctggccgtggatggagctgggaagccaggagctgaggaggcccaggaccctgagggcaagggggagcaggagcacagccagcagaaggaggaggaggaggagatggctgtggtgccccagggcctcttccggggcggcaagagcggggagctggagcaggaggaggagcggctgagcaaggagtgggaggacagcaagcgctggagcaagatggaccagctggccaaggagctgacagctgagaagaggctggagggccaggaggaggaggaggacaacagagacagctccatgaagctgtccttccgggcccgggcctacggcttccggggccctggcccccagctgcggcggggctggaggcccagcagccgggaggacagcctggaggccggcctgcccctgcaggtgcggggctacccagaggagaagaaggaggaggagggcagcgccaacagaagacctgaggaccaggagctggagagcctgagcgccatcgaggccgagctggagaaggtggcccaccagctgcaggccctgcggcggggctag

SEQ ID NO: 149698 - DNA, 1128 bp, Artificial Sequence
  Description of Artificial Sequence: Synthetic coding sequence
atgaactgggagctgctgctgtggctgctggtgctgtgtgccctgctgctgctgctggtgcagctgctgcgcttcctgcgggcagatggagacctgaccctgctgtgggccgagtggcagggccggcggcctgagtgggagctgacagacatggtggtgtgggtgactggagccagcagcggcatcggggaggagctggcctaccagctgagcaagctgggcgtgtccctggtgctgagcgcccggcgggtgcatgagctggagcgggtgaagaggcgctgcctggagaatggaaacctgaaggagaaggacatcctggtgctgcccctggacctgacagacaccggcagccatgaggccgccaccaaggctgtgctgcaggagtttggaagaattgacatcctggtgaacaacggcggcatgagccagaggagcctgtgcatggacaccagcctggatgtgtacaggaagctgattgagctgaactacctgggcaccgtgtccctgaccaagtgtgtgctgccccacatgattgaaaggaagcagggcaagatcgtgacagtgaacagcatcctgggcatcatctctgtgcccctgagcatcggctactgtgccagcaagcacgccctgcggggcttcttcaacggcctgaggacagagctggccacctacccaggcatcatcgtgagcaacatctgccccggccctgtgcagagcaacatcgtggagaacagcctggccggggaggtgaccaagaccatcggcaacaatggagaccagagccacaagatgaccaccagccgctgtgtgcggctgatgctgatctccatggccaatgacctgaaggaggtgtggatcagcgagcagcccttcctgctggtgacctacctgtggcagtacatgcccacctgggcctggtggatcacccgctggggcaggaagggcctgcggaccctgcgggtggtgtggatgcagaccctgctgatcctgaagagcctgcggcagaacatgacagagaagagcacctgcaccttccaggccaccggcggcagaaatggcaagcatgagaacagcaacctgctgatgctgctgaacaaccagaggctcatctgtgacttcaccttctag

SEQ ID NO: 149699 - DNA, 870 bp, Artificial Sequence
  Description of Artificial Sequence: Synthetic coding sequence
atggtggtgtgggtgactggagccagcagcggcatcggggaggagctggcctaccagctgagcaagctgggcgtgtccctggtgctgagcgcccggcgggtgcatgagctggagcgggtgaagaggcgctgcctggagaatggaaacctgaaggagaaggacatcctggtgctgcccctggacctgacagacaccggcagccatgaggccgccaccaaggctgtgctgcaggagtttggaagaattgacatcctggtgaacaacggcggcatgagccagaggagcctgtgcatggacaccagcctggatgtgtacaggaagctgattgagctgaactacctgggcaccgtgtccctgaccaagtgtgtgctgccccacatgattgaaaggaagcagggcaagatcgtgacagtgaacagcatcctgggcatcatctctgtgcccctgagcatcggctactgtgccagcaagcacgccctgcggggcttcttcaacggcctgaggacagagctggccacctacccaggcatcatcgtgagcaacatctgccccggccctgtgcagagcaacatcgtggagaacagcctggccggggaggtgaccaagaccatcggcaacaatggagaccagagccacaagatgaccaccagccgctgtgtgcggctgatgctgatctccatggccaatgacctgaaggaggtgtggatcagcgagcagcccttcctgctggtgacctacctgtggcagtacatgcccacctgggcctggtggatcaccaacaagatgggcaagaagagaattgagaacttcaagagcggcgtggatgctgacagcagctacttcaagatcttcaagaccaagcatgactag

SEQ ID NO: 149700 - DNA, 1020 bp, Artificial Sequence
  Description of Artificial Sequence: Synthetic coding sequence
atgaactgggagctgctgctgtggctgctggtgctgtgtgccctgctgctgctgctggtgcagctgctgcgcttcctgcgggcagatggagacctgaccctgctgtgggccgagtggcagggccggcggcctgagtgggagctgacagacatggtggtgtgggtgactggagccagcagcggcatcggggaggagctggcctaccagctgagcaagctgggcgtgtccctggtgctgagcgcccggcgggtgcatgagctggagcgggtgaagaggcgctgcctggagaatggaaacctgaaggagaaggacatcctggtgctgcccctggacctgacagacaccggcagccatgaggccgccaccaaggctgtgctgcaggagtttggaagaattgacatcctggtgaacaacggcggcatgagccagaggagcctgtgcatggacaccagcctggatgtgtacaggaagctgattgagctgaactacctgggcaccgtgtccctgaccaagtgtgtgctgccccacatgattgaaaggaagcagggcaagatcgtgacagtgaacagcatcctgggcatcatctctgtgcccctgagcatcggctactgtgccagcaagcacgccctgcggggcttcttcaacggcctgaggacagagctggccacctacccaggcatcatcgtgagcaacatctgccccggccctgtgcagagcaacatcgtggagaacagcctggccggggaggtgaccaagaccatcggcaacaatggagaccagagccacaagatgaccaccagccgctgtgtgcggctgatgctgatctccatggccaatgacctgaaggaggtgtggatcagcgagcagcccttcctgctggtgacctacctgtggcagtacatgcccacctgggcctggtggatcaccaacaagatgggcaagaagagaattgagaacttcaagagcggcgtggatgctgacagcagctacttcaagatcttcaagaccaagcatgactag

SEQ ID NO: 149701 - DNA, 186 bp, Artificial Sequence
  Description of Artificial Sequence: Synthetic coding sequence
atgaactgggagctgctgctgtggctgctggtgctgtgtgccctgctgctgctgctggtgcagctgctgcgcttcctgcgggcagatggagacctgaccctgctgtgggccgagtggcagggccggcggcctgagtgggagctgacagacatggtggtgtgggtgactggagccagcagcggctag

SEQ ID NO: 149702 - DNA, 960 bp, Artificial Sequence
  Description of Artificial Sequence: Synthetic coding sequence
atgctgttctgggtgctgggcctgctgatcctgtgtggcttcctgtggaccaggaagggcaagctgaagattgaggacatcacagacaagtacatcttcatcaccggctgtgacagcggctttggaaacctggccgcccggacctttgacaagaagggcttccacgtgattgctgcctgcctgacagagagcggcagcacagccctgaaggccgagaccagcgagcggctgaggacagtgctgctggatgtgacagatcctgaaaatgtgaagaggacagcccagtgggtgaagaaccaggtgggggagaagggcctgtggggcctcatcaacaatgccggcgtgcctggggtgctggcccccacagactggctgaccctggaggactaccgggagcccatcgaggtgaacctgtttggcctcatctctgtgaccctgaacatgctgcccctggtgaagaaggcccagggccgggtcatcaacgtgtcctctgtgggcggccgcctggccatcgtgggcggcggctacacccccagcaaatatgctgtggagggcttcaatgacagcctgcggcgggacatgaaggcctttggagtgcacgtgtcctgcatcgagcccggcctcttcaagaccaacctggccgaccctgtgaaggtgattgagaagaagctggccatctgggagcagctgagcccagacatcaagcagcagtacggggagggctacatcgagaagagcctggacaagctgaagggcaacaagagctatgtgaacatggacctgagccctgtggtggagtgcatggaccacgccctgaccagcctcttccccaagacccactacgccgccggcaaggatgccaagatcttctggatccccctgagccacatgcctgctgccctgcaggacttcctgctgctgaagcagaaggccgagctggccaaccccaaggctgtgtag

SEQ ID NO: 149703 - DNA, 960 bp, Artificial Sequence; identical to SEQ ID NO: 149702
  Description of Artificial Sequence: Synthetic coding sequence

SEQ ID NO: 149704 - DNA, 960 bp, Artificial Sequence; identical to SEQ ID NO: 149702
  Description of Artificial Sequence: Synthetic coding sequence

SEQ ID NO: 149705 - DNA, 519 bp, Artificial Sequence
  Description of Artificial Sequence: Synthetic coding sequence
atgctgcccctggtgaagaaggcccagggccgggtcatcaacgtgtcctctgtgggcggccgcctggccatcgtgggcggcggctacacccccagcaaatatgctgtggagggcttcaatgacagcctgcggcgggacatgaaggccttcggcgtgcacgtgtcctgcatcgagcccggcctcttcaagaccaacctggccgaccctgtgaaggtgattgagaagaagctggccatctgggagcagctgagcccagacatcaagcagcagtatggagagggctacatcgagaagagcctggacaagctgaagggcaacaagagctatgtgaacatggacctgagccctgtggtggagtgcatggaccacgccctgaccagcctcttccccaagacccactatgctgctgggaaggatgccaagatcttctggatccccctgagccacatgcctgctgccctgcaggacttcctgctgctgaagcagaaggccgagctggccaaccccaaggctgtgtag

SEQ ID NO: 149706 - DNA, 960 bp, Artificial Sequence; identical to SEQ ID NO: 149702
  Description of Artificial Sequence: Synthetic coding sequence

SEQ ID NO: 149707 - DNA, 1140 bp, Artificial Sequence
  Description of Artificial Sequence: Synthetic coding sequence
atgcctgagggccgcagccactgtgcctgcagcatcaccagcctgaccctgctggtgtccctgaccagggtgaccctggacatcctgcagaagctggaccccccccagcctgcccactggaggcaccacctgctggtgctgtacaagaagggcgtgtacctgagccacactggaggcaagatgctgttctgggtgctgggcctgctgatcctgtgtggcttcctgtggaccaggaagggcaagctgaagattgaggacatcacagacaagtacatcttcatcaccggctgtgacagcggctttggaaacctggccgcccggacctttgacaagaagggcttccacgtgattgctgcctgcctgacagagagcggcagcacagccctgaaggccgagaccagcgagcggctgaggacagtgctgctggatgtgacagatcctgaaaatgtgaagaggacagcccagtgggtgaagaaccaggtgggggagaagggcctgtggggcctcatcaacaatgccggcgtgcctggggtgctggcccccacagactggctgaccctggaggactaccgggagcccatcgaggtgaacctgtttggcctcatctctgtgaccctgaacatgctgcccctggtgaagaaggcccagggccgggtcatcaacgtgtcctctgtgggcggccgcctggccatcgtgggcggcggctacacccccagcaaatatgctgtggagggcttcaatgacagcctgcggcgggacatgaaggcctttggagtgcacgtgtcctgcatcgagcccggcctcttcaagaccaacctggccgaccctgtgaaggtgattgagaagaagctggccatctgggagcagctgagcccagacatcaagcagcagtacggggagggctacatcgagaagagcctggacaagctgaagggcaacaagagctatgtgaacatggacctgagccctgtggtggagtgcatggaccacgccctgaccagcctcttccccaagacccactacgccgccggcaaggatgccaagatcttctggatccccctgagccacatgcctgctgccctgcaggacttcctgctgctgaagcagaaggccgagctggccaaccccaaggctgtgtag

SEQ ID NO: 149708 - DNA, 960 bp, Artificial Sequence; identical to SEQ ID NO: 149702
  Description of Artificial Sequence: Synthetic coding sequence

SEQ ID NO: 149709 - DNA, 201 bp, Artificial Sequence
  Description of Artificial Sequence: Synthetic coding sequence
atgctgttctgggtgctgggcctgctgatcctgtgtggcttcctgtggaccaggaagggcaagctgaagattgaggacatcacagacaagtacatcttcatcaccggctgtgacagcggctttggaaacctggccgcccggacctttgacaagaagggcttccacgtgattgctgcctgcctgacagagagcggcagctag

SEQ ID NO: 149710 - DNA, 480 bp, Artificial Sequence
  Description of Artificial Sequence: Synthetic coding sequence
atgggcctgccccagcccggcctgtggctgaagaggctgtgggtgctgctggaggtggccgtgcacgtggtggtgggcaaggtgctgctgatcctcttcccagacagagtgaagaggaacatcctggccatgggagagaagacaggcatgaccaggaacccccacttcagccatgacaactggatccccaccttcttcagcacccagtacttctggtttgtgctgaaggtgcgctggcagaggctggaggacaccacagagctgggcggcctggcccccaactgccctgtggtgcggctgagcggccagcgctgcaacatctgggagttcatgcagggcaaccggcccctggtgctgaactttggcagctgccccagcttcatgttcaagtttgaccagttcaagaggctgattgaggacttcagcagcattgctgacttcctggtgatctacatcgaggaggcccacgccagcggctag

SEQ ID NO: 149711 - DNA, 744 bp, Artificial Sequence
  Description of Artificial Sequence: Synthetic coding sequence
atgggcctgccccagcccggcctgtggctgaagaggctgtgggtgctgctggaggtggccgtgcacgtggtggtgggcaaggtgctgctgatcctcttcccagacagagtgaagaggaacatcctggccatgggagagaagacaggcatgaccaggaacccccacttcagccatgacaactggatccccaccttcttcagcacccagtacttctggtttgtgctgaaggtgcgctggcagaggctggaggacaccacagagctgggcggcctggcccccaactgccctgtggtgcggctgagcggccagcgctgcaacatctgggagttcatgcagggcaaccggcccctggtgctgaactttggcagctgccccagcttcatgttcaagtttgaccagttcaagaggctgattgaggacttcagcagcattgctgacttcctggtgatctacatcgaggaggcccacgccagtgatggctgggccttcaagaacaacatggacatccggaaccaccagaacctgcaggaccggctgcaggccgcccacctgctgctggcccggagcccccagtgccctgtggtggtggacaccatgcagaaccagagcagccagctgtatgctgccctgcctgagcggctgtacatcatccaggagggccgcatcctgtacaagggcaagagcggcccctggaactacaaccctgaggaggtgcgggctgtgctggagaagctgcacagctag

SEQ ID NO: 149712 - DNA, 606 bp, Artificial Sequence
  Description of Artificial Sequence: Synthetic coding sequence
atgggcctgccccagcccggcctgtggctgaagaggctgtgggtgctgctggaggtggccgtgcacgtggtggtgggcaaggtgctgctgatcctcttcccagacagagtgaagaggaacatcctggccatgggagagaagacaggcatgaccaggaacccccacttcagccatgacaactggatccccaccttcttcagcacccagtacttctggtttgtgctgaaggtgcgctggcagaggctggaggacaccacagagctgggcggcctggcccccaactgccctgtggtgcggctgagcggccagcgctgcaacatctgggagttcatgcaggacggctgggccttcaagaacaacatggacatccggaaccaccagaacctgcaggaccggctgcaggccgcccacctgctgctggcccggagcccccagtgccctgtggtggtggacaccatgcagaaccagagcagccagctgtatgctgccctgcctgagcggctgtacatcatccaggagggccgcatcctgtacaagggcaagagcggcccctggaactacaaccctgaggaggtgcgggctgtgctggagaagctgcacagctag

SEQ ID NO: 149713 - DNA, 363 bp, Artificial Sequence
  Description of Artificial Sequence: Synthetic coding sequence
atgttcaagtttgaccagttcaagaggctgattgaggacttcagcagcattgctgacttcctggtgatctacatcgaggaggcccacgccagtgatggctgggccttcaagaacaacatggacatccggaaccaccagaacctgcaggaccggctgcaggccgcccacctgctgctggcccggagcccccagtgccctgtggtggtggacaccatgcagaaccagagcagccagctgtatgctgccctgcctgagcggctgtacatcatccaggagggccgcatcctgtacaagggcaagagcggcccctggaactacaaccctgaggaggtgcgggctgtgctggagaagctgcacagctag

SEQ ID NO: 149714 - DNA, 552 bp, Artificial Sequence
  Description of Artificial Sequence: Synthetic coding sequence
atgggcctgccccagcccggcctgtggctgaagaggctgtgggtgctgctggaggtggccgtgcacgtggtggtgggcaaggtgctgctgatcctcttcccagacagagtgaagaggaacatcctggccatgggagagaagacaggcaaccggcccctggtgctgaactttggcagctgccccagcttcatgttcaagtttgaccagttcaagaggctgattgaggacttcagcagcattgctgacttcctggtgatctacatcgaggaggcccacgccagtgatggctgggccttcaagaacaacatggacatccggaaccaccagaacctgcaggaccggctgcaggccgcccacctgctgctggcccggagcccccagtgccctgtggtggtggacaccatgcagaaccagagcagccagctgtatgctgccctgcctgagcggctgtacatcatccaggagggccgcatcctgtacaagggcaagagcggcccctggaactacaaccctgaggaggtgcgggctgtgctggagaagctgcacagctag

SEQ ID NO: 149715 - DNA, 342 bp, Artificial Sequence
  Description of Artificial Sequence: Synthetic coding sequence
atgggcctgccccagcccggcctgtggctgaagaggctgtgggtgctgctggaggtggccgtgcacgtggtggtgggcaaggtgctgctgatcctcttcccagacagagtgaagaggaacatcctggccatgggagagaagacaggcatgaccaggaacccccacttcagccatgacaactggatccccaccttcttcagcacccagtacttctggtttgtgctgaaggtgcgctggcagaggctggaggacaccacagagctgggcggcctggcccccaactgccctgtggtgcggctgagcggccagcgctgcaacatctgggagttcatgcagggctag

SEQ ID NO: 149716 - DNA, 270 bp, Artificial Sequence
  Description of Artificial Sequence: Synthetic coding sequence
atgggcatcctgtctgtggacctgctgatcaccctgcagatcctgcccgtcttcttcagcaactgcctcttcctggccctgtatgacagcgtcatcctgctgaagcacgtggtgctgctgctgagccgcagcaagagcaccagaggagagtggaggaggatgctgaccagcgagggcctgcgctgtgtgtggaagagcttcctgctggatgcctacaagcagctgaactgcccccccagcggcttcagcaaggatggccacatcctgtag

SEQ ID NO: 149717 - DNA, 399 bp, Artificial Sequence
  Description of Artificial Sequence: Synthetic coding sequence
atgggcatcctgtctgtggacctgctgatcaccctgcagatcctgcccgtcttcttcagcaactgcctcttcctggccctgtatgacagcgtcatcctgctgaagcacgtggtgctgctgctgagccgcagcaagagcaccagaggagagtggaggaggatgctgaccagcgagggcctgcgctgtgtgtggaagagcttcctgctggatgcctacaagcaggtgaagctgggagaagatgcccccaacagctctgtggtgcacgtgagcagcacagagggcggggacaacagcggaaatggcacccaggagaagattgctgagggcgccacctgccacctgctggactttgccagccctgagcggcccctggtggtgaactttggcagcgccacctag

SEQ ID NO: 149718 - DNA, 810 bp, Artificial Sequence
  Description of Artificial Sequence: Synthetic coding sequence
atgggcatcctgtctgtggacctgctgatcaccctgcagatcctgcccgtcttcttcagcaactgcctcttcctggccctgtatgacagcgtcatcctgctgaagcacgtggtgctgctgctgagccgcagcaagagcaccagaggagagtggaggaggatgctgaccagcgagggcctgcgctgtgtgtggaagagcttcctgctggatgcctacaagcaggtgaagctgggagaagatgcccccaacagctctgtggtgcacgtgagcagcacagagggcggggacaacagcggaaatggcacccaggagaagattgctgagggcgccacctgccacctgctggactttgccagccctgagcggcccctggtggtgaactttggcagcgccacccccttcaccagccagctgcctgccttcaggaagctggtggaggagttcagctctgtggccgacttcctgctggtgtacattgatgaggcccaccccagtgatggctgggccatccctggggacagcagcctgagctttgaggtgaagaagcaccagaaccaggaggacagatgtgccgccgcccagcagctgctggagcgcttcagcctgcccccccagtgccgggtggtggccgacaggatggacaacaatgccaacatcgcctatggagtggcctttgagcgggtgtgcatcgtgcagaggcagaagatcgcctacctgggcggcaagggccccttctcctacaacctgcaggaggtgcgccactggctggagaagaacttcagcaagaagaagacccggctggccggctag

SEQ ID NO: 149719 - DNA, 21 bp, Artificial Sequence
  Description of Artificial Sequence: Synthetic coding sequence
atgggcatcctgtctgtgtag

SEQ ID NO: 149720 - DNA, 21 bp, Artificial Sequence
  Description of Artificial Sequence: Synthetic coding sequence
atgggcatcctgtctgtgtag

SEQ ID NO: 149721 - DNA, 168 bp, Artificial Sequence
  Description of Artificial Sequence: Synthetic coding sequence
atgggcatcctgtctgtggacctgctgatcaccctgcagatcctgcccgtcttcttcagcaactgcctcttcctggccctgtatgacagcgtcatcctgctgaagcacgtggtgctgctgctgagccgcagcaagagcaccagaggagagtggaggaggatgctgtag

SEQ ID NO: 149722 - DNA, 912 bp, Artificial Sequence
  Description of Artificial Sequence: Synthetic coding sequence
atgggcatcctgtctgtggacctgctgatcaccctgcagatcctgcccgtcttcttcagcaactgcctcttcctggccctgtatgacagcgtcatcctgctgaagcacgtggtgctgctgctgagccgcagcaagagcaccagaggagagtggaggaggatgctgaccagcgagggcctgcgctgtgtgtggaagagcttcctgctggatgcctacaagcagctgaactgcccccccagcggcttcagcaaggatggccacatcctggtgtatgaggcctacaagagccggctgctggtgtacagccacctggacctgtggatggtgaagctgggagaagatgcccccaacagctctgtggtgcacgtgagcagcacagagggcggggacaacagcggaaatggcacccaggagaagattgctgagggcgccacctgccacctgctggactttgccagccctgagcggcccctggtggtgaactttggcagcgccacccccttcaccagccagctgcctgccttcaggaagctggtggaggagttcagctctgtggccgacttcctgctggtgtacattgatgaggcccaccccagtgatggctgggccatccctggggacagcagcctgagctttgaggtgaagaagcaccagaaccaggaggacagatgtgccgccgcccagcagctgctggagcgcttcagcctgcccccccagtgccgggtggtggccgacaggatggacaacaatgccaacatcgcctatggagtggcctttgagcgggtgtgcatcgtgcagaggcagaagatcgcctacctgggcggcaagggccccttctcctacaacctgcaggaggtgcgccactggctggagaagaacttcagcaagaagaagacccggctggccggctag

SEQ ID NO: 149723 - DNA, 810 bp, Artificial Sequence; identical to SEQ ID NO: 149718
  Description of Artificial Sequence: Synthetic coding sequence

SEQ ID NO: 149724 - DNA, 909 bp, Artificial Sequence
  Description of Artificial Sequence: Synthetic coding sequence
atgccccggcaggccaccagccggctggtggtgggggagggggagggcagccagggcgccagcggccctgctgccaccatgctgcggagcctgctgctgcacagcctgcggctgtgtgcccagacagccagctgcctggtgctcttcccccgcttcctgggcacagccttcatgctgtggctgctggacttcctgtgcatcaggaagcacttcctgggcagaagaagaagaggccagcctgagcctgaggtggagctgaacagcgagggggaggaggtgcccccagatgacccccccatctgtgtgtctgatgacaaccggctgtgcaccctggccagcctgaaggctgtgtggcacggccagaagctggacttcttcaagcaggcccacgagggcggccctgcccccaacagcgaggtggtgctgcctgatggcttccagagccagcacatcctggactatgcccagggcaaccggcccctggtgctgaactttggcagctgcccccccttcatggccaggatgtctgccttccagaggctggtgaccaagtaccagagagatgtggacttcctgatcatctacatcgaggaggcccaccccagtgatggctgggtgaccacagacagcccctacatcatcccccagcacaggagcctggaggacagagtgtctgctgcccgggtgctgcagcagggcgcccctggctgtgccctggtgctggacaccatggccaacagcagcagcagcgcctacggggcctactttgagcggctgtatgtgatccagagcggcaccatcatgtaccagggcggccggggcccagatggctaccaggtgtctgagctgcggacctggctggagagatatgatgagcagctgcatggagcccggccccggcgggtgtag

SEQ ID NO: 149725 - DNA, 1026 bp, Artificial Sequence
  Description of Artificial Sequence: Synthetic coding sequence
atgtctgccagcgccccagctgctgagggggagggcacccccacccagcctgccagcgagaaggagcctgagatgcctggcccccgggaggagagcgaggaggaggaggatgaagatgatgaggaggaggaggaggaggagaagggcaagggccagaagctgtgtgaaattgagcgcatccacttcttcctgagcaagaagaagacagatgagctgaggaacctgcacaagctgctgtacaacagacctggcaccgtgagcagcctgaagaagaatgtgggccagttcagcggcttcccctttgagaagggctctgtgcagtacaagaagaaggaggagatgctgaagaagttcagaaatgccatgctgaagagcatctgtgaggtgctggacctggagaggtctggagtgaacagcgagctggtgaagaggatcctgaacttcctgatgcaccccaagcccagcggcaagcccctgcccaagagcaagaagacctgcagcaagggcagcaagaaggagaggaacagcagcggcatggccaggaaggccaagaggaccaagtgcccagagatcctgagtgatgagagcagcagtgatgaagatgagaagaagaacaaggaggagagcagtgatgatgaggacaaggagagcgaggaggagccccccaagaagacagccaagcgggagaagcccaagcagaaggccaccagcaagagcaagaagtctgtgaagagcgccaacgtgaagaaggctgacagcagcaccaccaagaagaaccagaacagcagcaagaaggagagcgagagcgaggacagcagtgatgatgagcccctcatcaagaagctgaagaagcccccaacagatgaggagctgaaggagaccatcaagaagctgctggccagcgccaacctggaggaggtgaccatgaagcagatctgcaagaaggtgtatgagaactaccccacctatgacctgacagagaggaaggacttcatcaagaccaccgtgaaggagctgatctcctag

SEQ ID NO: 149726 - DNA, 1128 bp, Artificial Sequence
  Description of Artificial Sequence: Synthetic coding sequence
atgtctgccagcgccccagctgctgagggggagggcacccccacccagcctgccagcgagaaggagcctgagatgcctggcccccgggaggagagcgaggaggaggaggatgaagatgatgaggaggaggaggaggaggagaaggagaagagcctgattgtggagggcaagcgggagaagaagaaggtggagcggctgaccatgcaggtgagcagcctgcagcgggagcccttcaccatcgcccagggcaagggccagaagctgtgtgaaattgagcgcatccacttcttcctgagcaagaagaagacagatgagctgaggaacctgcacaagctgctgtacaacagacctggcaccgtgagcagcctgaagaagaatgtgggccagttcagcggcttcccctttgagaagggctctgtgcagtacaagaagaaggaggagatgctgaagaagttcagaaatgccatgctgaagagcatctgtgaggtgctggacctggagaggtctggagtgaacagcgagctggtgaagaggatcctgaacttcctgatgcaccccaagcccagcggcaagcccctgcccaagagcaagaagacctgcagcaagggcagcaagaaggagaggaacagcagcggcatggccaggaaggccaagaggaccaagtgcccagagatcctgagtgatgagagcagcagtgatgaagatgagaagaagaacaaggaggagagcagtgatgatgaggacaaggagagcgaggaggagccccccaagaagacagccaagcgggagaagcccaagcagaaggccaccagcaagagcaagaagtctgtgaagagcgccaacgtgaagaaggctgacagcagcaccaccaagaagaaccagaacagcagcaagaaggagagcgagagcgaggacagcagtgatgatgagcccctcatcaagaagctgaagaagcccccaacagatgaggagctgaaggagaccatcaagaagctgctggccagcgccaacctggaggaggtgaccatgaagcagatctgcaagaaggtgtatgagaactaccccacctatgacctgacagagaggaaggacttcatcaagaccaccgtgaaggagctgatctcctag

SEQ ID NO: 149727 - DNA, 1101 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccagcagccccttccaggtgacagctggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149728 - DNA, 1605 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149729 - DNA, 1821 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149730 - DNA, 1461 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149731 - DNA, 1677 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149732 - DNA, 1086 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagatgccaccctag

SEQ ID NO: 149733 - DNA, 1965 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149734 - DNA, 1605 bp, Artificial Sequence; identical to SEQ ID NO: 149728
  Description of Artificial Sequence: Synthetic coding sequence

SEQ ID NO: 149735 - DNA, 1317 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccccttccaggtggccaccggctaccagtttcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149736 - DNA, 1173 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149737 - DNA, 1746 bp, Artificial Sequence
  Description of Artificial Sequence: Synthetic coding sequence
atgatggatgaaacagaaattggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagattctgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149738 - DNA, 1014 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagatgccaccctag

SEQ ID NO: 149739 - DNA, 1101 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccctgtgcaggtgaccaccggctaccagctgcctgtgtacaactaccaggccttccctgcctaccccaacagccctgtgcaggtgaccaccggctaccagctgcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149740 - DNA, 1317 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149741 - DNA, 1086 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccctgtgcaggtgaccaccggctaccagctgcctgtgtacaactaccagatgccaccctag

SEQ ID NO: 149742 - DNA, 1173 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 149743 - DNA, 948 bp, Artificial Sequence
  Description of Artificial Sequence: Synthetic coding sequence
atggccgcccccagctgtggcggggacaggaaggcccggctgacccccagcctgccccatgagagcacagccaaccctgagacccccaacagcaccatcagccgggaggccagcacccagagcagcagcgctgccaccagccagggctacatcctgcctgagggcaagatcatgcccaacacagtgtttgtgggcggcattgatgtgaggatggatgaaacagagatccgctccttctttgcccgctatggctctgtgaaggaggtgaagatcatcacagacagaactggagtgtccaagggctacggctttgtgtccttcttcaatgatgtggatgtgcagaagatcgtggagagccagatcaacttccacggcaagaagctgaagctgggccctgccatcaggaagcagaacctgtgtgcctaccacgtgcagccccggcccctggtgttcaaccaccccccaccaccccagttccagaatgtgtggaccaaccccaacacagagacctacatgcagcccaccaccaccatgaaccccatcacccagtatgtgcaggcctaccccacctaccccaacagccctgtgcaggtgatcaccggctaccagctgcctgtgtacaactaccagatgccaccccagtggcctgtgggggagcagaggagctatgtggtgcccccagcctacagcgctgtgaactaccactgcaatgaggtggaccctggagctgaggtggtgcccaatgaatgttctgtgcatgaggccaccccaccttctggaaatggcccccagaagaagtctgtggacaggagcatccagacagtggtgtcctgcctcttcaacccagaaaatcggctgagaaattctgtggtgacccaggatgactacttcaaggacaagagggtgcaccacttccgccgcagccgggccatgctgaagtctgtgtag

SEQ ID NO: 149744 - DNA, 888 bp, Artificial Sequence
  Description of Artificial Sequence: Synthetic coding sequence
atgagcacagccaaccctgagacccccaacagcaccatcagccgggaggccagcacccagagcagcagcgctgccaccagccagggctacatcctgcctgagggcaagatcatgcccaacacagtgtttgtgggcggcattgatgtgaggatggatgaaacagagatccgctccttctttgcccgctatggctctgtgaaggaggtgaagatcatcacagacagaactggagtgtccaagggctacggctttgtgtccttcttcaatgatgtggatgtgcagaagatcgtggagagccagatcaacttccacggcaagaagctgaagctgggccctgccatcaggaagcagaacctgtgtgcctaccacgtgcagccccggcccctggtgttcaaccaccccccaccaccccagttccagaatgtgtggaccaaccccaacacagagacctacatgcagcccaccaccaccatgaaccccatcacccagtatgtgcaggcctaccccacctaccccaacagccctgtgcaggtgatcaccggctaccagctgcctgtgtacaactaccagatgccaccccagtggcctgtgggggagcagaggagctatgtggtgcccccagcctacagcgctgtgaactaccactgcaatgaggtggaccctggagctgaggtggtgcccaatgaatgttctgtgcatgaggccaccccaccttctggaaatggcccccagaagaagtctgtggacaggagcatccagacagtggtgtcctgcctcttcaacccagaaaatcggctgagaaattctgtggtgacccaggatgactacttcaaggacaagagggtgcaccacttccgccgcagccgggccatgctgaagtctgtgtag

SEQ ID NO: 149745 - DNA, 2286 bp, Artificial Sequence
  Description of Artificial Sequence: Synthetic coding sequence
atgaactggaggtttgtggagctgctgtacttcctgttcatctggggccgcatctctgtgcagcccagccaccaggagcccgccggcacagaccagcacgtgtccaaggagtttgactggctgatcagtgaccggggccccttccaccacagccgcagctacctgagctttgtggagcggcaccggcagggcttcaccacccgctacaagatctaccgggagtttgcccgctggaaggtgaggaacacagccattgaaagaagagacctggtgcgccaccctgtgcccctgatgcctgagttccagaggagcatccggctgctgggccggcggcccaccacccagcagttcatcgacaccatcatcaagaagtatggcacccacctgctgatcagcgccaccctgggcggggaggaggccctgaccatgtacatggacaagagccggctggacaggaagtctggaaatgccacccagagcgtggaggccctgcaccagctggccagcagctactttgtggacagagatggcaccatgaggcggctgcacgagatccagatcagcactggagccatcaaggtgacagagaccaggacaggccccctgggctgcaacagctatgacaacctggacagcgtgtcctctgtgctgctgcagagcacagagagcaagctgcacctgcagggcctgcagatcatcttcccccagtacctgcaggagaagtttgtgcagagcgccctgagctacatcatgtgcaatggagagggggagtacctgtgccagaacagccagtgccgctgccagtgtgccgaggagttcccccagtgcaactgccccatcacagacatccagatcatggagtacaccctggccaacatggccaagtcctgggccgaggcctacaaggacctggagaacagtgatgagttcaagagcttcatgaagaggctgcccagcaaccacttcctgaccatcggcagcatccaccagcactggggcaatgactgggacctgcagaaccgctacaagctgctgcagagcgccacagaggcccagaggcagaagatccagaggacagccaggaagctgtttggcctgtctgtgcgctgccgccacaaccccaaccaccagctgccccgggagaggaccatccagcagtggctggcccgggtgcagagcctgctgtactgcaatgaaaatggcttctggggcaccttcctggagagccagaggagctgtgtgtgccacggcagcaccaccctgtgccagaggcccatcccctgcgtcatcggcggcaacaacagctgtgccatgtgcagcctggccaacatcagcctgtgtggcagctgcaacaagggctacaagctgtaccggggccgctgtgagccccagaatgtggacagcgagaggtctgagcagttcatcagctttgaaacagacctggacttccaggacctggagctgaagtacctgctgcagaagatggacagccggctgtatgtgcacaccaccttcatcagcaatgagatccggctggacaccttctttgacccccgctggaggaagaggatgagcctgaccctgaagagcaacaagaacaggatggacttcatccacatggtgattggcatgtccatgaggatctgccagatgaggaacagcagcctggaccccatgttctttgtgtatgtgaaccccttcagcggcagccacagcgagggctggaacatgccctttggagaatttggctacccccgctgggagaagatccggctgcagaacagccagtgctacaactggaccctgctgctgggcaaccgctggaagaccttctttgagaccgtgcacatctacctgcggagcaggacccggctgcccaccctgctgagaaatgaaacaggccagggccctgtggacctgagtgaccccagcaagaggcagttctacatcaagatcagtgatgtgcaggtgtttggctacagcctgcgcttcaatgctgacctgctgcggtctgctgtgcagcaggtgaaccagagctacacccagggcggccagttctacagcagcagctctgtgatgctgctgctgctggacatccgggaccgcatcaaccggctggcccctcctgtggcccctgggaagccccagctggacctcttcagctgcatgctgaagcaccggctgaagctgaccaacagcgagatcatccgggtgaaccacgccctggacctgtacaacacagagatcctgaagcagagcgaccagatgacagccaagctgtgctag

SEQ ID NO: 149746 - DNA, 963 bp, Artificial Sequence
  Description of Artificial Sequence: Synthetic coding sequence
atgaactggaggtttgtggagctgctgtacttcctgttcatctggggccgcatctctgtgcagcccagccaccaggagcccgccggcacagaccagcacgtgtccaaggagtttgactggctgatcagtgaccggggccccttccaccacagccgcagctacctgagctttgtggagcggcaccggcagggcttcaccacccgctacaagatctaccgggagtttgcccgctggaaggtgaggaacacagccattgaaagaagagacctggtgcgccaccctgtgcccctgatgcctgagttccagaggagcatccggctgctgggccggcggcccaccacccagcagttcatcgacaccatcatcaagaagtatggcacccacctgctgatcagcgccaccctgggcggggaggaggccctgaccatgtacatggacaagagccggctggacaggaagtctggaaatgccacccagagcgtggaggccctgcaccagctggccagcagctactttgtggacagagatggcaccatgaggcggctgcacgagatccagatcagcactggagccatcaaggtgacagagaccaggacaggccccctgggctgcaacagctatgacaacctggacagcgtgtcctctgtgctgctgcagagcacagagagcaagctgcacctgcagggcctgcagatcatcttcccccagtacctgcaggagaagtttgtgcagagcgccctgagctacatcatgtgcaatggagagggggagtacctgtgccagaacagccagtgccgctgccagtgtgccgaggagttcccccagtgcaactgccccatcacagacatccagatcatggagtacaccctggccaacatggccaagtcctgggccgaggcctacaaggacctggagaacagcggccgggagagccacagcgtgcccctgcacgagtggccctag

SEQ ID NO: 149747 - DNA, 2286 bp, Artificial Sequence; identical to SEQ ID NO: 149745
  Description of Artificial Sequence: Synthetic coding sequence

SEQ ID NO: 149748 - DNA, 1404 bp, Artificial Sequence
  Description of Artificial Sequence: Synthetic coding sequence
atgaagaggatcaaggtgcctgactacaaggacagatctgtgtttggagtgcccctgactgtgaatgtgcagaggacaggccagcccctgccccagagcatccagcaggccatgagatacctgaggaaccactgcctggaccaggtgggcctcttcaggaagtctggagtgaagagccgcatccaggccctgcggcagatgaatgaaggagccatcgactgtgtgaactatgagggccagagcgcctatgatgtggccgacatgctgaagcagtacttccgggacctgcctgagcccctgatgaccaacaagctgtctgagaccttcctgcagatctaccagtatgtgcccaaggaccagaggctgcaggccatcaaggccgccatcatgctgctgcctgatgaaaatcgggaggtgctgcagaccctgctgtacttcctgagtgatgtgacagctgctgtgaaggagaaccagatgacccccaccaacctggccgtgtgcctggcccccagcctcttccacctgaacaccctgaagcgggagaacagcagcccccgggtgatgcagaggaagcagagcctgggcaagccagaccagaaggacctgaatgaaaacctggccgccacccagggcctggcccacatgattgctgagtgcaagaagctgttccaggtgcctgaggagatgagccgctgcagaaattcctacacagagcaggagctgaagcccctgaccctggaggccctgggccacctgggcaatgatgattctgctgactaccagcacttcctgcaggactgtgtggatggcctcttcaaggaggtgaaggagaagttcaagggctgggtgtcctacagcaccagcgagcaggccgagctgagctacaagaaggtgtctgagggcccccccctgcggctgtggaggtctgtgattgaggtgcctgctgtgcctgaggagatcctgaagaggctgctgaaggagcagcacctgtgggatgtggacctgctggacagcaaggtgattgagatcctggacagccagacagagatctaccagtatgtgcagaacagcatggccccccacccagcccgggactatgtggtgctgcggacctggaggaccaacctgcccaagggggcctgtgccctgctgctgacctctgtggaccatgaccgggcccctgtggtgggcgtgcgggtgaatgtgctgctgagccgctacctgattgagccctgtggccctgggaagagcaagctgacctacatgtgccgggtggacctgcggggccacatgcctgagtggtacaccaagagctttggccacctgtgtgccgctgaggtggtgaagatccgggacagcttcagcaaccagaacacagagaccaaggacaccaagagcaggtag

SEQ ID NO: 149749 - DNA, 3378 bp, Artificial Sequence
  Description of Artificial Sequence: Synthetic coding sequence
atgggagaccccaaggcccacgtgatggcccggcccctgcgggcccccctgcggcgctccttcagtgaccacatccgggacagcacagcccgggccctggatgtgatctggaagaacacccgggaccggcggctggccgagattgaggccaaggaggcctgtgactggctgcgggccaccggcttcccccagtatgcccagctgtatgaggacttcctgttccccatcgacatcagcctggtgaagcgggagcatgacttcctggacagagatgccatcgaggccctgtgccggcggctgaacaccctgaacaagtgtgctgtgatgaagctggagatcagcccccacaggaagagaagtgatgacagtgatgaagatgagccctgtgccatcagcggcaagtggaccttccagagggacagcaagcgctggagccggctggaggagtttgatgtgttcagccccaagcaggacctggtgcccggcagcccagatgacagccaccccaaggatggccccagccctgggggcaccctgatggacctgtctgagcggcaggaggtgtcctctgtgcgcagcctgagcagcacaggcagcctgcccagccacgcccctccttctgaagatgctgccacccccaggaccaacagcgtcatctctgtgtgcagcagcagcaacctggccggaaatgatgacagctttggcagcctgcccagccccaaggagctgagcagcttctccttctccatgaagggccacgagaagacagccaagagcaagaccaggagcctgctgaagaggatggagagcctgaagctgaagagcagccaccacagcaagcacaaggcccccagcaagctgggcctcatcatcagcggccccatcctgcaggagggcatggatgaggagaagctgaagcagctgaactgtgtggagatcagcgccctgaatggaaaccgcatcaacgtgcccatggtgaggaagaggtctgtgagcaacagcacccagaccagcagcagcagcagccagagcgagaccagcagcgctgtgtccacccccagccctgtgaccaggaccaggagcctgagcgcctgcaacaagagggtgggcatgtacctggagggctttgaccccttcaaccagagcaccttcaacaacgtggtggagcagaacttcaagaaccgggagagctacccagaggacaccgtcttctacatccctgaggaccacaagccaggcaccttccccaaggccctgaccaacggcagcttcagccccagcggcaacaacggctctgtgaactggaggacaggcagcttccacggccctggccacatcagcctgcggcgggagaacagcagtgacagccccaaggagctgaagagaagaaacagcagcagctccatgagcagccggctgagcatctatgacaacgtgcccggcagcatcctgtacagcagcagcggggacctggccgacctggagaatgaagacatcttccctgagctggatgacatcctgtaccacgtgaagggcatgcagagaattgtgaaccagtggagcgagaagttcagtgatgaaggagacagcgacagcgccctggacagcgtgagcccctgccccagcagccccaagcagatccacctggatgtggacaatgacaggaccacccccagcgacctggacagcacaggcaacagcctgaatgaacctgaggagcccagcgagatccctgagcggcgggacagcggcgtgggcgccagcctgaccaggagcaacagacaccggctgcgctggcacagcttccagagcagccaccggcccagcctgaacagcgtgtccctgcagatcaactgccagagcgtggcccagatgaacctgctgcagaagtacagcctgctgaagctgacagccctgctggagaagtacacccccagcaacaagcacggcttctcctgggccgtgcccaagttcatgaagaggatcaaggtgcctgactacaaggacagatctgtgtttggagtgcccctgactgtgaatgtgcagaggacaggccagcccctgccccagagcatccagcaggccatgagatacctgaggaaccactgcctggaccaggtgggcctcttcaggaagtctggagtgaagagccgcatccaggccctgcggcagatgaatgaaggagccatcgactgtgtgaactatgagggccagagcgcctatgatgtggccgacatgctgaagcagtacttccgggacctgcctgagcccctgatgaccaacaagctgtctgagaccttcctgcagatctaccagtatgtgcccaaggaccagaggctgcaggccatcaaggccgccatcatgctgctgcctgatgaaaatcgggaggtgctgcagaccctgctgtacttcctgagtgatgtgacagctgctgtgaaggagaaccagatgacccccaccaacctggccgtgtgcctggcccccagcctcttccacctgaacaccctgaagcgggagaacagcagcccccgggtgatgcagaggaagcagagcctgggcaagccagaccagaaggacctgaatgaaaacctggccgccacccagggcctggcccacatgattgctgagtgcaagaagctgttccaggtgcctgaggagatgagccgctgcagaaattcctacacagagcaggagctgaagcccctgaccctggaggccctgggccacctgggcaatgatgattctgctgactaccagcacttcctgcaggactgtgtggatggcctcttcaaggaggtgaaggagaagttcaagggctgggtgtcctacagcaccagcgagcaggccgagctgagctacaagaaggtgtctgagggcccccccctgcggctgtggaggtctgtgattgaggtgcctgctgtgcctgaggagatcctgaagaggctgctgaaggagcagcacctgtgggatgtggacctgctggacagcaaggtgattgagatcctggacagccagacagagatctaccagtatgtgcagaacagcatggccccccacccagcccgggactatgtggtgctgcggacctggaggaccaacctgcccaagggggcctgtgccctgctgctgacctctgtggaccatgaccgggcccctgtggtgggcgtgcgggtgaatgtgctgctgagccgctacctgattgagccctgtggccctgggaagagcaagctgacctacatgtgccgggtggacctgcggggccacatgcctgagtggtacaccaagagctttggccacctgtgtgccgctgaggtggtgaagatccgggacagcttcagcaaccagaacacagagaccaaggacaccaagagcaggtag

SEQ ID NO: 149750 - DNA, 3054 bp, Artificial Sequence
  Description of Artificial Sequence: Synthetic coding sequence
atgaagctggagatcagcccccacaggaagagaagtgatgacagtgatgaagatgagccctgtgccatcagcggcaagtggaccttccagagggacagcaagcgctggagccggctggaggagtttgatgtgttcagccccaagcaggacctggtgcccggcagcccagatgacagccaccccaaggatggccccagccctgggggcaccctgatggacctgtctgagcggcaggaggtgtcctctgtgcgcagcctgagcagcacaggcagcctgcccagccacgcccctccttctgaagatgctgccacccccaggaccaacagcgtcatctctgtgtgcagcagcagcaacctggccggaaatgatgacagctttggcagcctgcccagccccaaggagctgagcagcttctccttctccatgaagggccacgagaagacagccaagagcaagaccaggagcctgctgaagaggatggagagcctgaagctgaagagcagccaccacagcaagcacaaggcccccagcaagctgggcctcatcatcagcggccccatcctgcaggagggcatggatgaggagaagctgaagcagctgaactgtgtggagatcagcgccctgaatggaaaccgcatcaacgtgcccatggtgaggaagaggtctgtgagcaacagcacccagaccagcagcagcagcagccagagcgagaccagcagcgctgtgtccacccccagccctgtgaccaggaccaggagcctgagcgcctgcaacaagagggtgggcatgtacctggagggctttgaccccttcaaccagagcaccttcaacaacgtggtggagcagaacttcaagaaccgggagagctacccagaggacaccgtcttctacatccctgaggaccacaagccaggcaccttccccaaggccctgaccaacggcagcttcagccccagcggcaacaacggctctgtgaactggaggacaggcagcttccacggccctggccacatcagcctgcggcgggagaacagcagtgacagccccaaggagctgaagagaagaaacagcagcagctccatgagcagccggctgagcatctatgacaacgtgcccggcagcatcctgtacagcagcagcggggacctggccgacctggagaatgaagacatcttccctgagctggatgacatcctgtaccacgtgaagggcatgcagagaattgtgaaccagtggagcgagaagttcagtgatgaaggagacagcgacagcgccctggacagcgtgagcccctgccccagcagccccaagcagatccacctggatgtggacaatgacaggaccacccccagcgacctggacagcacaggcaacagcctgaatgaacctgaggagcccagcgagatccctgagcggcgggacagcggcgtgggcgccagcctgaccaggagcaacagacaccggctgcgctggcacagcttccagagcagccaccggcccagcctgaacagcgtgtccctgcagatcaactgccagagcgtggcccagatgaacctgctgcagaagtacagcctgctgaagctgacagccctgctggagaagtacacccccagcaacaagcacggcttctcctgggccgtgcccaagttcatgaagaggatcaaggtgcctgactacaaggacagatctgtgtttggagtgcccctgactgtgaatgtgcagaggacaggccagcccctgccccagagcatccagcaggccatgagatacctgaggaaccactgcctggaccaggtgggcctcttcaggaagtctggagtgaagagccgcatccaggccctgcggcagatgaatgaaggagccatcgactgtgtgaactatgagggccagagcgcctatgatgtggccgacatgctgaagcagtacttccgggacctgcctgagcccctgatgaccaacaagctgtctgagaccttcctgcagatctaccagtatgtgcccaaggaccagaggctgcaggccatcaaggccgccatcatgctgctgcctgatgaaaatcgggaggtgctgcagaccctgctgtacttcctgagtgatgtgacagctgctgtgaaggagaaccagatgacccccaccaacctggccgtgtgcctggcccccagcctcttccacctgaacaccctgaagcgggagaacagcagcccccgggtgatgcagaggaagcagagcctgggcaagccagaccagaaggacctgaatgaaaacctggccgccacccagggcctggcccacatgattgctgagtgcaagaagctgttccaggtgcctgaggagatgagccgctgcagaaattcctacacagagcaggagctgaagcccctgaccctggaggccctgggccacctgggcaatgatgattctgctgactaccagcacttcctgcaggactgtgtggatggcctcttcaaggaggtgaaggagaagttcaagggctgggtgtcctacagcaccagcgagcaggccgagctgagctacaagaaggtgtctgagggcccccccctgcggctgtggaggtctgtgattgaggtgcctgctgtgcctgaggagatcctgaagaggctgctgaaggagcagcacctgtgggatgtggacctgctggacagcaaggtgattgagatcctggacagccagacagagatctaccagtatgtgcagaacagcatggccccccacccagcccgggactatgtggtgctgcggacctggaggaccaacctgcccaagggggcctgtgccctgctgctgacctctgtggaccatgaccgggcccctgtggtgggcgtgcgggtgaatgtgctgctgagccgctacctgattgagccctgtggccctgggaagagcaagctgacctacatgtgccgggtggacctgcggggccacatgcctgagtggtacaccaagagctttggccacctgtgtgccgctgaggtggtgaagatccgggacagcttcagcaaccagaacacagagaccaaggacaccaagagcaggtag

SEQ ID NO: 149751 - DNA, 972 bp, Artificial Sequence
  Description of Artificial Sequence: Synthetic coding sequence
atgggcaacagcgccagcagaagtgactttgagtgggtgtacacagaccagccccacacccagaggaggaaggagatcctggccaagtacccagccatcaaggccctgatgaggccagacccccggctgaagtgggccgtgctggtgctggtgctggtgcagatgctggcctgctggctggtgcggggcctggcctggcgctggctgctcttctgggcctatgccttcggcggctgtgtgaaccacagcctgaccctggccatccatgacatcagccacaatgctgcctttggaacaggccgggccgccaggaaccgctggctggccgtgtttgccaacctgcctgtgggcgtgccctatgctgccagcttcaagaagtaccacgtggaccaccaccgctacctgggcggagatggcctggatgtggatgtgcccacccggctggagggctggttcttctgcaccccagccaggaagctgctgtggctggtgctgcagcccttcttctacagcctgcggcccctgtgtgtgcaccccaaggctgtgaccaggatggaggtgctgaacaccctggtgcagctggccgctgacctggccatctttgccctgtggggcctgaagcctgtggtgtacctgctggccagcagcttcctgggcctgggcctgcaccccatcagcggccactttgtggccgagcactacatgttcctgaagggccacgagacctacagctactacggccccctgaactggatcaccttcaacgtgggctaccacgtggagcaccacgacttccccagcatccctggctacaacctgcccctggtgaggaagatcgcccctgagtactatgaccacctgccccagcaccacagctgggtgaaggtgctgtgggactttgtgtttgaggacagcctgggcccctatgcccgggtgaagagggtgtaccgcctggccaaggatggcctgtag

SEQ ID NO: 149752 - DNA, 2214 bp, Artificial Sequence
  Description of Artificial Sequence: Synthetic coding sequence
atgcagccccggcgggcccaggcccctggggcccagctgctgcctgccctggccctgctgctgctgctgctgggcgccggcccccggggcagcagcctggccaaccctgtgcctgctgcccccctgagcgcccctggcccctgtgccgcccagccctgcagaaatggaggagtgtgcaccagcaggcctgagccagacccccagcacccagccccagctggggagcccggctacagctgcacctgcccagctggcatcagcggggccaactgccagctggtggccgacccctgtgccagcaacccctgccaccacggcaactgcagcagcagcagcagcagcagcagtgatggctacctgtgcatctgcaatgaaggctatgagggccccaactgtgagcaggccctgcccagcctgcctgccaccggctggacagagagcatggccccccggcagctgcagcctgtgcctgccacccaggagccagacaagatcctgcccaggagccaggccaccgtgaccctgcccacctggcagcccaagacaggccagaaggtggtggagatgaagtgggaccaggtggaggtgatcccagacatcgcctgtggaaatgccagcagcaacagcagcgctgggggccgcctggtgtcctttgaggtgccccagaacacctctgtgaagatccggcaggatgccacagccagcctcatcctgctgtggaaggtgacagccaccggcttccagcagtgcagcctgattgatggccgctctgtgacccccctgcaggccagcggcggcctggtgctgctggaggagatgctggccctgggcaacaaccacttcatcggctttgtgaatgacagcgtgaccaagagcatcgtggccctgcggctgaccctggtggtgaaggtgtccacctgtgtgcctggagagagccacgccaatgacctggagtgcagcggcaagggcaagtgcaccaccaagcccagcgaggccaccttcagctgcacctgtgaggagcagtatgtgggcaccttctgtgaggagtatgatgcctgccagaggaagccctgccagaacaatgccagctgcattgatgccaatgagaagcaggacggcagcaacttcacctgtgtgtgcctgcccggctacacaggagagctgtgccagagcaagattgactactgcatcctggacccctgcagaaatggagccacctgcatcagcagcctgagcggcttcacctgccagtgcccagagggctactttggaagtgcctgtgaggagaaggtggacccctgtgccagcagcccctgccagaacaacggcacctgctacgtggatggagtgcacttcacctgcaactgcagccctggcttcaccggccccacctgtgcccagctgattgacttctgtgccctgagcccctgtgcccacggcacctgccgctctgtgggcaccagctacaagtgcctgtgtgaccccggctaccacggcctgtactgtgaggaggagtacaatgaatgtctgagcgccccctgcctgaatgctgccacctgccgggacctggtgaatggctatgaatgtgtgtgcctggccgagtacaagggcacccactgtgagctgtacaaggacccctgtgccaacgtgtcctgcctgaatggagccacctgtgacagtgatggcctgaatggcacctgcatctgtgcccctggcttcaccggggaggagtgtgacatcgacatcaatgaatgtgacagcaacccctgccaccacggcggcagctgcctggaccagcccaacggctacaactgccactgcccccacggctgggtgggcgccaactgtgagatccacctgcagtggaagagcggccacatggccgagagcctgaccaacatgcccaggcacagcctgtacatcatcattggagccctgtgtgtggccttcatcctgatgctgatcatcctgattgtgggcatctgccgcatcagcagaattgagtaccagggcagcagcaggcctgcctatgaggagttctacaactgccgcagcattgacagcgagttcagcaatgccatcgccagcatcagacatgccaggtttgggaagaagagcaggcctgccatgtatgatgtgagccccatcgcctatgaggactacagcccagatgacaagcccctggtgaccctcatcaagaccaaggacctgtag

SEQ ID NO: 149753 - DNA, 1368 bp, Artificial Sequence
  Description of Artificial Sequence: Synthetic coding sequence
atgctggccctgggcaacaaccacttcatcggctttgtgaatgacagcgtgaccaagagcatcgtggccctgcggctgaccctggtggtgaaggtgtccacctgtgtgcctggagagagccacgccaatgacctggagtgcagcggcaagggcaagtgcaccaccaagcccagcgaggccaccttcagctgcacctgtgaggagcagtatgtgggcaccttctgtgaggagtatgatgcctgccagaggaagccctgccagaacaatgccagctgcattgatgccaatgagaagcaggacggcagcaacttcacctgtgtgtgcctgcccggctacacaggagagctgtgccagagcaagattgactactgcatcctggacccctgcagaaatggagccacctgcatcagcagcctgagcggcttcacctgccagtgcccagagggctactttggaagtgcctgtgaggagaaggtggacccctgtgccagcagcccctgccagaacaacggcacctgctgcagccctggcttcaccggccccacctgtgcccagctgattgacttctgtgccctgagcccctgtgcccacggcacctgccgctctgtgggcaccagctacaagtgcctgtgtgaccccggctaccacggcctgtactgtgaggaggagtacaatgaatgtctgagcgccccctgcctgaatgctgccacctgccgggacctggtgaatggctatgaatgtgtgtgcctggccgagtacaagggcacccactgtgagctgtacaaggacccctgtgccaacgtgtcctgcctgaatggagccacctgtgacagtgatggcctgaatggcacctgcatctgtgcccctggcttcaccggggaggagtgtgacatcgacatcaatgaatgtgacagcaacccctgccaccacggcggcagctgcctggaccagcccaacggctacaactgccactgcccccacggctgggtgggcgccaactgtgagatccacctgcagtggaagagcggccacatggccgagagcctgaccaacatgcccaggcacagcctgtacatcatcattggagccctgtgtgtggccttcatcctgatgctgatcatcctgattgtgggcatctgccgcatcagcagaattgagtaccagggcagcagcaggcctgcctatgaggagttctacaactgccgcagcattgacagcgagttcagcaatgccatcgccagcatcagacatgccaggtttgggaagaagagcaggcctgccatgtatgatgtgagccccatcgcctatgaggactacagcccagatgacaagcccctggtgaccctcatcaagaccaaggacctgtag

SEQ ID NO: 149754 - DNA, 933 bp, Artificial Sequence
  Description of Artificial Sequence: Synthetic coding sequence
atgacagccacagaggccctgctgcgggtgctgctgctgctgctggccttcggccacagcacctacggggctgagtgcttccctgcctgcaacccccagaatggcttctgtgaagatgacaacgtgtgccgctgccagcccggctggcagggccccctgtgtgaccagtgtgtgaccagccctggctgcctgcacggcctgtgtggggagcccggccagtgcatctgcacagatggctgggatggagagctgtgtgacagagatgtgcgggcctgcagcagcgccccctgtgccaacaacagaacctgtgtgtccctggatgatggcctgtatgagtgcagctgtgcccctggctacagcggcaaggactgccagaagaaggatggcccctgtgtgatcaatggcagcccctgccagcacggcggcacctgtgtggatgatgagggccgggccagccacgccagctgcctgtgccccccaggcttcagcggcaacttctgtgaaattgtggccaacagctgcacccccaacccctgtgaaaatgatggagtgtgcacagacatcggcggggacttccgctgccgctgcccagctggcttcatcgacaagacctgcagcaggcctgtgaccaactgtgccagcagcccctgccagaatggaggcacctgcctgcagcacacccagggccaggccatctgcttcaccatcctgggcgtgctgaccagcctggtggtgctgggcaccgtgggcatcgtgttcctgaacaagtgtgagacctgggtgagcaacctgcgctacaaccacatgctgaggaagaagaagaacctgctgctgcagtacaacagcggggaggacctggccgtgaacatcatcttccctgagaagattgacatgaccaccttcagcaaggaggccggagatgaggagatctag

SEQ ID NO: 149755 - DNA, 1152 bp, Artificial Sequence
  Description of Artificial Sequence: Synthetic coding sequence
atgacagccacagaggccctgctgcgggtgctgctgctgctgctggccttcggccacagcacctacggggctgagtgcttccctgcctgcaacccccagaatggcttctgtgaagatgacaacgtgtgccgctgccagcccggctggcagggccccctgtgtgaccagtgtgtgaccagccctggctgcctgcacggcctgtgtggggagcccggccagtgcatctgcacagatggctgggatggagagctgtgtgacagagatgtgcgggcctgcagcagcgccccctgtgccaacaacagaacctgtgtgtccctggatgatggcctgtatgagtgcagctgtgcccctggctacagcggcaaggactgccagaagaaggatggcccctgtgtgatcaatggcagcccctgccagcacggcggcacctgtgtggatgatgagggccgggccagccacgccagctgcctgtgccccccaggcttcagcggcaacttctgtgaaattgtggccaacagctgcacccccaacccctgtgaaaatgatggagtgtgcacagacatcggcggggacttccgctgccgctgcccagctggcttcatcgacaagacctgcagcaggcctgtgaccaactgtgccagcagcccctgccagaatggaggcacctgcctgcagcacacccaggtgtcctatgagtgcctgtgcaagccagagttcaccggcctgacctgtgtgaagaagagggccctgagcccccagcaggtgacccggctgcccagcggctacggcctggcctaccgcctgaccccaggagtgcatgagctgcctgtgcagcagcctgagcaccgcatcctgaaggtgtccatgaaggagctgaacaagaagacccccctgctgacagagggccaggccatctgcttcaccatcctgggcgtgctgaccagcctggtggtgctgggcaccgtgggcatcgtgttcctgaacaagtgtgagacctgggtgagcaacctgcgctacaaccacatgctgaggaagaagaagaacctgctgctgcagtacaacagcggggaggacctggccgtgaacatcatcttccctgagaagattgacatgaccaccttcagcaaggaggccggagatgaggagatctag

SEQ ID NO: 149756 - DNA, 294 bp, Artificial Sequence
  Description of Artificial Sequence: Synthetic coding sequence
atgacagccacagaggccctgctgcgggtgctgctgctgctgctggccttcggccacagcacctacggggctgagtgcttccctgcctgcaacccccagaatggcttctgtgaagatgacaacgtgtgccgctgccagcccggctggcagggccccctgtgtgaccagtgtgtgaccagccctggctgcctgcacggcctgtgtggggagcccggccagtgcatctgcacagatggctgggatggagagctgtgtgacagagatgtgcgggcctgcagcagcgccccctgctag

SEQ ID NO: 149757 - DNA, 3612 bp, Artificial Sequence
  Description of Artificial Sequence: Synthetic coding sequence
atggccgcctgtggccgggtgcggaggatgttccggctgtctgctgccctgcacctgctgctgctgtttgctgctggagctgagaagctgcccggccagggcgtgcacagccagggccagggccctggggccaactttgtgtcctttgtgggccaggccggcggcggcggccctgctggccagcagctgccccagctgccccagagcagccagctgcagcagcagcagcagcagcagcagcagcagcagcagccccagcccccccagccccccttccctgctgggggccccccagcccggcggggcggggccggggccggcggcggctggaagctggccgaggaggagagctgccgggaggatgtgaccagggtgtgccccaagcacacctggagcaacaacctggccgtgctggagtgcctgcaggatgtgcgggagccagaaaatgagatcagcagtgactgcaaccacctgctgtggaactacaagctgaacctgaccacagaccccaagtttgagagcgtggcccgggaggtgtgcaagagcaccatcacagagatcaaggaatgtgctgatgagcctgtgggcaagggctacatggtgtcctgcctggtggaccaccggggcaacatcacagagtaccagtgccaccagtacatcaccaagatgacagccatcatcttcagtgactaccgcctcatctgtggcttcatggatgactgcaagaatgacatcaacatcctgaagtgtggcagcatccggctgggggagaaggatgcccacagccagggcgaggtggtgtcctgcctggagaagggcctggtgaaggaggccgaggagcgggagcccaagatccaggtgtctgagctgtgcaagaaggccatcctgcgggtggccgagctgagcagtgatgacttccacctggacagacacctgtactttgcctgcagagatgaccgggagcgcttctgtgagaacacccaggccggggagggccgggtgtacaagtgcctcttcaaccacaagtttgaggagagcatgtctgagaagtgccgggaggccctgaccacccggcagaagctgattgcccaggactacaaggtgtcctacagcctggccaagagctgcaagagtgacctgaagaagtaccgctgcaatgtggagaacctgcccaggagccgggaggcccggctgagctacctgctgatgtgcctggagagcgctgtgcaccggggccggcaggtgtcctctgagtgccagggcgagatgctggactacagaaggatgctgatggaggacttcagcctgagccctgagatcatcctgagctgccgcggggagattgagcaccactgcagcggcctgcacaggaagggccgcaccctgcactgcctgatgaaggtggtgcggggggagaagggcaacctgggcatgaactgccagcaggccctgcagaccctcatccaggagacagatcctggagctgactacagaattgaccgggccctgaatgaggcctgtgagagcgtcatccagacagcctgcaagcacatccgcagcggggaccccatgatcctgagctgcctgatggagcacctgtacacagagaagatggtggaggactgtgagcaccggctgctggagctgcagtacttcatcagccgggactggaagctggaccctgtgctgtacaggaagtgccagggagatgccagccggctgtgccacacccacggctggaatgagaccagcgagttcatgccccagggcgctgtgttcagctgcctgtacagacatgcctacagaacagaggagcagggccggcggctgagcagagaatgtagagctgaggtgcagaggatcctgcaccagagggccatggatgtgaagctggaccctgccctgcaggacaagtgcctgattgacctgggcaagtggtgcagcgagaagacagaaacaggccaggagctggagtgcctgcaggaccacctggatgacctggtggtggagtgccgggacatcgtgggcaacctgacagagctggagagcgaggacatccagatcgaggccctgctgatgagggcctgtgagcccatcatccagaacttctgccatgatgtggccgacaaccagattgacagcggggacctgatggagtgcctgatccagaacaagcaccagaaggacatgaatgaaaaatgtgccatcggcgtgacccacttccagctggtgcagatgaaggacttccgcttctcctacaagttcaagatggcctgcaaggaggatgtgctgaagctgtgccccaacatcaagaagaaggtggatgtggtgatctgcctgagcaccaccgtgagaaatgacaccctgcaggaggccaaggagcaccgggtgtccctgaagtgccggcggcagctgcgggtggaggagctggagatgacagaggacatccggctggagccagacctgtatgaggcctgcaagagtgacatcaagaacttctgcagcgctgtgcagtatggaaatgcccagatcatcgagtgcctgaaggagaacaagaagcagctgagcacccgctgccaccagaaggtgttcaagctgcaggagacagagatgatggaccctgagctggactacaccctgatgagggtgtgcaagcagatgatcaagcgcttctgcccagaggccgacagcaagaccatgctgcagtgcctgaagcagaacaagaacagcgagctgatggaccccaagtgcaagcagatgatcaccaagaggcagatcacccagaacacagactaccgcctgaaccccatgctgaggaaggcctgcaaggctgacatccccaagttctgccacggcatcctgaccaaggccaaggatgattctgagctggagggccaggtgatcagctgcctgaagctgcgctatgctgaccagaggctgagcagtgactgtgaggaccagatccgcatcatcatccaggagagcgccctggactaccgcctggacccccagctgcagctgcactgcagtgatgagatcagcagcctgtgtgccgaggaggccgccgcccaggagcagacaggccaggtggaggagtgcctgaaggtgaacctgctgaagatcaagacagagctgtgcaagaaggaggtgctgaacatgctgaaggagagcaaggctgacatctttgtggaccctgtgctgcacacagcctgtgccctggacatcaagcaccactgtgccgccatcaccccaggccggggccggcagatgagctgcctgatggaggccctggaggacaagagggtgcggctgcagcctgagtgcaagaagaggctgaatgaccgcatcgagatgtggagctatgctgccaaggtggccccagcagatggcttcagtgacctggccatgcaggtgatgaccagccccagcaagaactacatcctgagcgtcatcagcggcagcatctgcatcctcttcctgattggcctgatgtgtggccgcatcaccaagagggtgacccgggagctgaaggaccggctgcagtacagaagtgagaccatggcctacaagggcctggtgtggagccaggatgtgacaggcagccctgcctag

SEQ ID NO: 149758 - DNA, 1764 bp, Artificial Sequence
  Description of Artificial Sequence: Synthetic coding sequence
atggtgagccccaggatgagcggcctgctgagccagaccgtcatcctggccctgatcttcctgccccagaccaggcctgctggggtgtttgagctgcagatccacagctttggacctggccctggccctggggcccccaggagcccctgcagcgcccggctgccctgccgcctcttcttccgggtgtgcctgaagccaggcctgtctgaggaggccgctgagagcccctgtgccctgggcgccgccctgagcgcccggggccctgtgtacacagagcagcccggggccccagccccagacctgcccctgcctgatggcctgctgcaggtgcccttcagagatgcctggccaggcaccttctccttcatcatcgagacctggagggaggagctgggggaccagattggaggccctgcctggagcctgctggcccgggtggccggcagaagaaggctggccgccggcggcccctgggcccgggacatccagagagctggggcctgggagctgcgcttctcctaccgggcccgctgtgagcccccagctgtgggcacagcctgcacccggctgtgccggcccaggtctgcccccagccgctgtggccctggcctgcggccctgtgcccccctggaggatgaatgtgaggcccccctggtgtgccgggccggctgcagccctgagcacggcttctgtgagcagcccggggagtgccgctgcctggagggctggacaggccccctgtgcaccgtgcctgtgtccaccagcagctgcctgagcccccggggccccagcagcgccaccaccggctgcctggtgcccggccctggcccctgtgatggcaacccctgtgccaatggaggcagctgcagcgagacccccaggagctttgaatgtacctgcccccggggcttctacggcctgcgctgtgaggtgtctggagtgacctgtgctgatggcccctgcttcaatggaggcctgtgtgtgggcggcgctgaccctgattctgcctacatctgccactgccccccaggcttccagggcagcaactgtgagaagagggtggaccgctgcagcctgcagccctgcagaaatggaggcctgtgcctggacctgggccacgccctgcgctgccgctgcagagctggctttgctggcccccgctgtgaacatgacctggatgactgtgccggccgggcctgtgccaacggcggcacctgtgtggagggcggcggggcccaccgctgcagctgtgccctgggctttggaggccgggactgccgggagagagctgacccctgtgccgcccggccctgtgcccacggcggccgctgctacgcccacttcagcggcctggtgtgtgcctgtgcccctggctacatgggcgcccgctgtgagttccctgtgcacccagatggagccagcgccctgcctgctgcccctcctggcctgcggcctggggacccccagcgctacctgctgcccccagccctgggcctgctggtggccgccggcgtggccggggccgccctgctgctggtgcacgtgagaagaagaggccacagccaggatgctggcagccggctgctggccggcaccccagagcccagcgtgcacgccctgcctgatgccctgaacaacctgcggacccaggagggcagcggagatggccccagcagctctgtggactggaacagaccagaagatgtggacccccagggcatctacgtgatcagcgcccccagcatctatgcccgggaggcctag

SEQ ID NO: 149759 - DNA, 2058 bp, Artificial Sequence
  Description of Artificial Sequence: Synthetic coding sequence
atggctgctgccagccgcagcgccagcggctgggccctgctgctgctggtggccctgtggcagcagagagctgctggcagcggggtcttccagctgcagctgcaggagttcatcaatgaaagaggagtgctggccagcggccggccctgtgagcccggctgcaggaccttcttccgggtgtgcctgaagcacttccaggccgtggtgtccccaggcccctgcaccttcggcaccgtgtccacccctgtgctgggcaccaacagctttgctgtgagagatgacagcagcggcggcggcaggaaccccctgcagctgcccttcaacttcacctggccaggcaccttcagcctcatcatcgaggcctggcacgcccctggagatgacctgcggcctgaggccctgcccccagatgccctgatcagcaagatcgccatccagggcagcctggccgtgggccagaactggctgctggatgagcagaccagcaccctgacccggctgcgctacagctacagagtcatctgcagcgacaactactacggggacaactgcagccggctgtgcaagaagagaaatgaccacttcggccactacgtgtgccagccagatggcaacctgagctgcctgcccggctggacaggagagtactgccagcagcccatctgcctgagcggctgccacgagcagaatggctactgcagcaagccagctgagtgcctgtgcaggcctggctggcagggccgcctgtgcaatgaatgcatcccccacaacggctgcagacatggcacctgcagcaccccctggcagtgcacctgtgatgagggctggggcggcctcttctgtgaccaggacctgaactactgcacccaccacagcccctgcaagaatggagccacctgcagcaacagcggccagaggagctacacctgcacctgccggcccggctacacaggagtggactgtgagctggagctgtctgaatgtgacagcaacccctgcagaaatggaggcagctgcaaggaccaggaggatggctaccactgcctgtgccccccaggctactacggcctgcactgtgagcacagcaccctgagctgtgccgacagcccctgcttcaatggaggcagctgccgggagaggaaccagggcgccaactatgcctgtgaatgtcctcccaacttcaccggcagcaactgtgagaagaaggtggaccgctgcaccagcaacccctgtgccaatggaggccagtgcctgaacagaggccccagcaggatgtgccgctgccggcccggcttcaccggcacctactgtgagctgcacgtgtctgactgtgccaggaacccctgtgcccatggaggcacctgccacgacctggagaatggcctgatgtgcacctgcccagctggcttctctggaagaagatgtgaggtgaggaccagcattgatgcctgtgccagcagcccctgcttcaacagagccacctgctacacagacctgagcacagacacctttgtgtgcaactgcccctacggctttgtgggcagccgctgtgagttccctgtgggcctgccccccagcttcccctgggtggccgtgtccctgggcgtgggcctggccgtgctgctggtgctgctgggcatggtggccgtggccgtgcggcagctgcggctgcggcggccagatgatggcagccgggaggccatgaacaacctgagtgacttccagaaggacaacctgatcccagctgcccagctgaagaacaccaaccagaagaaggagctggaggtggactgtggcctggacaagagcaactgtgggaagcagcagaaccacaccctggactacaacctggcccctggccccctgggccggggcaccatgcctgggaagttcccccacagcgacaagagcctgggggagaaggcccccctgcggctgcacagcgagaagccagagtgccgcatcagcgccatctgcagcccccgggacagcatgtaccagagcgtgtgcctgatcagcgaggagagaaatgaatgtgtgattgccacagaggtgtag

SEQ ID NO: 149760 - DNA, 2223 bp, Artificial Sequence
  Description of Artificial Sequence: Synthetic coding sequence
atggccagccacctgcggccccccagccccctgctggtgcgggtgtacaagagcggcccccgggtgcggaggaagctggagagctacttccagagcagcaagagcagcggcggcggggagtgcaccgtgtccacccaggagcacgaggcccctggcaccttccgggtggagttcagcgagcgggccgccaaggagcgggtgctgaagaagggggagcaccagatcctggtggatgagaagcctgtgcccatcttcctggtgcccacagagaacagcatcaagaagaacacccggccccagatcagcagcctgacccagagccaggccgagaccccatctggggacatgcaccagcacgagggccacatccccaatgctgtggacagctgcctgcagaagatcttcctgactgtgacagctgacctgaactgcaacctcttcagcaaggagcagagggcctacatcaccaccctgtgccccagcatcaggaagatggagggccatgatggcatcgagaaggtgtgtggggacttccaggacatcgagcgcatccaccagttcctgtctgagcagttcctggagagcgagcagaagcagcagttcagccccagcatgacagagaggaagcccctgagccagcaggagcgggacagctgcatcagccccagcgagcctgagaccaaggccgagcagaagagcaactactttgaggtgcccctgccctactttgagtacttcaagtacatctgcccagacaagatcaacagcattgagaagagatttggagtgaacatcgagatccaggagagcagccccaacatggtgtgcctggacttcaccagcagccgcagcggggacctggaggccgcccgggagagctttgccagcgagttccagaagaacacagagcccctgaagcaggagtgtgtgtccctggccgacagcaagcaggccaacaagttcaagcaggagctgaaccaccagttcaccaagctgctgatcaaggagaagggcggggagctgaccctgctgggcacccaggatgacatctctgctgccaagcagaagatcagcgaggcctttgtgaagatccctgtgaagctgtttgctgccaactacatgatgaatgtcatcgaggtggacagcgcccactacaagctgctggagacagagctgctgcaggagatcagcgagattgagaagagatatgacatctgcagcaaggtgtctgagaagggccagaagacctgcatcctgtttgagagcaaggaccggcaggtggacctgtctgtgcacgcctatgccagcttcattgatgccttccagcacgccagctgccagctgatgagggaggtgctgctgctgaagagcctgggcaaggagaggaagcacctgcaccagaccaagtttgctgatgacttcaggaagaggcaccccaacgtgcactttgtgctgaaccaggagagcatgaccctgaccggcctgcccaaccacctggccaaggccaagcagtatgtgctgaagggcggcggcatgagcagcctggccggcaagaagctgaaggagggccacgagacccccatggacatcgacagtgatgacagcaaggccgccagcccccccctgaagggctctgtgagcagcgaggccagcgagctggacaagaaggagaagggcatctgtgtgatctgcatggacaccatcagcaacaagaaggtgctgcccaagtgcaagcatgagttctgtgccccctgcatcaacaaggccatgagctacaagcccatctgccccacctgccagaccagctatggcatccagaagggcaaccagcctgagggctccatggtgttcaccgtgtcccgggacagcctgcccggctatgagagctttggcaccatcgtcatcacctacagcatgaaggccggcatccagacagaggagcaccccaaccctgggaagcgctacccaggcatccagaggacagcctacctgcctgacaacaaggagggcaggaaggtgctgaagctgctgtaccgggcctttgaccagaagctgatcttcaccgtgggctacagccgggtgctgggcgtgtctgatgtgatcacctggaatgacatccaccacaagaccagcagatttggaggccctgagatgtatggctacccagaccccagctacctgaagagggtgaaggaggagctgaaggccaagggcattgaatag

SEQ ID NO: 149761 - DNA, 1863 bp, Artificial Sequence
  Description of Artificial Sequence: Synthetic coding sequence
atgagccggcccggccacggcggcctgatgcctgtgaatggcctgggcttccccccccagaatgtggcccgggtggtggtgtgggagtggctgaatgagcacagccgctggaggccctacacagccaccgtgtgccaccacattgaaaatgtgctgaaggaggatgcccggggctctgtggtgctgggccaggtggatgcccagctggtgccctacatcatcgacctgcagagcatgcaccagttccggcaggacaccggcaccatgaggcctgtgagaagaaacttctatgaccccagcagcgcccctggaaaaggaattgtgtgggagtgggagaatgatggaggagcctggacagcctatgacatggacatctgcatcaccatccagaatgcctatgagaagcagcacccctggctggacctgagcagcctgggcttctgctacctgatctacttcaacagcatgagccagatgaaccggcagaccaggagaagaagaaggctgcggcggcggctggacctggcctaccccctgactgtgggcagcatccccaagagccagagctggcctgtgggcgccagcagcggccagccctgcagctgccagcagtgcctgctggtgaacagcaccagggctgccagcaatgccatcctggccagccagaggaggaaggcccccccagccccacccctgcccccacctcctcctcctgggggccccccaggggccctggccgtgcggcccagcgccaccttcaccggggccgccctgtgggccgccccagctgctggccctgctgagcccgcccctcctcctggggccccacccaggagccctggggcccctggaggagcccggaccccaggccagaacaacctgaacagacctggcccccagaggaccacctctgtgtctgcccgggccagcatccccccaggagtgcctgccctgcctgtgaagaacctgaatggcaccggccctgtgcacccagccctggccggcatgacaggcatcctgctgtgtgccgccggcctgcctgtgtgcctgacccgggcccccaagcccatcctgcaccccccacctgtgtccaagagtgatgtgaagcctgtgcctggggtgcctggggtgtgcaggaagaccaagaagaagcacctgaagaagagcaagaacccagaagatgtggtgcggcgctacatgcagaaggtgaagaaccccccagatgaggactgcaccatctgcatggagcggctggtgacagccagcggctatgagggcgtgctgcggcacaagggcgtgcggcctgagctggtgggccgcctgggccgctgtggccacatgtaccacctgctgtgcctggtggccatgtacagcaatggaaacaaggatggcagcctgcagtgccccacctgcaaggccatctatggagagaagacaggcacccagcccccaggcaagatggagttccacctgatcccccacagcctgcccggcttcccagacacccagaccatcagaattgtgtatgacatccccaccggcatccagggccctgagcaccccaaccctgggaagaagttcaccgcccggggcttccccaggcactgctacctgcccaacaatgaaaaaggaaggaaggtgctgcggctgctgatcacagcctgggagaggaggctcatcttcaccatcggcaccagcaacaccactggagagagtgacacagtggtgtggaatgagatccaccacaagacagaatttggcagcaacctgactggacatggctacccagatgccagctacctggacaacgtgctggccgagctgacagcccagggcgtgtctgaggccgccgccaaggcctag

SEQ ID NO: 149762 - DNA, 1044 bp, Artificial Sequence
  Description of Artificial Sequence: Synthetic coding sequence
atgagctttgtgctgagcaggatggccgcctgtggcggcacctgcaagaacaaggtgacagtgtccaagcctgtgtgggacttcctgagcaaggagaccccagcccggctggcccggctgcgggaggagcaccgggtgtccatcctgattgatggagagaccagtgacatctacgtgctgcagctgagcccccagggccccccaccagcccccccaaatggcctgtacctggccaggaaggccctgaagggcctgctgaaggaggccgagaaggagctgaagaaggcccagaggcagggcgagctgatgggctgcctggccctgggcggcggcggggagcaccctgagatgcaccgggccggccccccacccctgcgggccgcccccctgctgcccccaggggcccggggcctgcccccacctcctccacccctgcccccacccctgcccccccggctgcgggaggaggccgaggagcaggagagcacctgccccatctgcctgggggagatccagaatgccaagaccctggagaagtgccgccacagcttctgtgagggctgcatcacccgggccctgcaggtgaagaaggcctgccccatgtgtggccgcttctacggccagctggtgggcaaccagccccagaatggccgcatgctggtgtccaaggatgccaccctgctgctgcccagctatgagaagtatggcaccatcgtcatccagtatgtgtttcctcctggggtgcagggcgctgagcaccccaaccctggggtgcgctacccaggcaccaccagggtggcctacctgcctgactgcccagagggcaacaaggtgctgaccctcttcaggaaggcctttgaccagaggctgaccttcaccatcggcacctccatgaccaccggccggcccaacgtcatcacctggaatgacatccaccacaagaccagctgcaccggcggcccccagctgtttggctacccagaccccacctacctgaccagggtgcaggaggagctgcgggccaagggcatcacagatgactag

SEQ ID NO: 149763 - DNA, 1044 bp, Artificial Sequence; identical to SEQ ID NO: 149762
  Description of Artificial Sequence: Synthetic coding sequence

SEQ ID NO: 149764 - DNA, 1044 bp, Artificial Sequence; identical to SEQ ID NO: 149762
  Description of Artificial Sequence: Synthetic coding sequence

SEQ ID NO: 149765 - DNA, 615 bp, Artificial Sequence
  Description of Artificial Sequence: Synthetic coding sequence
atgcccatcctgagcagcagcggcagcaagatggccgcctgtggcggcacctgcaagaacaaggtgacagtgtccaagcctgtgtgggacttcctgagcaaggagaccccagcccggctggcccggctgcgggaggagcaccgggtgtccatcctgattgatggagagaccagtgacatctacgtgctgcagctgagcccccagggccccccaccagccccacccaacggcctgtacctggccaggaaggccctgaagggcctgctgaaggaggccgagaaggagctgaagaaggcccagaggcagggcgagctgatgggctgcctggccctgggcggcggcggggagcaccctgagatgcacagagctggccccccacccctgcgggccgcccccctgctgcccccaggggcccggggcctgcccccacctcctccacccctgcccccacccctgcccccccggctgcgggaggaggccgaggagcaggagagcacctgccccatctgcctgggggagatccagaatgccaagaccctggagaagtgccgccacagcttctgtgagggctgcatcacccgggccctgcaggtgaagaaggcctgccccatgtag

SEQ ID NO: 149766 - DNA, 24 bp, Artificial Sequence
  Description of Artificial Sequence: Synthetic coding sequence
atgcccatcctgagcagcagctag

SEQ ID NO: 149767 - DNA, 1053 bp, Artificial Sequence
  Description of Artificial Sequence: Synthetic coding sequence
atgcccatcctgagcagcagcggcagcaagatggccgcctgtggcggcacctgcaagaacaaggtgacagtgtccaagcctgtgtgggacttcctgagcaaggagaccccagcccggctggcccggctgcgggaggagcaccgggtgtccatcctgattgatggagagaccagtgacatctacgtgctgcagctgagcccccagggccccccaccagccccacccaacggcctgtacctggccaggaaggccctgaagggcctgctgaaggaggccgagaaggagctgaagaaggcccagaggcagggcgagctgatgggctgcctggccctgggcggcggcggggagcaccctgagatgcacagagctggccccccacccctgcgggccgcccccctgctgcccccaggggcccggggcctgcccccacctcctccacccctgcccccacccctgcccccccggctgcgggaggaggccgaggagcaggagagcacctgccccatctgcctgggggagatccagaatgccaagaccctggagaagtgccgccacagcttctgtgagggctgcatcacccgggccctgcaggtgaagaaggcctgccccatgtgtggccgcttctacggccagctggtgggcaaccagccccagaatggaaggatgctggtgtccaaggatgccaccctgctgctgcccagctatgagaagtatggcaccatcgtcatccagtatgtgttccccccaggagtgcagggcgctgagcaccccaaccctggggtgcgctacccaggcaccaccagggtggcctacctgcctgactgcccagagggcaacaaggtgctgaccctcttcaggaaggcctttgaccagaggctgaccttcaccatcggcacctccatgaccaccggccggcccaacgtcatcacctggaatgacatccaccacaagaccagctgcacaggaggcccccagctgtttggctacccagaccccacctacctgaccagggtgcaggaggagctgcgggccaagggcatcacagatgactag

SEQ ID NO: 149768 - DNA, 150 bp, Artificial Sequence
  Description of Artificial Sequence: Synthetic coding sequence
atgagctttgtgctgagcaggatggccgcctgtggcggcacctgcaagaacaaggtgacagtgtccaagcctgtgtgggacttcctgagcaaggagaccccagcccggctggcccggctgcgggaggagcaccgggtgtccatcctgtag

SEQ ID NO: 149769 - DNA, 2136 bp, Artificial Sequence
  Description of Artificial Sequence: Synthetic coding sequence
atgctggatggccccctcttcagcgagggccctgacagcccccgggagctgcaggatgaggagagcggcagctgcctgtgggtgcagaagagcaagctgctggtgattgaggtgaagaccatcagctgccactacagcagaagagcccccagccggcagcccatggacttccaggccagccactgggcccggggcttccagaacagaacctgtggccccaggcctggcagcccccagcccccaccaagaagaccctgggccagccgggtgctgcaggaggccaccaactggagggctggccccctggccgaggtgcgggcccgggagcaggagaagaggaaggccgccagccaggagcgggaggccaaggagacagagaggaagaggaggaaggccggcggggcccggcgcagccccccaggccggcccaggcctgagcccagaaatgccccccgggtggcccagctggccggcctgcctgcccccctgcggcctgagcggctggcccctgtgggccgggccccccggcccagcgcccagccccagagcgaccccggcagcgcctgggccggcccctggggcggccggcggcccggcccccccagctatgaggcccacctgctgctgcggggcagcgctggaacagccccccggcggcgctgggaccggcccccaccctacgtggccccacccagctatgagggcccccacaggaccctgggcaccaagaggggccctggcaacagccaggtgcccaccagcagcgccccagctgccaccccagccaggacagatggcggccgcaccaagaagaggctggacccccgcatctacagagatgtgctgggcgcctggggcctgcggcagggccagggcctgctgggcggcagccctggctgtggggccgcccgggcccggcctgagcctggaaaaggagtggtggagaagagcctgggcctggccgctgctgacctgaacagcggcagtgacagccacccccaggccaaggccaccggcagcgctggaacagaaattgccccagctggcagcgccacagctgccccctgtgccccccacccagcccccaggagccgccaccacctgaagggcagccgggagggcaaggagggggagcagatctggttccccaagtgctggatccccagccccaagaagcagccccccaggcacagccagaccctgccccggccctgggcccctgggggcaccggctggagggagagcctgggcctgggggagggcgccggccctgagaccctggagggctggaaggccacccggcgggcccacaccctgcccaggagcagccagggcctgagcagaggagaaggagtgtttgtgattgatgccacctgtgtggtgatccgcagccagtatgtgcccacccccaggacccagcaggtgcagctgctgcccagcggcgtgaccagggtggtgggggacagccccagccagagcaagccaggcaaggaggagggggagggcgccaccgtcttccccagcccctgccagaagaggctgagcagcagccggctgctgcaccagcccggcggcggccggggcggggaggccgagggcggccggcctggggacagcaccctggaggagaggaccttccgcatcctgggcctgcctgcccctgaggtgaacctgagagatgcccccacccagcccggcagccctgagcaccaggccctgggccctgctgccagcggggcccagggccgggcagagggcagcgaggtggccgtggtgcagaggcgggccggccggggctgggcccggaccccaggcccctatgctggggccctgcgggaggccgtgagccgcatcagaagacacacagccccagacagcgacacagatgaagctgaggagctgtctgtgcacagcggcagcagtgatggcagtgacacagaggcccctggggcctcctggagaaatgaaagaaccctgcctgaggtgggcaacagcagcccagaagaagatggcaagacagctgagctgagtgacagcgtgggggagatcctggatgtgatcagccagacagaggaggtgctgtttggagtgcgggacatccggggcacccagcagggcaacaggaagaggcagtag

SEQ ID NO: 149770 - DNA, 852 bp, Artificial Sequence
  Description of Artificial Sequence: Synthetic coding sequence
atgggcatctggaccagcggcacagacatcttcctgagcctgtgggagatctacgtgagccccaggagccctggctggatggacttcatccagcacctgggcgtgtgctgcctggtggccctgatctctgtgggcctgctgtctgtggccgcctgctggttcctgcccagcatcatcgctgctgctgcctcctggatcatcacctgtgtgctgctgtgctgcagcaagcacgcccgctgcttcatcctgctggtgttcctgagctgtggcctgcgggagggcagaaatgccctgattgctgctggcactggaattgtcatcctgggccacgtggagaacatcttccacaacttcaagggcctgctggatggcatgacctgcaacctgcgggccaagagcttcagcatccacttccccctgctgaagaagtacatcgaggccatccagtggatctacggcctggccacccccctgtctgtgtttgatgacctggtgtcctggaaccagaccctggccgtgtccctcttcagccccagccacgtgctggaggcccagctgaatgacagcaagggggaggtgctgtctgtgctgtaccagatggccaccaccacagaggtgctgagcagcctgggccagaagctgctggcctttgctggcctgagcctggtgctgctgggcaccggcctcttcatgaagcgcttcctgggcccctgtggctggaagtatgagaacatctacatcacccggcagtttgtgcagtttgatgagcgggagcggcaccagcagaggccctgtgtgctgcccctgaacaaggaggagaggaggaagttcatcagcggcttccagagctag

SEQ ID NO: 149771 - DNA, 1401 bp, Artificial Sequence
  Description of Artificial Sequence: Synthetic coding sequence
atgctgaagtggcccatccctggccaggtggccctcttccagatcctgcgctgccggggcaacagcaggaggaccaccgtgaccagcctgactgtgtcccaggtgggccagaacttcacctttgtgctgacagacatcgacagcaagcagcgcttcggcttctgccgcctgagcagcggggccaagagctgcttctgcatcctgagctacctgccctggtttgaggtgttctacaagctgctgaacatcctggccgactacaccaccaagaggcaggagaaccagtggaatgagctgctggagaccctgcacaagctgcccatcccagaccccggggtgtctgtgcacctgtctgtgcacagctacttcaccgtgcctgacacccgggagctgcccagcatccctgagaacagaaacctgacagagtactttgtggccgtggatgtgaacaacatgctgcacctgtatgcctccatgctgtatgaaagacgcatcctgatcatctgcagcaagctgagcaccctgacagcctgcatccacggcagcgctgccatgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtgatcagcagcctgaagaaccggctgaagaaggtgtccaccaccactggagatggagtggcccgggccttcctgaaggcccaggccgccttcttcggcagctacagaaatgccctgaagattgagcctgaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggccctgtag

SEQ ID NO: 149772 - DNA, 1680 bp, Artificial Sequence
  Description of Artificial Sequence: Synthetic coding sequence
atgggcagccgcatcaagcagaaccctgagaccacctttgaggtgtatgtggaggtggcctaccccaggactggaggcaccctgagtgaccctgaggtgcagaggcagtttcctgaggactacagcgaccaggaggtgctgcagaccctgaccaagttctgcttccccttctacgtggacagcctgactgtgtcccaggtgggccagaacttcacctttgtgctgacagacatcgacagcaagcagcgcttcggcttctgccgcctgagcagcggggccaagagctgcttctgcatcctgagctacctgccctggtttgaggtgttctacaagctgctgaacatcctggccgactacaccaccaagaggcaggagaaccagtggaatgagctgctggagaccctgcacaagctgcccatcccagaccccggggtgtctgtgcacctgtctgtgcacagctacttcaccgtgcctgacacccgggagctgcccagcatccctgagaacagaaacctgacagagtactttgtggccgtggatgtgaacaacatgctgcacctgtatgcctccatgctgtatgaaagacgcatcctgatcatctgcagcaagctgagcaccctgacagcctgcatccacggcagcgctgccatgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtgatcagcagcctgaagaaccggctgaagaaggtgtccaccaccactggagatggagtggcccgggccttcctgaaggcccaggccgccttcttcggcagctacagaaatgccctgaagattgagcctgaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggtgcggcccccccggccccacgtggtgaagaggcccaagagcaacattgctgtggagggccgccgcacctctgtgcccagccctgagcagaacaccatcgccaccccagccaccctgcacatcctgcagaagagcatcacccactttgctgccaagttccccacccggggctggaccagcagcagccactag

SEQ ID NO: 149773 - DNA, 3030 bp, Artificial Sequence
  Description of Artificial Sequence: Synthetic coding sequence
atgggcagccgcatcaagcagaaccctgagaccacctttgaggtgtatgtggaggtggcctaccccaggactggaggcaccctgagtgaccctgaggtgcagaggcagtttcctgaggactacagcgaccaggaggtgctgcagaccctgaccaagttctgcttccccttctacgtggacagcctgactgtgtcccaggtgggccagaacttcacctttgtgctgacagacatcgacagcaagcagcgcttcggcttctgccgcctgagcagcggggccaagagctgcttctgcatcctgagctacctgccctggtttgaggtgttctacaagctgctgaacatcctggccgactacaccaccaagaggcaggagaaccagtggaatgagctgctggagaccctgcacaagctgcccatcccagaccccggggtgtctgtgcacctgtctgtgcacagctacttcaccgtgcctgacacccgggagctgcccagcatccctgagaacagaaacctgacagagtactttgtggccgtggatgtgaacaacatgctgcacctgtatgcctccatgctgtatgaaagacgcatcctgatcatctgcagcaagctgagcaccctgacagcctgcatccacggcagcgctgccatgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtgatcagcagcctgaagaaccggctgaagaaggtgtccaccaccactggagatggagtggcccgggccttcctgaaggcccaggccgccttcttcggcagctacagaaatgccctgaagattgagcctgaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggtgcggcccccccggccccacgtggtgaagaggcccaagagcaacattgctgtggagggccgccgcacctctgtgcccagccctgagcagccccagccctaccgcaccctgcgggagagtgacagcgcagaaggagatgaggccgagagccctgagcagcaggtgaggaagagcactggacctgtgcctgcccccccagacagagctgccagcattgacctgctggaggatgtgttcagcaacctggacatggaggccgccctgcagcccctgggccaggccaagagcctggaggacctgcgggcccccaaggacctgcgggagcagcccggcacctttgactaccagaggctggacctgggcggcagcgagaggagccggggcgtgacagtggccctgaagctgacccacccctacaacaagctgtggagcctgggccaggatgacatggccatccccagcaagcccccagctgccagccctgagaagcccagcgccctgctgggcaacagcctggccctgccccggcggccccagaacagagacagcatcctgaaccccagcgacaaggaggaggtgcccacccccaccctgggcagcatcaccatcccccggccccagggcaggaagaccccagagctgggcatcgtgcccccaccacccatccccaggcctgccaagctgcaggccgccggggccgccctgggagatgtgtctgagcggctgcagacagaccgggaccggcgggccgccctgagccctggcctgctgcccggggtggtgccccagggccccacagagctgctgcagcccctgagccctggccctggagctgctggcaccagcagtgatgccctgctggccctgctggaccccctgagcacagcctggagcggcagcaccctgcccagcaggcctgccacccccaacgtggccacccccttcaccccccagttctccttccccccagctggcacccccacccccttcccccagccccccctgaacccctttgtgcccagcatgcctgctgccccacccaccctgcccctggtgtccaccccagctggcccctttggagcccccccagccagcctgggccctgcctttgccagcggcctgctgctgagcagcgctggcttctgtgccccccacaggagccagcccaacctgagcgccctgtccatgcccaacctgtttggccagatgcccatgggcacccacaccagccccctgcagcccctgggccccccagctgtggcccccagccgcatccgcaccctgcccctggcccggagcagcgcccgggctgctgagaccaagcagggcctggccctgcggcctggggacccccccctgctgcccccccggcccccccagggcctggagcccaccctgcagcccagcgccccccagcaggcccgggacccctttgaggacctgctgcagaagaccaagcaggatgtgagccccagccctgccctggccccagccccagattctgtggagcagctgaggaagcagtgggagacctttgaatag

SEQ ID NO: 149774 - DNA, 1590 bp, Artificial Sequence
  Description of Artificial Sequence: Synthetic coding sequence
atgctgaagtggcccatccctggccaggtggccctcttccaggaggtgctgcagaccctgaccaagttctgcttccccttctacgtggacagcctgactgtgtcccaggtgggccagaacttcacctttgtgctgacagacatcgacagcaagcagcgcttcggcttctgccgcctgagcagcggggccaagagctgcttctgcatcctgagctacctgccctggtttgaggtgttctacaagctgctgaacatcctggccgactacaccaccaagaggcaggagaaccagtggaatgagctgctggagaccctgcacaagctgcccatcccagaccccggggtgtctgtgcacctgtctgtgcacagctacttcaccgtgcctgacacccgggagctgcccagcatccctgagaacagaaacctgacagagtactttgtggccgtggatgtgaacaacatgctgcacctgtatgcctccatgctgtatgaaagacgcatcctgatcatctgcagcaagctgagcaccctgacagcctgcatccacggcagcgctgccatgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtgatcagcagcctgaagaaccggctgaagaaggtgtccaccaccactggagatggagtggcccgggccttcctgaaggcccaggccgccttcttcggcagctacagaaatgccctgaagattgagcctgaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggtgcggcccccccggccccacgtggtgaagaggcccaagagcaacattgctgtggagggccgccgcacctctgtgcccagccctgagcagaacaccatcgccaccccagccaccctgcacatcctgcagaagagcatcacccactttgctgccaagttccccacccggggctggaccagcagcagccactag

SEQ ID NO: 149775 - DNA, 3063 bp, Artificial Sequence
  Description of Artificial Sequence: Synthetic coding sequence
atgaggaggcctggggaccacggcctgcaggaccaggaggtgctgcagaccctgaccaagttctgcttccccttctacgtggacagcctgactgtgtcccaggtgggccagaacttcacctttgtgctgacagacatcgacagcaagcagcgcttcggcttctgccgcctgagcagcggggccaagagctgcttctgcatcctgagctacctgccctggtttgaggtgttctacaagctgctgaacatcctggccgactacaccaccaagaggcaggagaaccagtggaatgagctgctggagaccctgcacaagctgcccatcccagaccccggggtgtctgtgcacctgtctgtgcacagctacttcaccgtgcctgacacccgggagctgcccagcatccctgagaacagaaacctgacagagtactttgtggccgtggatgtgaacaacatgctgcacctgtatgcctccatgctgtatgaaagacgcatcctgatcatctgcagcaagctgagcaccctgacagcctgcatccacggcagcgctgccatgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtgatcagcagcctgaagaaccggctgaagaaggtgtccaccaccactggagatggagtggcccgggccttcctgaaggcccaggccgccttcttcggcagctacagaaatgccctgaagattgagcctgaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggtgcggcccccccggccccacgtggtgaagaggcccaagagcaacattgctgtggagggccgccgcacctctgtgcccagccctgagcacctggtgaagcccctgcggcactatgctgtgttcctgtctgaggacagcagtgatgatgagtgccagcgggaggagggccccagcagcggcttcacagagagcttcttcttcagcgccccctttgagtggccccagccctaccgcaccctgcgggagagtgacagcgcagaaggagatgaagctgagagccctgagcagcaggtgaggaagagcacaggccctgtgcctgcccccccagaccgggccgccagcattgacctgctggaggatgtgttcagcaacctggacatggaggccgccctgcagcccctgggccaggccaagagcctggaggacctgcgggcccccaaggacctgcgggagcagcccggcacctttgactaccagaggctggacctgggcggcagcgagaggagcagaggagtgacagtggccctgaagctgacccacccctacaacaagctgtggagcctgggccaggatgacatggccatccccagcaagcccccagctgccagccctgagaagcccagcgccctgctgggcaacagcctggccctgccccggcggccccagaacagagacagcatcctgaaccccagcgacaaggaggaggtgcccacccccaccctgggcagcatcaccatcccccggccccagggcaggaagaccccagagctgggcatcgtgcccccaccacccatccccaggcctgccaagctgcaggccgccggggccgccctgggagatgtgtctgagcggctgcagacagaccgggacagaagagctgccctgagccctggcctgctgcccggggtggtgccccagggccccacagagctgctgcagcccctgagccctggccctggagctgctggcaccagcagtgatgccctgctggccctgctggaccccctgagcacagcctggagcggcagcaccctgcccagcaggcctgccaccccaaatgtggccacccccttcaccccccagttctccttccccccagctggcacccccacccccttcccccagccccccctgaacccctttgtgcccagcatgcctgctgccccacccaccctgcccctggtgtccaccccagctggcccctttggagcccccccagccagcctgggccctgcctttgccagcggcctgctgctgagcagcgctggcttctgtgccccccacaggagccagcccaacctgagcgccctgtccatgcccaacctgtttggccagatgcccatgggcacccacaccagccccctgcagcccctgggccccccagctgtggcccccagccgcatccgcaccctgcccctggcccggagcagcgcccgggctgctgagaccaagcagggcctggccctgcggcctggggacccccccctgctgccccccaggcctccccagggcctggagcccaccctgcagcccagcgccccccagcaggcccgggacccctttgaggacctgctgcagaagaccaagcaggatgtgagccccagccctgccctggccccagccccagacagcgtggagcagctgaggaagcagtgggagacctttgaatag

SEQ ID NO: 149776 - DNA, 2385 bp, Artificial Sequence
  Description of Artificial Sequence: Synthetic coding sequence
atgctgtaccccatgtactggcagcacgtgtacatccctgtgctgcccccccacctgctggactactgctgtgcccccatgccctacctgattggcatccacctgagcctgatggagaaggtgaggaacatggccctggatgatgtggtgatcctgaatgtggacaccaacaccctggagaccccatttgatgacctgcagagcctgcccaatgatgtggaggagcccatcaccttctgtgaggaggcctttgtgagccactaccgcagcggggccatgaggcagttcctgcagaatgccacccagctgcagctgttcaagcagttcattgatggccgcctggacctgctgaacagcggggagggcttcagtgatgtgtttgaggaggagatcaacatgggagaatatgccggcagtgacaagctgtaccaccagtggctgagcacagtgaggaagggcagcggggccatcctgaacacagtgaagaccaaggccaacccagccatgaagacagtgtacaagtttgccaaggaccacgccaagatgggcatcaaggaggtgaagaaccggctgaagcagaaggacattgctgaaaatggctgtgcccccaccccagaggagcagctgcccaagacagcccccagccccctggtggaggccaaggaccccaagctgagagaagatagaagacccatcaccgtgcacttcggccaggtgcggcccccccggccccacgtggtgaagaggcccaagagcaacattgctgtggagggccgccgcacctctgtgcccagccctgagcacctggtgaagcccctgcggcactatgctgtgttcctgtctgaggacagcagtgatgatgagtgccagcgggaggagggccccagcagcggcttcacagagagcttcttcttcagcgccccctttgagtggccccagccctaccgcaccctgcgggagagtgacagcgcagaaggagatgaagctgagagccctgagcagcaggtgaggaagagcacaggccctgtgcctgcccccccagaccgggccgccagcattgacctgctggaggatgtgttcagcaacctggacatggaggccgccctgcagcccctgggccaggccaagagcctggaggacctgcgggcccccaaggacctgcgggagcagcccggcacctttgactaccagaggctggacctgggcggcagcgagaggagcagaggagtgacagtggccctgaagctgacccacccctacaacaagctgtggagcctgggccaggatgacatggccatccccagcaagcccccagctgccagccctgagaagcccagcgccctgctgggcaacagcctggccctgccccggcggccccagaacagagacagcatcctgaaccccagcgacaaggaggaggtgcccacccccaccctgggcagcatcaccatcccccggccccagggcaggaagaccccagagctgggcatcgtgcccccaccacccatccccaggcctgccaagctgcaggccgccggggccgccctgggagatgtgtctgagcggctgcagacagaccgggacagaagagctgccctgagccctggcctgctgcccggggtggtgccccagggccccacagagctgctgcagcccctgagccctggccctggagctgctggcaccagcagtgatgccctgctggccctgctggaccccctgagcacagcctggagcggcagcaccctgcccagcaggcctgccaccccaaatgtggccacccccttcaccccccagttctccttccccccagctggcacccccacccccttcccccagccccccctgaacccctttgtgcccagcatgcctgctgccccacccaccctgcccctggtgtccaccccagctggcccctttggagcccccccagccagcctgggccctgcctttgccagcggcctgctgctgagcagcgctggcttctgtgccccccacaggagccagcccaacctgagcgccctgtccatgcccaacctgtttggccagatgcccatgggcacccacaccagccccctgcagcccctgggccccccagctgtggcccccagccgcatccgcaccctgcccctggcccggagcagcgcccgggctgctgagaccaagcagggcctggccctgcggcctggggacccccccctgctgccccccaggcctccccagggcctggagcccaccctgcagcccagcgccccccagcaggcccgggacccctttgaggacctgctgcagaagaccaagcaggatgtgagccccagccctgccctggccccagccccagacagcgtggagcagctgaggaagcagtgggagacctttgaatag

SEQ ID NO: 149777 - DNA, 1191 bp, Artificial Sequence
  Description of Artificial Sequence: Synthetic coding sequence
atggctgctgccccccgggaggagaagcgctggccccagcccgtcttcagcaaccctgtggtgctgtggaagttcccagaagattttggagaccaggagatcctgcagagcgtgcccaagttctgcttcccctttgatgtggagcgggtgtcccagaaccaggtgggccagcacttcacctttgtgctgacagacatcgagagcaagcagcgcttcggcttctgccgcctgaccagcggcggcaccatctgcctgtgcatcctgagctacctgccctggtttgaggtgtactacaagctgctgaacaccctggccgactacctggccaaggagctggagaatgacctgaatgagaccctgcggagcctgtacaaccaccctgtgcccaaggccaacacccctgtgaacctgtctgtgcacagctacttcatcgccccagatgtgacaggcctgcccaccatccctgagagcaggaacctgacagagtactttgtggccgtggatgtgaacaacatgctgcagctgtatgcctccatgctgcatgaaagaagaattgtcatcatcagcagcaagctgagcaccctgacagcctgcatccacggcagcgctgccctgctgtaccccatgtactggcagcacatctacatccctgtgctgcccccccacctgctggactactgctgtgcccccatgccctacctgattggcatccacagcagcctcatcgagcgggtgaagaacaagagcctggaggatgtggtgatgctgaatgtggacaccaacaccctggagagccccttcagtgacctgaacaacctgcccagtgatgtggtgtctgccctgaagaacaagctgaagaagcagagcacagccactggagatggagtggcccgggccttcctgcgggcccaggccgccctgtttggcagctacagagatgccctgcgctacaagccaggagagcccatcaccttctgtgaggagagctttgtgaagcacaggagctctgtgatgaagcagttcctggagacagccatcaacctgcagctgttcaagcagttcattgatggccgcctggccaagctgaatgccggccggggcttcagtgatgtgtttgaggaggagatcaccagcggcggcttctgtggcggcaaggacaagctgcagtatgactaccccttcagccagtag

SEQ ID NO: 149778 - DNA, 1281 bp, Artificial Sequence
  Description of Artificial Sequence: Synthetic coding sequence
atggactgcaggaccaaggccaacccagacaggacctttgacctggtgctgaaggtgaagtgccacgcctctgaaaatgaagatcctgtggtgctgtggaagttcccagaagattttggagaccaggagatcctgcagagcgtgcccaagttctgcttcccctttgatgtggagcgggtgtcccagaaccaggtgggccagcacttcacctttgtgctgacagacatcgagagcaagcagcgcttcggcttctgccgcctgaccagcggcggcaccatctgcctgtgcatcctgagctacctgccctggtttgaggtgtactacaagctgctgaacaccctggccgactacctggccaaggagctggagaatgacctgaatgagaccctgcggagcctgtacaaccaccctgtgcccaaggccaacacccctgtgaacctgtctgtgaaccaggagatcttcatcgcctgtgagcaggtgctgaaggaccagcctgccctggtgccccacagctacttcatcgccccagatgtgacaggcctgcccaccatccctgagagcaggaacctgacagagtactttgtggccgtggatgtgaacaacatgctgcagctgtatgcctccatgctgcatgaaagaagaattgtcatcatcagcagcaagctgagcaccctgacagcctgcatccacggcagcgctgccctgctgtaccccatgtactggcagcacatctacatccctgtgctgcccccccacctgctggactactgctgtgcccccatgccctacctgattggcatccacagcagcctcatcgagcgggtgaagaacaagagcctggaggatgtggtgatgctgaatgtggacaccaacaccctggagagccccttcagtgacctgaacaacctgcccagtgatgtggtgtctgccctgaagaacaagctgaagaagcagagcacagccactggagatggagtggcccgggccttcctgcgggcccaggccgccctgtttggcagctacagagatgccctgcgctacaagccaggagagcccatcaccttctgtgaggagagctttgtgaagcacaggagctctgtgatgaagcagttcctggagacagccatcaacctgcagctgttcaagcagttcattgatggccgcctggccaagctgaatgccggccggggcttcagtgatgtgtttgaggaggagatcaccagcggcggcttctgtggcggcaaggacaagctgcagtatgactaccccttcagccagtag

SEQ ID NO: 149779 - DNA, 1191 bp, Artificial Sequence; identical to SEQ ID NO: 149777
  Description of Artificial Sequence: Synthetic coding sequence

SEQ ID NO: 149780 - DNA, 2268 bp, Artificial Sequence
  Description of Artificial Sequence: Synthetic coding sequence
attgagaccaagacccgggccaacccagacaggacctttgacctggtgctgaaggtgaagtgccacgcctctgaaaatgaagatcctgtggtgctgtggaagttcccagaagattttggagaccaggagatcctgcagagcgtgcccaagttctgcttcccctttgatgtggagcgggtgtcccagaaccaggtgggccagcacttcacctttgtgctgacagacatcgagagcaagcagcgcttcggcttctgccgcctgaccagcggcggcaccatctgcctgtgcatcctgagctacctgccctggtttgaggtgtactacaagctgctgaacaccctggccgactacctggccaaggagctggagaatgacctgaatgagaccctgcggagcctgtacaaccaccctgtgcccaaggccaacacccctgtgaacctgtctgtgcacagctacttcatcgccccagatgtgacaggcctgcccaccatccctgagagcaggaacctgacagagtactttgtggccgtggatgtgaacaacatgctgcagctgtatgcctccatgctgcatgaaagaagaattgtcatcatcagcagcaagctgagcaccctgacagcctgcatccacggcagcgctgccctgctgtaccccatgtactggcagcacatctacatccctgtgctgcccccccacctgctggactactgctgtgcccccatgccctacctgattggcatccacagcagcctcatcgagcgggtgaagaacaagagcctggaggatgtggtgatgctgaatgtggacaccaacaccctggagagccccttcagtgacctgaacaacctgcccagtgatgtggtgtctgccctgaagaacaagctgaagaagcagagcacagccactggagatggagtggcccgggccttcctgcgggcccaggccgccctgtttggcagctacagagatgccctgcgctacaagccaggagagcccatcaccttctgtgaggagagctttgtgaagcacaggagctctgtgatgaagcagttcctggagacagccatcaacctgcagctgttcaagcagttcattgatggccgcctggccaagctgaatgccggccggggcttcagtgatgtgtttgaggaggagatcaccagcggcggcttctgtggcggcaaccccaggagctaccagcagtgggtgcacacagtgaagaagggcggggccctcttcaacacagccatgaccaaggccaccccagctgtgaggacagcctacaagtttgccaagaaccacgccaagctgggcctgaaggaggtgaagagcaagctgaagcacaaggaaaatgaagaagattatggcacctgcagcagctctgtgcagtacacccctgtgtacaagctgcacaatgagaagggcggcaacagcgagaagaggaagctggcccaggcccggctgaagaggcccctgaagagcctggatggagccctgtatgatgatgaagatgatgatgacatcgagcgggccagcaagctgagcagtgaagatggagaggaggccagcgcctacctgtatgaaagtgatgacagcgtggagaccagggtgaagaccccctacagcggggagatggacctgctgggggagatcctggacaccctgagcacccacagcagtgaccagggcaagctggccgccgccaagagcctggacttcttccgctccatggatgacatcgactacaagcccaccaacaagagcaatgcccccagcgagaacaacctggccttcctgtgtggcggcagcggggaccaggccgagtggaacctgggccaggatgacagcgccctgcacggcaagcacctgccccccagccccaggaagagggtgagcagcagcggcctgacagacagcctcttcatcctgaaggaggagaacagcaacaagcacctgggcgctgacaacgtgtctgaccccaccagcggcctggacttccagctgaccagccctgaggtgtcccagacagacaagggcaagacagagaagcgggagaccctgagccagatcagtgatgacctgctgatccctggcctgggccgccacagcagcacctttgtgccctgggagaaggagggcaaggaggccaaggagaccagtgaagatattggcctgctgcacgaggtggtgtccctgtgccacatgaccagtgacttccagcagagcctgaacatcagtgacaagaacaccaatggaaaccagacctag

SEQ ID NO: 149781 - DNA, 2328 bp, Artificial Sequence
  Description of Artificial Sequence: Synthetic coding sequence
attgagaccaagacccgggccaacccagacaggacctttgacctggtgctgaaggtgaagtgccacgcctctgaaaatgaagatcctgtggtgctgtggaagttcccagaagattttggagaccaggagatcctgcagagcgtgcccaagttctgcttcccctttgatgtggagcgggtgtcccagaaccaggtgggccagcacttcacctttgtgctgacagacatcgagagcaagcagcgcttcggcttctgccgcctgaccagcggcggcaccatctgcctgtgcatcctgagctacctgccctggtttgaggtgtactacaagctgctgaacaccctggccgactacctggccaaggagctggagaatgacctgaatgagaccctgcggagcctgtacaaccaccctgtgcccaaggccaacacccctgtgaacctgtctgtgaaccaggagatcttcatcgcctgtgagcaggtgctgaaggaccagcctgccctggtgccccacagctacttcatcgccccagatgtgacaggcctgcccaccatccctgagagcaggaacctgacagagtactttgtggccgtggatgtgaacaacatgctgcagctgtatgcctccatgctgcatgaaagaagaattgtcatcatcagcagcaagctgagcaccctgacagcctgcatccacggcagcgctgccctgctgtaccccatgtactggcagcacatctacatccctgtgctgcccccccacctgctggactactgctgtgcccccatgccctacctgattggcatccacagcagcctcatcgagcgggtgaagaacaagagcctggaggatgtggtgatgctgaatgtggacaccaacaccctggagagccccttcagtgacctgaacaacctgcccagtgatgtggtgtctgccctgaagaacaagctgaagaagcagagcacagccactggagatggagtggcccgggccttcctgcgggcccaggccgccctgtttggcagctacagagatgccctgcgctacaagccaggagagcccatcaccttctgtgaggagagctttgtgaagcacaggagctctgtgatgaagcagttcctggagacagccatcaacctgcagctgttcaagcagttcattgatggccgcctggccaagctgaatgccggccggggcttcagtgatgtgtttgaggaggagatcaccagcggcggcttctgtggcggcaaccccaggagctaccagcagtgggtgcacacagtgaagaagggcggggccctcttcaacacagccatgaccaaggccaccccagctgtgaggacagcctacaagtttgccaagaaccacgccaagctgggcctgaaggaggtgaagagcaagctgaagcacaaggaaaatgaagaagattatggcacctgcagcagctctgtgcagtacacccctgtgtacaagctgcacaatgagaagggcggcaacagcgagaagaggaagctggcccaggcccggctgaagaggcccctgaagagcctggatggagccctgtatgatgatgaagatgatgatgacatcgagcgggccagcaagctgagcagtgaagatggagaggaggccagcgcctacctgtatgaaagtgatgacagcgtggagaccagggtgaagaccccctacagcggggagatggacctgctgggggagatcctggacaccctgagcacccacagcagtgaccagggcaagctggccgccgccaagagcctggacttcttccgctccatggatgacatcgactacaagcccaccaacaagagcaatgcccccagcgagaacaacctggccttcctgtgtggcggcagcggggaccaggccgagtggaacctgggccaggatgacagcgccctgcacggcaagcacctgccccccagccccaggaagagggtgagcagcagcggcctgacagacagcctcttcatcctgaaggaggagaacagcaacaagcacctgggcgctgacaacgtgtctgaccccaccagcggcctggacttccagctgaccagccctgaggtgtcccagacagacaagggcaagacagagaagcgggagaccctgagccagatcagtgatgacctgctgatccctggcctgggccgccacagcagcacctttgtgccctgggagaaggagggcaaggaggccaaggagaccagtgaagatattggcctgctgcacgaggtggtgtccctgtgccacatgaccagtgacttccagcagagcctgaacatcagtgacaagaacaccaatggaaaccagacctag

SEQ ID NO: 149782 - DNA, 1248 bp, Artificial Sequence
  Description of Artificial Sequence: Synthetic coding sequence
gtgaagcacaggagctctgtgatgaagcagttcctggagacagccatcaacctgcagctgttcaagcagttcattgatggccgcctggccaagctgaatgccggccggggcttcagtgatgtgtttgaggaggagatcaccagcggcggcttctgtggcggcaaccccaggagctaccagcagtgggtgcacacagtgaagaagggcggggccctcttcaacacagccatgaccaaggccaccccagctgtgaggacagcctacaagtttgccaagaaccacgccaagctgggcctgaaggaggtgaagagcaagctgaagcacaaggaaaatgaagaagattatggcacctgcagcagctctgtgcagtacacccctgtgtacaagctgcacaatgagaagggcggcaacagcgagaagaggaagctggcccaggcccggctgaagaggcccctgaagagcctggatggagccctgtatgatgatgaagatgatgatgacatcgagcgggccagcaagctgagcagtgaagatggagaggaggccagcgcctacctgtatgaaagtgatgacagcgtggagaccagggtgaagaccccctacagcggggagatggacctgctgggggagatcctggacaccctgagcacccacagcagtgaccagggcaagctggccgccgccaagagcctggacttcttccgctccatggatgacatcgactacaagcccaccaacaagagcaatgcccccagcgagaacaacctggccttcctgtgtggcggcagcggggaccaggccgagtggaacctgggccaggatgacagcgccctgcacggcaagcacctgccccccagccccaggaagagggtgagcagcagcggcctgacagacagcctcttcatcctgaaggaggagaacagcaacaagcacctgggcgctgacaacgtgtctgaccccaccagcggcctggacttccagctgaccagccctgaggtgtcccagacagacaagggcaagacagagaagcgggagaccctgagccagatcagtgatgacctgctgatccctggcctgggccgccacagcagcacctttgtgccctgggagaaggagggcaaggaggccaaggagaccagtgaagatattggcctgctgcacgaggtggtgtccctgtgccacatgaccagtgacttccagcagagcctgaacatcagtgacaagaacaccaatggaaaccagacctag

SEQ ID NO: 149783 - DNA, 2406 bp, Artificial Sequence
  Description of Artificial Sequence: Synthetic coding sequence
atggagagcagagctgagggcggcagccctgctgtgtttgactggttctttgaagctgcctgcccagccagcctgcaggaggacccccccatcctgcggcagttccccccagacttccgggaccaggaggccatgcagatggtgcccaagttctgcttcccctttgatgtggagcgggagccccccagccctgctgtgcagcacttcacctttgccctgacagacctggccggcaacagacgcttcggcttctgccgcctgcgggccggcacccagagctgcctgtgcatcctgagccacctgccctggtttgaggtgttctacaagctgctgaacacagtgggggacctgctggcccaggaccaggtgacagaggccgaggagctgctgcagaacctcttccagcagagcctgagcggcccccaggcctctgtgggcctggagctgggcagcggcgtgacagtgagcagcggccagggcatccccccacccacccggggcaacagcaagcccctgagctgctttgtggccccagacagcggccgcctgcccagcatccctgagaacagaaacctgacagagctggtggtggccgtgacagatgagaacatcgtgggcctgtttgctgccctgctggccgagaggagagtgctgctgacagccagcaagctgagcaccctgaccagctgtgtgcacgccagctgtgccctgctgtaccccatgcgctgggagcacgtgctgatccccaccctgcccccccacctgctggactactgctgtgcccccatgccctacctgattggagtgcacgccagcctggccgagcgggtgcgggagaaggccctggaggatgtggtggtgctgaatgtggatgccaacaccctggagaccaccttcaatgatgtgcaggccctgcccccagatgtggtgtccctgctgcggctgcggctgaggaaggtggccctggcccctggagaaggagtgagccgcctcttcctgaaggcccaggccctgctgtttggaggctacagagatgccctggtgtgcagccctggccagcctgtgaccttcagcgaggaggtgttcctggcccagaagccaggggcccccctgcaggccttccaccggcgggctgtgcacctgcagctgttcaagcagttcatcgaggcccggctggagaagctgaacaagggggagggcttcagtgaccagtttgagcaggagatcaccggctgtggggccagcagcggggccctgcggagctaccagctgtgggccgacaacctgaagaagggcggcggggccctgctgcacagcgtgaaggccaagacccagcctgctgtgaagaacatgtaccgcagcgccaagagcggcctgaagggcgtgcagagcctgctgatgtacaaggatggagacagcgtgctgcagaggggcggcagcctgcgggccccagccctgcccagcagaagtgaccggctgcagcagaggctgcccatcacccagcactttgggaagaaccggcccctgcggcccagcagaagacggcagctggaggagggcaccagcgagcccccaggagctggcaccccacccctgagcccagaagatgagggctgcccctgggccgaggaggccctggacagcagcttcctgggcagcggggaggagctggacctgctgtctgagatcctggacagcctgtccatgggcgccaagtctgctggcagcctgcggcccagccagagcctggactgctgccacagaggagacctggacagctgcttcagcctgcccaacatcccccgctggcagccagatgacaagaagctgcctgagcctgagccccagcccctgagcctgcccagcctgcagaatgccagcagcctggatgccaccagcagcagcaaggacagccgcagccagctgatccccagcgagagtgaccaggaggtgaccagccccagccagagcagcacagccagcgctgaccccagcatctggggagaccccaagcccagccccctgacagagcccctcatcctgcacctgacccccagccacaaggctgctgaggacagcacagcccaggagaaccccaccccctggctgagcacagcccccacagagcccagccccccagagagcccccagatcctggcccccaccaagcccaactttgacatcgcctggaccagccagcccctggaccccagcagtgaccccagcagcctggaggacccccgggcccggccccccaaggccctgctggccgagcgggcccacctgcagccccgggaggagcccggggccctgaacagccctgccacccccaccagcaactgccagaagagccagcccagcagccggccccgggtggccgacctgaagaagtgctttgagggctag

SEQ ID NO: 149784 - DNA, 2274 bp, Artificial Sequence
  Description of Artificial Sequence: Synthetic coding sequence
atgcagatggtgcccaagttctgcttcccctttgatgtggagcgggagccccccagccctgctgtgcagcacttcacctttgccctgacagacctggccggcaacagacgcttcggcttctgccgcctgcgggccggcacccagagctgcctgtgcatcctgagccacctgccctggtttgaggtgttctacaagctgctgaacacagtgggggacctgctggcccaggaccaggtgacagaggccgaggagctgctgcagaacctcttccagcagagcctgagcggcccccaggcctctgtgggcctggagctgggcagcggcgtgacagtgagcagcggccagggcatccccccacccacccggggcaacagcaagcccctgagctgctttgtggccccagacagcggccgcctgcccagcatccctgagaacagaaacctgacagagctggtggtggccgtgacagatgagaacatcgtgggcctgtttgctgccctgctggccgagaggagagtgctgctgacagccagcaagctgagcaccctgaccagctgtgtgcacgccagctgtgccctgctgtaccccatgcgctgggagcacgtgctgatccccaccctgcccccccacctgctggactactgctgtgcccccatgccctacctgattggagtgcacgccagcctggccgagcgggtgcgggagaaggccctggaggatgtggtggtgctgaatgtggatgccaacaccctggagaccaccttcaatgatgtgcaggccctgcccccagatgtggtgtccctgctgcggctgcggctgaggaaggtggccctggcccctggagaaggagtgagccgcctcttcctgaaggcccaggccctgctgtttggaggctacagagatgccctggtgtgcagccctggccagcctgtgaccttcagcgaggaggtgttcctggcccagaagccaggggcccccctgcaggccttccaccggcgggctgtgcacctgcagctgttcaagcagttcatcgaggcccggctggagaagctgaacaagggggagggcttcagtgaccagtttgagcaggagatcaccggctgtggggccagcagcggggccctgcggagctaccagctgtgggccgacaacctgaagaagggcggcggggccctgctgcacagcgtgaaggccaagacccagcctgctgtgaagaacatgtaccgcagcgccaagagcggcctgaagggcgtgcagagcctgctgatgtacaaggatggagacagcgtgctgcagaggggcggcagcctgcgggccccagccctgcccagcagaagtgaccggctgcagcagaggctgcccatcacccagcactttgggaagaaccggcccctgcggcccagcagaagacggcagctggaggagggcaccagcgagcccccaggagctggcaccccacccctgagcccagaagatgagggctgcccctgggccgaggaggccctggacagcagcttcctgggcagcggggaggagctggacctgctgtctgagatcctggacagcctgtccatgggcgccaagtctgctggcagcctgcggcccagccagagcctggactgctgccacagaggagacctggacagctgcttcagcctgcccaacatcccccgctggcagccagatgacaagaagctgcctgagcctgagccccagcccctgagcctgcccagcctgcagaatgccagcagcctggatgccaccagcagcagcaaggacagccgcagccagctgatccccagcgagagtgaccaggaggtgaccagccccagccagagcagcacagccagcgctgaccccagcatctggggagaccccaagcccagccccctgacagagcccctcatcctgcacctgacccccagccacaaggctgctgaggacagcacagcccaggagaaccccaccccctggctgagcacagcccccacagagcccagccccccagagagcccccagatcctggcccccaccaagcccaactttgacatcgcctggaccagccagcccctggaccccagcagtgaccccagcagcctggaggacccccgggcccggccccccaaggccctgctggccgagcgggcccacctgcagccccgggaggagcccggggccctgaacagccctgccacccccaccagcaactgccagaagagccagcccagcagccggccccgggtggccgacctgaagaagtgctttgagggctag

SEQ ID NO: 149785 - DNA, 2193 bp, Artificial Sequence
  Description of Artificial Sequence: Synthetic coding sequence
atgctgttcaacagcgtgctgcggcagccccagctgggcgtgctgagaaatggctggagcagccagtaccccctgcagagcctgctgaccggctaccagtgcagcggaaatgatgagcacaccagctatggagagaccggggtgcctgtgcccccatttggctgcaccttcagcagcgcccccaacatggagcacgtgctggccgtggccaatgaggagggctttgtgcggctgtacaacacagagagccagagcttcaggaagaagtgcttcaaggagtggatggcccactggaatgctgtgtttgacctggcctgggtgcctggagagctgaagctggtgacagctgctggggaccagacagccaagttctgggatgtgaaggccggggagctgattggcacctgcaagggccaccagtgcagcctgaagtctgtggccttcagcaagtttgagaaggctgtgttctgcaccggcggcagagatggcaacatcatggtgtgggacacccgctgcaacaagaaggatggcttctaccggcaggtgaaccagatcagcggggcccacaacaccagtgacaagcagacccccagcaagcccaagaagaagcagaacagcaagggcctggcccccagcgtggacttccagcagagcgtgacagtggtgctcttccaggatgagaacaccctggtgtctgctggagctgtggatggcatcatcaaggtgtgggacctgaggaagaactacacagcctaccggcaggagcccatcgccagcaagagcttcctgtacccaggcagcagcaccaggaagctgggctacagcagcctcatcctggacagcacaggcagcaccctgtttgccaactgcacagatgacaacatctacatgttcaacatgacaggcctgaagaccagccctgtggccatcttcaacggccaccagaacagcaccttctacgtgaagagcagcctgagcccagatgaccagttcctggtgtctggcagcagtgatgaggccgcctacatctggaaggtgtccaccccctggcagccccccaccgtgctgctgggccacagccaggaggtgacctctgtgtgctggtgccccagcgacttcaccaagatcgccacctgcagtgatgacaacaccctgaagatctggaggctgaacagaggcctggaggagaagccaggaggagacaagctgagcacagtgggctgggccagccagaagaagaaggagagccggcccggcctggtgacagtgaccagcagccagagcaccccagccaaggccccccgggccaagtgcaaccccagcaacagcagccccagcagcgctgcctgtgcccccagctgtgccggggacctgcccctgcccagcaacacccccaccttcagcatcaagaccagccctgccaaggcccggagccccatcaacagaagaggctctgtgtcctctgtgagccccaagccacccagcagcttcaagatgagcatccggaactgggtgaccaggacccccagcagcagcccccccatcaccccaccagccagcgagaccaagatcatgagccccaggaaggccctgatccctgtgtcccagaagagcagccaggccgaggcctgcagcgagagcaggaacagagtgaagaggcggctggacagcagctgcctggagagcgtgaagcagaagtgtgtgaagagctgcaactgtgtgacagagctggatggccaggtggagaacctgcacctggacctgtgctgcctggccggcaaccaggaggacctgagcaaggacagcctgggccccaccaagagcagcaagattgaaggagctggcaccagcatcagcgagccccccagccccatcagcccctatgccagcgagagctgtggcaccctgcccctgcccctgcggccctgtggggagggcagcgagatggtgggcaaggagaacagcagccctgagaacaagaactggctgctggccatggccgccaagaggaaggccgagaaccccagccccaggagccccagcagccagacccccaacagccggcggcagagcggcaagaagctgcccagccctgtgaccatcacccccagctccatgaggaagatctgcacctacttccacaggaagagccaggaggacttctgtggccctgagcacagcacagagctgtag

SEQ ID NO: 149786 - DNA, 1230 bp, Artificial Sequence
  Description of Artificial Sequence: Synthetic coding sequence
atgctgttcaacagcgtgctgcggcagccccagctgggcgtgctgagaaatggctggagcagccagtaccccctgcagagcctgctgaccggctaccagtgcagcggaaatgatgagcacaccagctatggagagaccggggtgcctgtgcccccatttggctgcaccttcagcagtgatgacaacaccctgaagatctggaggctgaacagaggcctggaggagaagccaggaggagacaagctgagcacagtgggctgggccagccagaagaagaaggagagcaggcctggcctggtgacagtgaccagcagccagagcaccccagccaaggccccccgggccaagtgcaaccccagcaacagcagccccagcagcgctgcctgtgcccccagctgtgccggggacctgcccctgcccagcaacacccccaccttcagcatcaagaccagccctgccaaggcccggagccccatcaacagaagaggctctgtgtcctctgtgagccccaagccacccagcagcttcaagatgagcatccggaactgggtgaccaggacccccagcagcagcccccccatcaccccaccagccagcgagaccaagatcatgagccccaggaaggccctgatccctgtgtcccagaagagcagccaggccgaggcctgcagcgagagcaggaacagagtgaagaggcggctggacagcagctgcctggagagcgtgaagcagaagtgtgtgaagagctgcaactgtgtgacagagctggatggccaggtggagaacctgcacctggacctgtgctgcctggccggcaaccaggaggacctgagcaaggacagcctgggccccaccaagagcagcaagattgagggcgccggcaccagcatcagcgagccccccagccccatcagcccctatgccagcgagagctgtggcaccctgcccctgcccctgcggccctgtggggagggcagcgagatggtgggcaaggagaacagcagccctgagaacaagaactggctgctggccatggccgccaagaggaaggccgagaaccccagccccaggagccccagcagccagacccccaacagccggcggcagagcggcaagaagctgcccagccctgtgaccatcacccccagctccatgaggaagatctgcacctacttccacaggaagagccaggaggacttctgtggccctgagcacagcacagagctgtag

SEQ ID NO: 149787 - DNA, 2067 bp, Artificial Sequence
  Description of Artificial Sequence: Synthetic coding sequence
atgctgttcaacagcgtgctgcggcagccccagctgggcgtgctgagaaatgcccccaacatggagcacgtgctggccgtggccaatgaggagggctttgtgcggctgtacaacacagagagccagagcttcaggaagaagtgcttcaaggagtggatggcccactggaatgctgtgtttgacctggcctgggtgcctggagagctgaagctggtgacagctgctggggaccagacagccaagttctgggatgtgaaggccggggagctgattggcacctgcaagggccaccagtgcagcctgaagtctgtggccttcagcaagtttgagaaggctgtgttctgcaccggcggcagagatggcaacatcatggtgtgggacacccgctgcaacaagaaggatggcttctaccggcaggtgaaccagatcagcggggcccacaacaccagtgacaagcagacccccagcaagcccaagaagaagcagaacagcaagggcctggcccccagcgtggacttccagcagagcgtgacagtggtgctcttccaggatgagaacaccctggtgtctgctggagctgtggatggcatcatcaaggtgtgggacctgaggaagaactacacagcctaccggcaggagcccatcgccagcaagagcttcctgtacccaggcagcagcaccaggaagctgggctacagcagcctcatcctggacagcacaggcagcaccctgtttgccaactgcacagatgacaacatctacatgttcaacatgacaggcctgaagaccagccctgtggccatcttcaacggccaccagaacagcaccttctacgtgaagagcagcctgagcccagatgaccagttcctggtgtctggcagcagtgatgaggccgcctacatctggaaggtgtccaccccctggcagccccccaccgtgctgctgggccacagccaggaggtgacctctgtgtgctggtgccccagcgacttcaccaagatcgccacctgcagtgatgacaacaccctgaagatctggaggctgaacagaggcctggaggagaagccaggaggagacaagctgagcacagtgggctgggccagccagaagaagaaggagagccggcccggcctggtgacagtgaccagcagccagagcaccccagccaaggccccccgggccaagtgcaaccccagcaacagcagccccagcagcgctgcctgtgcccccagctgtgccggggacctgcccctgcccagcaacacccccaccttcagcatcaagaccagccctgccaaggcccggagccccatcaacagaagaggctctgtgtcctctgtgagccccaagccacccagcagcttcaagatgagcatccggaactgggtgaccaggacccccagcagcagcccccccatcaccccaccagccagcgagaccaagatcatgagccccaggaaggccctgatccctgtgtcccagaagagcagccaggccgaggcctgcagcgagagcaggaacagagtgaagaggcggctggacagcagctgcctggagagcgtgaagcagaagtgtgtgaagagctgcaactgtgtgacagagctggatggccaggtggagaacctgcacctggacctgtgctgcctggccggcaaccaggaggacctgagcaaggacagcctgggccccaccaagagcagcaagattgaaggagctggcaccagcatcagcgagccccccagccccatcagcccctatgccagcgagagctgtggcaccctgcccctgcccctgcggccctgtggggagggcagcgagatggtgggcaaggagaacagcagccctgagaacaagaactggctgctggccatggccgccaagaggaaggccgagaaccccagccccaggagccccagcagccagacccccaacagccggcggcagagcggcaagaagctgcccagccctgtgaccatcacccccagctccatgaggaagatctgcacctacttccacaggaagagccaggaggacttctgtggccctgagcacagcacagagctgtag

SEQ ID NO: 149788 - DNA, 1494 bp, Artificial Sequence
  Description of Artificial Sequence: Synthetic coding sequence
atgaagatcagcatcctgctgatgttcctgtggggcctgagctgtgccctgcctgtgacccgctaccagaacaatgaaagtgaggacagcgaggagtggaagggccacctggcccaggcccccaccccacccctggccaatgaagaccccagcgacagcacccagagcgaggagggcctgggcagtgatgaccaccagtacatctaccgcctggccggcggcttcagccgcagcactggaaaaggaggagatgacaaggatgatgatgaagatgattctggagatgacacctttggagatgatgattctggccctggccccaaggaccggcaggagggcggcaacagccggctgggcagtgatgaggacagtgatgacaccatccaggccagcgaggagagcgccccccagggccaggacagcgcccaggacaccaccagcgagagccgggagctggacaatgaagatagagtggacagcaagccagagggcggggacagcacccaggagagcgagagcgaggagcactgggtgggcggcggcagtgatggagagagcagccatggagatggcagcgagctggatgatgagggcatgcagagtgatgatcctgagagcatccgctctgagcggggcaacagcaggatgaacagcgctggcatgaagagcaaggagagcggggagaacagcgagcaggccaacacccaggacagcggcggcagccagctgctggagcaccccagcaggaagatcttcaggaagagccgcatcagcgaggaggatgacagaagtgagctggatgacaacaacaccatggaggaggtgaagagtgacagcacagagaacagcaacagccgggacaccggcctgagccagccccggcgggacagcaagggggacagccaggaggacagcaaagaaaacctgagccaggaggagagccagaatgtggatggccccagcagcgagagcagccaggaggccaacctgagcagccaggagaacagcagcgagagccaggaggaggtggtgtctgagagcagaggagacaacccagaccccaccaccagctatgtggaggaccaggaggacagcgacagcagcgaggaggacagcagccacaccctgagccacagcaagtctgagagccgggaggagcaggccgacagcgagagcagcgagagcctgaacttcagcgaggagagccctgagagcccagaagatgagaacagcagcagccaggagggcctgcagagccacagcagcagcgctgagagccagagcgaggagagccacagtgaagaagatgacagcgacagccaggacagcagccgcagcaaggaggacagcaacagcacagagagcaagagcagcagtgaagaagatggccagctgaagaacatcgagattgagagcaggaagctgactgtggatgcctaccacaacaagcccatcggggaccaggatgacaatgactgccaggacggctactag

SEQ ID NO: 149789 - DNA, 1542 bp, Artificial Sequence
  Description of Artificial Sequence: Synthetic coding sequence
atgaagatcagcatcctgctgatgttcctgtggggcctgagctgtgccctgcctgtgacccgctaccagaacaatgaaagtgaggacagcgaggagtggaagggccacctggcccaggcccccaccccacccctggagagcagcgagagcagcgagggcagcaaggtgagcagcgaggagcaggccaatgaagaccccagcgacagcacccagagcgaggagggcctgggcagtgatgaccaccagtacatctaccgcctggccggcggcttcagccgcagcactggaaaaggaggagatgacaaggatgatgatgaagatgattctggagatgacacctttggagatgatgattctggccctggccccaaggaccggcaggagggcggcaacagccggctgggcagtgatgaggacagtgatgacaccatccaggccagcgaggagagcgccccccagggccaggacagcgcccaggacaccaccagcgagagccgggagctggacaatgaagatagagtggacagcaagccagagggcggggacagcacccaggagagcgagagcgaggagcactgggtgggcggcggcagtgatggagagagcagccatggagatggcagcgagctggatgatgagggcatgcagagtgatgatcctgagagcatccgctctgagcggggcaacagcaggatgaacagcgctggcatgaagagcaaggagagcggggagaacagcgagcaggccaacacccaggacagcggcggcagccagctgctggagcaccccagcaggaagatcttcaggaagagccgcatcagcgaggaggatgacagaagtgagctggatgacaacaacaccatggaggaggtgaagagtgacagcacagagaacagcaacagccgggacaccggcctgagccagccccggcgggacagcaagggggacagccaggaggacagcaaagaaaacctgagccaggaggagagccagaatgtggatggccccagcagcgagagcagccaggaggccaacctgagcagccaggagaacagcagcgagagccaggaggaggtggtgtctgagagcagaggagacaacccagaccccaccaccagctatgtggaggaccaggaggacagcgacagcagcgaggaggacagcagccacaccctgagccacagcaagtctgagagccgggaggagcaggccgacagcgagagcagcgagagcctgaacttcagcgaggagagccctgagagcccagaagatgagaacagcagcagccaggagggcctgcagagccacagcagcagcgctgagagccagagcgaggagagccacagtgaagaagatgacagcgacagccaggacagcagccgcagcaaggaggacagcaacagcacagagagcaagagcagcagtgaagaagatggccagctgaagaacatcgagattgagagcaggaagctgactgtggatgcctaccacaacaagcccatcggggaccaggatgacaatgactgccaggacggctactag

SEQ ID NO: 149790 - DNA, 3906 bp, Artificial Sequence
  Description of Artificial Sequence: Synthetic coding sequence
atgaagatcatcacctacttctgcatctgggccgtggcctgggccatccctgtgccccagagcaagcccctggagagacatgtggagaagtccatgaacctgcacctgctggcccggagcaatgtgtctgtgcaggatgagctgaatgccagcggcaccatcaaggagagcggcgtgctggtgcatgaaggagaccggggccggcaggagaacacccaggacggccacaagggggagggcaatggcagcaagtgggccgaggtgggcggcaagagcttcagcacctacagcaccctggccaatgaggagggcaacatcgagggctggaatggagacaccgggaaggccgagacctacggccatgatggcatccacggcaaggaggagaacatcacagccaacggcatccagggccaggtgtccatcatcgacaatgctggggccaccaacagaagcaacaccaatggaaacacagacaagaacacccagaatggagatgtgggagatgctggccacaatgaagatgtggccgtggtgcaggaggatggcccccaggtggccggcagcaacaacagcacagacaatgaagatgagatcatcgagaacagctgcagaaatgaaggcaacaccagcgagatcaccccccagatcaacagcaagagaaatggcaccaaggaggccgaggtgaccccaggcactggagaagatgctggcctggacaacagtgatggcagccccagcggaaatggagcagatgaagatgaagatgagggcagcggagatgatgaagatgaggaggccggaaatggcaaggacagcagcaacaacagcaagggccaggagggccaggaccacggcaaggaggatgaccatgacagcagcatcggccagaacagcgacagcaaggagtactatgaccctgagggcaaggaggacccccacaatgaggtggatggagacaagaccagcaagtcagaagaaaattctgctggcatccctgaggacaatggcagccagagaattgaggacacccagaagctgaaccaccgggagagcaagagggtggagaaccgcatcaccaaggagagcgagacccatgctgtgggcaagagccaggacaagggcatcgagatcaagggccccagcagcggcaacagaaacatcaccaaggaggtgggcaaaggaaatgaaggcaaggaggacaagggccagcacggcatgatcctgggcaaaggaaatgtgaagacccagggcgaggtggtgaacatcgagggccctggccagaagtctgagcccggcaacaaggtgggccacagcaacacaggcagtgacagcaacagtgatggctatgacagctatgactttgatgacaagtccatgcagggagatgaccccaacagcagtgatgagagcaatggaaatgatgatgccaacagcgagagtgacaacaacagcagcagcagaggagatgccagctacaacagtgatgagagcaaggacaatggaaatggaagtgacagcaaaggagcagaagatgatgacagcgacagcaccagtgacaccaacaacagcgacagcaatggaaatggaaataatggaaatgatgacaatgacaagagtgacagcggcaagggcaagagtgacagcagtgacagcgacagcagtgacagcagcaacagcagtgacagcagtgacagcagtgacagcgacagcagtgacagcaacagcagcagtgacagcgacagcagtgacagcgacagcagtgacagcagtgacagcgacagcagtgacagcagcaacagcagtgacagcagtgacagcagtgacagcagtgacagcagtgacagcagtgacagcagtgacagcaagagtgacagcagcaagtctgagagtgacagcagtgacagcgacagcaagagtgacagcagtgacagcaacagcagtgacagcagtgacaacagcgacagcagtgacagcagcaacagcagcaacagcagtgacagcagtgacagcagtgacagcagtgacagcagcagcagcagtgacagcagcaacagcagtgacagcagtgacagcagtgacagcagcaacagcagcgagagcagtgacagcagtgacagcagtgacagcgacagcagtgacagcagtgacagcagcaacagcaacagcagtgacagcgacagcagcaacagcagtgacagcagtgacagcagcaacagcagtgacagcagtgacagcagtgacagcagcaacagcagtgacagcagtgacagcagtgacagcagcaacagcagtgacagcagtgacagcagtgacagcagtgacagcagtgacagcagcaacagcagtgacagcaatgacagcagcaacagcagtgacagcagtgacagcagcaacagcagtgacagcagcaacagcagtgacagcagtgacagcagtgacagcagtgacagcgacagcagcaacagcagtgacagcagcaacagcagtgacagcagtgacagcagcaacagcagtgacagcagtgacagcagtgacagcagtgatggcagtgacagcgacagcagcaacagaagtgacagcagcaacagcagtgacagcagtgacagcagtgacagcagcaacagcagtgacagcagtgacagcagtgacagcaatgaaagcagcaacagcagtgacagcagtgacagcagcaacagcagtgacagcgacagcagtgacagcagcaacagcagtgacagcagtgacagcagcaacagcagtgacagcagcgagagcagcaacagcagtgacaacagcaacagcagtgacagcagcaacagcagtgacagcagtgacagcagtgacagcagcaacagcagtgacagcagcaacagcagtgacagcagcaacagcagtgacagcagtgacagcaacagcagtgacagcagtgacagcagcaacagcagtgacagcagtgacagcagtgacagcagtgacagcagtgacagcagtgacagcagcaacagcagtgacagcagtgacagcagtgacagcagtgacagcagcaacagcagtgacagcagcaacagcagtgacagcagcaacagcagtgacagcagtgacagcagtgacagcagtgacagcagtgacagcagtgacagcagtgacagcagtgacagcagcaacagcagtgacagcagtgacagcagtgacagcagtgacagcagtgacagcagtgacagcagtgacagcagtgacagcagcgagagcagtgacagcagtgacagcagcaacagcagtgacagcagtgacagcagtgacagcagtgacagcagtgacagcagtgacagcagtgacagcagtgacagcagtgacagcagcaacagcagtgacagcagtgacagcagtgacagcagtgacagcagtgacagcagcaacagcagtgacagcagtgacagcagcgagagcagtgacagcagtgacagcagtgacagcagtgacagcagtgacagcagtgacagcagtgacagcagtgacagcagtgacagcagcaacagcagtgacagcagtgacagcagtgacagcagtgacagcagtgacagcagtgacagcagtgacagcagtgacagcagtgacagcagtgacagcagtgacagcagtgacagcagtgacagcagtgacagcagtgacagcagtgacagcagtgacagcaatgaaagcagtgacagcagtgacagcagtgacagcagtgacagcagcaacagcagtgacagcagtgacagcagtgacagcagtgacagcaccagtgacagcaatgatgaaagtgacagccagagcaagtctggaaatggaaacaacaatggaagtgacagcgacagcgacagcgagggcagtgacagcaaccacagcaccagtgatgactag

SEQ ID NO: 149791 - DNA, 3906 bp, Artificial Sequence; identical to SEQ ID NO: 149790
  Description of Artificial Sequence: Synthetic coding sequence

SEQ ID NO: 149792 - DNA, 783 bp, Artificial Sequence
  Description of Artificial Sequence: Synthetic coding sequence
atggccaccccacccaagaggagctgccccagcttcagcgccagcagcgagggcacccgcatcaagaagatcagcattgagggcaacattgctgctgggaagagcacctttgtgaacatcctgaagcagctgtgtgaggactgggaggtggtgcctgagcctgtggcccgctggtgcaatgtgcagagcacccaggatgaatttgaggagctgaccatgagccagaagaatggaggaaatgtgctgcagatgatgtatgagaagccagagcgctggagcttcaccttccagacctacgcctgcctgagccgcatccgggcccagctggccagcctgaatggcaagctgaaggatgctgagaagcctgtgctcttctttgagaggtctgtgtacagcgaccgctacatctttgccagcaacctgtatgaaagtgagtgcatgaatgaaacagagtggaccatctaccaggactggcatgactggatgaacaaccagtttggccagagcctggagctggatggcatcatctacctgcaggccaccccagagacctgcctgcaccgcatctacctgcggggcagaaatgaggagcagggcatccccctggagtacctggagaagctgcactacaagcatgagagctggctgctgcacaggaccctgaagaccaactttgactacctgcaggaggtgcccatcctgaccctggatgtgaatgaagacttcaaggacaagtatgagagcctggtggagaaggtgaaggagttcctgagcaccctgtag

SEQ ID NO: 149793 - DNA, 48 bp, Artificial Sequence
  Description of Artificial Sequence: Synthetic coding sequence
atggccaccccacccaagaggagctgccccagcttcagcgccagctag

SEQ ID NO: 149794 - DNA, 834 bp, Artificial Sequence
  Description of Artificial Sequence: Synthetic coding sequence
atggctgctggccgcctcttcctgagccggctgcgggcccccttcagctccatggccaagagccccctggagggcgtgagcagcagccggggcctgcacgccggccggggcccccggcggctgagcattgagggcaacattgctgtgggcaagagcacctttgtgaagctgctgaccaagacctacccagagtggcacgtggccacagagcctgtggccacctggcagaacatccaggccgccggcacccagaaggcctgcacagcccagagcctgggcaacctgctggacatgatgtaccgggagcccgcccgctggagctacaccttccagaccttctccttcctgagccggctgaaggtgcagctggagcccttccctgagaagctgctgcaggccaggaagcctgtgcagatctttgagaggtctgtgtacagcgaccgctacatctttgccaagaacctgtttgaaaatggcagcctgagtgacatcgagtggcacatctaccaggactggcacagcttcctgctgtgggagtttgccagccgcatcaccctgcacggcttcatctacctgcaggccagcccccaggtgtgcctgaagaggctgtaccagagggcccgggaggaggagaagggcatcgagctggcctacctggagcagctgcacggccagcacgaggcctggctgatccacaagaccaccaagctgcactttgaggccctgatgaacatccctgtgctggtgctggatgtgaatgatgacttcagcgaggaggtgaccaagcaggaggacctgatgagggaggtgaacacctttgtgaagaacctgtag

SEQ ID NO: 149795 - DNA, 720 bp, Artificial Sequence
  Description of Artificial Sequence: Synthetic coding sequence
atggctgctggccgcctcttcctgagccggctgcgggcccccttcagctccatggccaagagccccctggagggcgtgagcagcagccggggcctgcacgccggccggggcccccggcggctgagcattgagggcaacatcgcctgcacagcccagagcctgggcaacctgctggacatgatgtaccgggagcccgcccgctggagctacaccttccagaccttctccttcctgagccggctgaaggtgcagctggagcccttccctgagaagctgctgcaggccaggaagcctgtgcagatctttgagaggtctgtgtacagcgaccgctacatctttgccaagaacctgtttgaaaatggcagcctgagtgacatcgagtggcacatctaccaggactggcacagcttcctgctgtgggagtttgccagccgcatcaccctgcacggcttcatctacctgcaggccagcccccaggtgtgcctgaagaggctgtaccagagggcccgggaggaggagaagggcatcgagctggcctacctggagcagctgcacggccagcacgaggcctggctgatccacaagaccaccaagctgcactttgaggccctgatgaacatccctgtgctggtgctggatgtgaatgatgacttcagcgaggaggtgaccaagcaggaggacctgatgagggaggtgaacacctttgtgaagaacctgtag

SEQ ID NO: 149796 - DNA, 570 bp, Artificial Sequence
  Description of Artificial Sequence: Synthetic coding sequence
atggctgctggccgcctcttcctgagccggctgcgggcccccttcagctccatggccaagagccccctggagggcgtgagcagcagccggggcctgcacgccggccggggcccccggcggctgagcattgagggcaacattgctgtgggcaagagcacctttgtgaagctgctgaccaagacctacccagagtggcacgtggccacagagcctgtggccacctggcagaacatccaggccgccggcacccagaaggcctgcacagcccagagcctgggcaacctgctggacatgatgtaccgggagcccgcccgctggagctacaccttccagaccttctccttcctgagccggctgaaggtgcagctggagcccttccctgagaagctgctgcaggccaggaagcctgtgcagatctttgagaggtctgtgtacagcgaccggctgcactttgaggccctgatgaacatccctgtgctggtgctggatgtgaatgatgacttcagcgaggaggtgaccaagcaggaggacctgatgagggaggtgaacacctttgtgaagaacctgtag

SEQ ID NO: 149797 - DNA, 768 bp, Artificial Sequence
  Description of Artificial Sequence: Synthetic coding sequence
atggctgctggccgcctcttcctgagccggctgcgggcccccttcagctccatggccaagagccccctggagggcgtgagcagcagccggggcctgcacgccggccggggcccccggcggctgagcattgagggcaacatcggcaacatcctgaagcagatccgcatgagggcccccatccaggagacagcctgcacagcccagagcctgggcaacctgctggacatgatgtaccgggagcccgcccgctggagctacaccttccagaccttctccttcctgagccggctgaaggtgcagctggagcccttccctgagaagctgctgcaggccaggaagcctgtgcagatctttgagaggtctgtgtacagcgaccgctacatctttgccaagaacctgtttgaaaatggcagcctgagtgacatcgagtggcacatctaccaggactggcacagcttcctgctgtgggagtttgccagccgcatcaccctgcacggcttcatctacctgcaggccagcccccaggtgtgcctgaagaggctgtaccagagggcccgggaggaggagaagggcatcgagctggcctacctggagcagctgcacggccagcacgaggcctggctgatccacaagaccaccaagctgcactttgaggccctgatgaacatccctgtgctggtgctggatgtgaatgatgacttcagcgaggaggtgaccaagcaggaggacctgatgagggaggtgaacacctttgtgaagaacctgtag

SEQ ID NO: 149798 - DNA, 1416 bp, Artificial Sequence
  Description of Artificial Sequence: Synthetic coding sequence
atggccaagaaggtggccgtcatcggggccggcgtgtctggcctcatcagcctgaagtgctgcgtggatgagggcctggagcccacctgctttgagaggacagaagatattggaggagtgtggaggttcaaggaaaatgtggaggatggccgggccagcatctaccagagcgtggtgaccaacaccagcaaggagatgagctgcttcagtgacttccccatgcctgaggacttccccaacttcctgcacaacagcaagctgctggagtacttccgcatctttgccaagaagtttgacctgctgaagtacatccagttccagaccaccgtgctgtctgtgaggaaatgtcctgacttcagcagcagcggccagtggaaggtggtgacccagagcaatggcaaggagcagagcgctgtgtttgatgctgtgatggtgtgcagcggccaccacatcctgccccacatccccctgaagagcttccctggcatggagcgcttcaagggccagtacttccacagccggcagtacaagcacccagatggctttgagggcaagaggatcctggtgattggcatgggcaacagcggcagtgacattgctgtggagctgagcaagaatgctgcccaggtgttcatcagcaccaggcatggcacctgggtgatgagccgcatcagtgaagatggctacccctgggacagcgtcttccacacccgcttccgctccatgctgagaaatgtgctgcccaggacagctgtgaagtggatgattgagcagcagatgaaccgctggttcaaccatgaaaattatggcctggagccccagaacaagtacatcatgaaggagcctgtgctgaatgatgatgtgcccagccggctgctgtgtggggccatcaaggtgaagagcacagtgaaggagctgacagagaccagcgccatctttgaagatggcaccgtggaggagaacattgatgtgatcatctttgccaccggctacagcttctccttccccttcctggaggacagcctggtgaaggtggagaacaacatggtgtccctgtacaagtacatcttccctgcccacctggacaagagcaccctggcctgcatcggcctcatccagcccctgggcagcatcttccccacagctgagctgcaggcccgctgggtgaccagggtcttcaagggcctgtgcagcctgcccagcgagaggaccatgatgatggacatcatcaagagaaatgagaagagaattgacctgtttggagagagccagagccagaccctgcagaccaactacgtggactacctggatgagctggccctggagattggagccaagccagacttctgcagcctgctcttcaaggaccccaagctggccgtgcggctgtacttcggcccctgcaacagctactag

SEQ ID NO: 149799 - DNA, 969 bp, Artificial Sequence
  Description of Artificial Sequence: Synthetic coding sequence
atggagggcagcctggagcgggaggccccagctggggccctggccgctgtgctgaagcacagcagcaccctgcccccagagagcacccaggtgcggggctatgacttcaacagaggagtgaactaccgggccctgctggaggccttcggcaccaccggcttccaggccaccaactttggccgggctgtgcagcaggtgaatgccatgattgagaagaagctggagcccctgagccaggatgaggaccagcacgccgacctgacccagagcagaagacccctgaccagctgcaccatcttcctgggctacaccagcaacctgatcagcagcggcatccgggagaccatccgctacctggtgcagcacaacatggtggatgtgctggtgaccacagctgggggcgtggaggaggacctgatcaagtgcctggcccccacctacctgggggagttcagcctgcggggcaaggagctgcgggagaatggcatcaaccgcatcggcaacctgctggtgcccaatgaaaactactgcaagtttgaggactggctgatgcccatcctggaccagatggtgatggagcagaacacagagggcgtgaagtggacccccagcaagatgattgcccggctgggcaaggagatcaacaaccctgagagcgtgtactactgggcccagaagaaccacatccctgtgttcagccctgccctgacagatggcagcctgggggacatgatcttcttccacagctacaagaaccctggcctggtgctggacatcgtggaggcccaggagtttgatggcagtgacagcggggcccggccagatgaagctgtgtcctggggcaagatccgggtggatgcccagcctgtgaaggtgtatgcagatgccagcctggtgttccccctgctggtggccgagacctttgcccagaagatggatgccttcatgcatgagaagaatgaagattag

SEQ ID NO: 149800 - DNA, 984 bp, Artificial Sequence
  Description of Artificial Sequence: Synthetic coding sequence
atgcccatcatcccagccttctgggaggccgaggccggcggcagccgggaggaggagtttgagaccagcctggccaacatgattgagaagaagctggagcccctgagccaggatgaggaccagcacgccgacctgacccagagcagaagacccctgaccagctgcaccatcttcctgggctacaccagcaacctgatcagcagcggcatccgggagaccatccgctacctggtgcagcacaacatggtggatgtgctggtgaccacagctgggggcgtggaggaggacctgatcaagtgcctggcccccacctacctgggggagttcagcctgcggggcaaggagctgcgggagaatggcatcaaccgcatcggcaacctgctggtgcccaatgaaaactactgcaagtttgaggactggctgatgcccatcctggaccagatggtgatggagcagaacacagagggcgtgaagtggacccccagcaagatgattgcccggctgggcaaggagatcaacaaccctgagagcgtgtactactgggcccagaagaaccacatccctgtgttcagccctgccctgacagatggcagcctgggggacatgatcttcttccacagctacaagaaccctggcctggtgctggacatcgtggaggacctgcggctcatcaacacccaggccatctttgccaagtgcaccggcatgatcatcctgggcggcggcgtggtgaagcaccacatcgccaatgccaacctgatgagaaatggagctgactatgctgtgtacatcaacacagcccaggagtttgatggcagtgacagcggggcccggccagatgaggccgtgtcctggggcaagatccgggtggatgcccagcctgtgaaggtgtatgcagatgccagcctggtgttccccctgctggtggccgagacctttgcccagaagatggatgccttcatgcatgagaagaatgaagattag

SEQ ID NO: 149801 - DNA, 462 bp, Artificial Sequence
  Description of Artificial Sequence: Synthetic coding sequence
atgccccagctgtgcacccgggccagcagcagcgagatccctggccgcctgctgaccaccctgcagagcgcccagggccagaagttcctgcactttgccaagagtgacagcttcctggatgacatctttgctgcctggatggcccagaggctgaagacccacctgctgacagagacctggcagaggaagaggcaggagctgcccagcaactgcagcctgccctaccacgtgtacaacatcaaggccatcaagctgagccgccacagctacttcagcagctaccaggaccacgccaagtggtgcatcagccagaagggcaccaagaaccgctggacctgcatcggggacctgaacagaagcccccaccaggccttccgcagcggcggcttcatctgcacccagaactggcagatctaccaggccttccagggcctggtgctgtactatgagagctgcaagtag

SEQ ID NO: 149802 - DNA, 1086 bp, Artificial Sequence
  Description of Artificial Sequence: Synthetic coding sequence
atgaagcagaagatgatggcccggctgctgcggaccagctttgccctgctcttcctgggcctgtttggagtgctgggcgccgccaccatcagctgcagaaatgaggagggcaaggctgtggactggttcaccttctacaagctgcccaagaggcagaacaaggagagcggggagaccggcctggagtacctgtacctggacagcaccaccaggtcctggaggaagtctgagcagctgatgaatgacaccaagtctgtgctgggccgcaccctgcagcagctgtatgaggcctatgccagcaagagcaacaacacagcctacctgatctacaatgatggagtgcccaagcctgtgaactacagcaggaaatatggccacaccaagggcctgctgctgtggaacagagtgcagggcttctggctgatccacagcatcccccagtttcctcccatccctgaggagggctatgactacccacccactggaagaagaaatggccagagcggcatctgcatcaccttcaagtacaaccagtatgaggccatcgacagccagctgctggtgtgcaaccccaacgtgtacagctgcagcatcccagccaccttccaccaggagctgatccacatgccccagctgtgcacccgggccagcagcagcgagatccctggccgcctgctgaccaccctgcagagcgcccagggccagaagttcctgcactttgccaagagtgacagcttcctggatgacatctttgctgcctggatggcccagaggctgaagacccacctgctgacagagacctggcagaggaagaggcaggagctgcccagcaactgcagcctgccctaccacgtgtacaacatcaaggccatcaagctgagccgccacagctacttcagcagctaccaggaccacgccaagtggtgcatcagccagaagggcaccaagaaccgctggacctgcatcggggacctgaacagaagcccccaccaggccttccgcagcggcggcttcatctgcacccagaactggcagatctaccaggccttccagggcctggtgctgtactatgagagctgcaagtag

SEQ ID NO: 149803 - DNA, 1317 bp, Artificial Sequence
  Description of Artificial Sequence: Synthetic coding sequence
atggccctgcggggcgtgtctgtgcggctgctgagccggggccctggcctgcacgtgctgcggacctgggtgagcagcgctgcccagacagagaagggcggccgcacccagagccagctggccaagagcagcaggcctgagtttgactggcaggaccccctggtgctggaggagcagctgaccacagatgagatcctgatccgggacaccttccgcacctactgccaggagcggctgatgccccgcatcctgctggccaacagaaatgaggtgttccaccgggagatcatcagcgagatgggagagctgggcgtgctgggccccaccatcaagggctacggctgtgccggcgtgtcctctgtggcctacggcctgctggcccgggagctggagcgggtggacagcggctacagaagtgccatgtctgtgcagagcagcctggtgatgcaccccatctatgcctacggcagcgaggagcagaggcagaagtacctgccccagctggccaagggggagctgctgggctgcttcggcctgacagagcccaacagcggcagtgaccccagctccatggagacccgggcccactacaacagcagcaacaagagctacaccctgaatggcaccaagacctggatcaccaacagccccatggctgacctgtttgtggtgtgggcccgctgtgaagatggctgcatccggggcttcctgctggagaagggcatgaggggcctgagcgccccccgcatccagggcaagttcagcctgcgggccagcgccaccggcatgatcatcatggatggagtggaggtgcctgaggagaatgtgctgcccggggccagcagcctgggcggccccttcggctgcctgaacaatgcccgctatggaattgcctggggcgtgctgggcgccagcgagttctgcctgcacacagcccggcagtatgccctggacaggatgcagtttggagtgcccctggccaggaaccagctgatccagaagaagctggccgacatgctgacagagatcaccctgggcctgcacgcctgcctgcagctgggccgcctgaaggaccaggacaaggccgcccctgagatggtgtccctgctgaagaggaacaactgtgggaaggccctggacatcgcccggcaggcccgggacatgctgggcggcaatggcatcagtgatgagtaccacgtgatcagacatgccatgaacctggaggccgtgaacacctatgagggcacccatgacatccacgccctgatcctgggccgggccatcaccggcatccaggccttcaccgccagcaagtag

SEQ ID NO: 149804 - DNA, 918 bp, Artificial Sequence
  Description of Artificial Sequence: Synthetic coding sequence
atgatccccctgctgctggccgccctgctgtgtgtgcctgctggggccctgacctgctacggggacagcggccagcctgtggactggtttgtggtgtacaagctgcctgccctgcggggcagcggggaggccgcccagaggggcctgcagtacaagtacctggatgagagcagcggcggctggagagatggccgggccctgatcaacagccctgagggcgctgtgggccgcagcctgcagcccctgtaccgcagcaacaccagccagctggccttcctgctgtacaatgaccagcccccccagcccagcaaggcccaggacagctccatgaggggccacaccaagggcaagcagctgacctacacctacccctgggtgtacaactaccagctggagggcatctttgcccaggagttcccagacctggagaatgtggtgaagggccaccacgtgtcccaggagccctggaacagcagcatcaccctgaccagccaggccggggctgtgttccagagctttgccaagttcagcaagtttggagatgacctgtacagcggctggctggccgccgccctgggcaccaacctgcaggtgcagttctggcacaagacagtgggcatcctgcccagcaactgcagcgacatctggcaggtgctgaatgtgaaccagatcgccttccctggccctgctggccccagcttcaacagcacagaggaccacagcaagtggtgtgtgagccccaagggcccctggacctgtgtgggggacatgaacagaaaccagggcgaggagcagagaggaggcggcaccctgtgtgcccagctgcctgccctgtggaaggccttccagcccctggtgaagaactaccagccctgcaatggcatggccaggaagcccagccgggcctacaagatctag

SEQ ID NO: 149805 - DNA, 909 bp, Artificial Sequence
  Description of Artificial Sequence: Synthetic coding sequence
atgcactaccccacagccctgctcttcctgatcctggccaacggggcccaggccttccgcatctgtgccttcaatgcccagaggctgaccctggccaaggtggcccgggagcaggtgatggacaccctggtgcgcatcctggcccgctgtgacatcatggtgctgcaggaggtggtggacagcagcggcagcgccatccccctgctgctgcgggagctgaacagatttgatggcagcggcccctacagcaccctgagcagcccccagctgggccgcagcacctacatggagacctacgtgtacttctaccgcagccacaagacccaggtgctgagcagctatgtgtacaatgatgaagatgatgtgtttgcccgggagccctttgtggcccagttcagcctgcccagcaatgtgctgcccagcctggtgctggtgcccctgcacaccacccccaaggctgtggagaaggagctgaatgccctgtatgatgtgttcctggaggtgtcccagcactggcagagcaaggatgtgatcctgctgggggacttcaatgctgactgtgccagcctgaccaagaagaggctggacaagctggagctgaggacagagcccggcttccactgggtgattgctgatggagaggacaccaccgtgcgggccagcacccactgcacctatgacagagtggtgctgcacggggagcgctgccgcagcctgctgcacacagctgctgcctttgacttccccaccagcttccagctgacagaggaggaggccctgaacatcagtgaccactaccctgtggaggtggagctgaagctgagccaggcccacagcgtgcagcccctgagcctgactgtgctgctgctgctgagcctgctgagcccccagctgtgcccagctgcctag

SEQ ID NO: 149806 - DNA, 909 bp, Artificial Sequence; identical to SEQ ID NO: 149805
  Description of Artificial Sequence: Synthetic coding sequence

SEQ ID NO: 149807 - DNA, 909 bp, Artificial Sequence; identical to SEQ ID NO: 149805
  Description of Artificial Sequence: Synthetic coding sequence

SEQ ID NO: 149808 - DNA, 909 bp, Artificial Sequence; identical to SEQ ID NO: 149805
  Description of Artificial Sequence: Synthetic coding sequence

SEQ ID NO: 149809 - DNA, 909 bp, Artificial Sequence; identical to SEQ ID NO: 149805
  Description of Artificial Sequence: Synthetic coding sequence

SEQ ID NO: 149810 - DNA, 909 bp, Artificial Sequence; identical to SEQ ID NO: 149805
  Description of Artificial Sequence: Synthetic coding sequence

SEQ ID NO: 149811 - DNA, 315 bp, Artificial Sequence
  Description of Artificial Sequence: Synthetic coding sequence
atgcactaccccacagccctgctcttcctgatcctggccaacggggcccaggccttccgcatctgtgccttcaatgcccagaggctgaccctggccaaggtggcccgggagcaggtgatggacaccctggtgcgcatcctggcccgctgtgacatcatggtgctgcaggaggtggtggacagcagcggcagcgccatccccctgctgctgcgggagctgaacagatttgatggcagcggcccctacagcaccctgagcagcccccagctgggccgcagcacctacatggagacctacgtgtacttctacagatag

SEQ ID NO: 149812 - DNA, 81 bp, Artificial Sequence
  Description of Artificial Sequence: Synthetic coding sequence
atgcactaccccacagccctgctcttcctgatcctggccaacggggcccaggccttccgcatctgtgccttcaatgcctag

SEQ ID NO: 149813 - DNA, 627 bp, Artificial Sequence
  Description of Artificial Sequence: Synthetic coding sequence
atgcactaccccacagccctgctcttcctgatcctggccaacggggcccaggccttccgcatctgtgccttcaatgcccagaggctgaccctggccaaggtggcccgggagcaggtgatggacaccctggtgcgcatcctggcccgctgtgacatcatggtgctgcaggaggtggtggacagcagcggcagcgccatccccctgctgctgcgggagctgaacagatttgatggcagcggcccctacagcaccctgagcagcccccagctgggccgcagcacctacatggagacctacgtgtacttctaccgcagccacaagacccaggtgctgagcagctatgtgtacaatgatgaagatgatgtgtttgcccgggagccctttgtggcccagttcagcctgcccagcaatgtgctgcccagcctggtgctggtgcccctgcacaccacccccaaggctgtggagaaggagctgaatgccctgtatgatgtgttcctggaggtgtcccagcactggcagagcaaggatgtgatcctgctgggggacttcaatgctgactgtgccagcctgaccaagaagaggctggacaagctggagctgaggacagagcccggcttccactggtag

SEQ ID NO: 149814 - DNA, 918 bp, Artificial Sequence
  Description of Artificial Sequence: Synthetic coding sequence
atgagccgggagctggcccccctgctgctgctgctgctgagcatccacagcgccctggccatgaggatctgcagcttcaacgtgcgcagctttggagagagcaagcaggaggacaagaatgccatggatgtgattgtgaaggtgatcaagagatgtgacatcatcctggtgatggagatcaaggacagcaacaaccgcatctgccccatcctgatggagaagctgaacagaaacagccggcggggcatcacctacaactacgtgatcagcagccggctgggcaggaacacctacaaggagcagtatgccttcctgtacaaggagaagctggtgtctgtgaagaggagctaccactaccatgactaccaggatggagatgctgatgtgttcagccgggagccctttgtggtgtggttccagagcccccacacagctgtgaaggactttgtgatcatccccctgcacaccaccccagagacctctgtgaaggagattgatgagctggtggaggtgtacacagatgtgaagcaccgctggaaggccgagaacttcatcttcatgggagacttcaatgccggctgcagctatgtgcccaagaaggcctggaagaacatccggctgaggacagaccccaggtttgtgtggctgattggagaccaggaggacaccaccgtgaagaagagcaccaactgtgcctatgaccgcatcgtgctgcggggccaggagatcgtgtcctctgtggtgcccaagagcaacagcgtgtttgacttccagaaggcctacaagctgacagaggaggaggccctggatgtgtctgaccacttccctgtggagttcaagctgcagagcagccgggccttcaccaacagcaagaagtctgtgaccctgaggaagaagaccaagagcaagaggagctag

SEQ ID NO: 149815 - DNA, 918 bp, Artificial Sequence; identical to SEQ ID NO: 149814
  Description of Artificial Sequence: Synthetic coding sequence

SEQ ID NO: 149816 - DNA, 867 bp, Artificial Sequence
  Description of Artificial Sequence: Synthetic coding sequence
atgagccgggagctggcccccctgctgctgctgctgctgagcatccacagcgccctggccatgaggatctgcagcttcaacgtgcgcagctttggagagagcaagcaggaggacaagaatgccatggatgtgattgtgaaggtgatcaagagatgtgacatcatcctggtgatggagatcaaggacagcaacaaccgcatctgccccatcctgatggagaagctgaacagaaacagccggcggggcatcacctacaactacgtgatcagcagccggctgggcaggaacacctacaaggagcagtatgccttcctgtacaaggagaagctggtgtctgtgaagaggagctaccactaccatgactaccaggatggagatgctgatgtgttcagccgggagccctttgtggtgtggttccagagcccccacacagctgtgaaggactttgtgatcatccccctgcacaccaccccagagacctctgtgaaggagattgatgagctggtggaggtgtacacagatgtgaagcaccgctggaaggccgagaacttcatcttcatgggagacttcaatgccggctgcagctatgtgcccaagaaggcctggaagaacatccggctgaggacagaccccaggtttgtgtggctgattggagaccaggaggacaccaccgtgaagaagagcaccaactgtgcctatgaccgcatcgtgctgcggggccaggagatcgtgtcctctgtggtgcccaagagcaacagcgtgtttgacttccagaaggcctacaagctgacagaggaggaggtgcggctgcccagctgcctgtccatgcccctgtcctggaaggatgagctggcctgggccacctag

SEQ ID NO: 149817 - DNA, 303 bp, Artificial Sequence
  Description of Artificial Sequence: Synthetic coding sequence
atgagccgggagctggcccccctgctgctgctgctgctgagcatccacagcgccctggccatgaggatctgcagcttcaacgtgcgcagctttggagagagcaagcaggaggacaagaatgccatggatgtgattgtgaaggtgatcaagagatgtgacatcatcctggtgatggagatcaaggacagcaacaaccgcatctgccccatcctgatggagaagctgaacagaaacagccggcggggcatcacctacaactacgtgatcagcagccggctgggcaggaacacctacaaggagtag

SEQ ID NO: 149818 - DNA, 828 bp, Artificial Sequence
  Description of Artificial Sequence: Synthetic coding sequence
atgagccgggagctggcccccctgctgctgctgctgctgagcatccacagcgccctggccatgaggatctgcagcttcaacgtgcgcagctttggagagagcaagcaggaggacaagaatgccatggatgtgattgtgaaggtgatcaagagatgtgacatcatcctggtgatggagatcaaggacagcaacaaccgcatctgccccatcctgatggagaagctgaaccgggagaagctggtgtctgtgaagaggagctaccactaccatgactaccaggatggagatgctgatgtgttcagccgggagccctttgtggtgtggttccagagcccccacacagctgtgaaggactttgtgatcatccccctgcacaccaccccagagacctctgtgaaggagattgatgagctggtggaggtgtacacagatgtgaagcaccgctggaaggccgagaacttcatcttcatgggagacttcaatgccggctgcagctatgtgcccaagaaggcctggaagaacatccggctgaggacagaccccaggtttgtgtggctgattggagaccaggaggacaccaccgtgaagaagagcaccaactgtgcctatgaccgcatcgtgctgcggggccaggagatcgtgtcctctgtggtgcccaagagcaacagcgtgtttgacttccagaaggcctacaagctgacagaggaggaggccctggatgtgtctgaccacttccctgtggagttcaagctgcagagcagccgggccttcaccaacagcaagaagtctgtgaccctgaggaagaagaccaagagcaagaggagctag

SEQ ID NO: 149819 - DNA, 753 bp, Artificial Sequence
  Description of Artificial Sequence: Synthetic coding sequence
atgacccccctgtgccccaggcctgccctgtgctaccacttcctgaccagcctgctgcggagcgccatgcagaatgccaggacagctgagggccgcagccggggcaccctgcgggcccggcctgcccccaggcctgctgcccagcacggcatcccccggcccctgagcagcgctggccgcctgagccagggctgccgcggggccagcacagtgggcgccgccggctggaagggggagctgcccaaggccggcggcagccctgcccctggccctgagaccccagccatcagccccagcaagagggcccggcctgctgaggtgggcggcatgcagctgcgctttgcccggctgtctgagcacgccacagcccccacccggggcagcgcccgggccgccggctatgacctgtacagcgcctatgactacaccatcccccccatggagaaggctgtggtgaagacagacatccagatcgccctgcccagcggctgctacggccgggtggcccccaggagcggcctggccgccaagcacttcattgatgtgggcgctggggtgattgatgaggactacagaggaaatgtgggcgtggtgctcttcaactttgggaaggagaagtttgaggtgaagaagggggacagaattgcccagctgatctgtgagcgcatcttctacccagaaattgaggaggtgcaggccctggatgacacagagcggggcagcggcggcttcggcagcacaggcaagaactag

SEQ ID NO: 149820 - DNA, 759 bp, Artificial Sequence
  Description of Artificial Sequence: Synthetic coding sequence
atgacccccctgtgccccaggcctgccctgtgctaccacttcctgaccagcctgctgcggagcgccatgcagaatgcccggggggcccggcagagagctgaggccgctgtgctgagcggccctggcccccccctgggccgggccgcccagcacggcatcccccggcccctgagcagcgctggccgcctgagccagggctgccgcggggccagcacagtgggcgccgccggctggaagggggagctgcccaaggccggcggcagccctgcccctggccctgagaccccagccatcagccccagcaagagggcccggcctgctgaggtgggcggcatgcagctgcgctttgcccggctgtctgagcacgccacagcccccacccggggcagcgcccgggccgccggctatgacctgtacagcgcctatgactacaccatcccccccatggagaaggctgtggtgaagacagacatccagatcgccctgcccagcggctgctacggccgggtggcccccaggagcggcctggccgccaagcacttcattgatgtgggcgctggggtgattgatgaggactacagaggaaatgtgggcgtggtgctcttcaactttgggaaggagaagtttgaggtgaagaagggggacagaattgcccagctgatctgtgagcgcatcttctacccagaaattgaggaggtgcaggccctggatgacacagagcggggcagcggcggcttcggcagcacaggcaagaactag

SEQ ID NO: 149821 - DNA, 495 bp, Artificial Sequence
  Description of Artificial Sequence: Synthetic coding sequence
atgccctgcagcgaggagaccccagccatcagccccagcaagagggcccggcctgctgaggtgggcggcatgcagctgcgctttgcccggctgtctgagcacgccacagcccccacccggggcagcgcccgggccgccggctatgacctgtacagcgcctatgactacaccatcccccccatggagaaggctgtggtgaagacagacatccagatcgccctgcccagcggctgctacggccgggtggcccccaggagcggcctggccgccaagcacttcattgatgtgggcgctggggtgattgatgaggactacagaggaaatgtgggcgtggtgctcttcaactttgggaaggagaagtttgaggtgaagaagggggacagaattgcccagctgatctgtgagcgcatcttctacccagaaattgaggaggtgcaggccctggatgacacagagcggggcagcggcggcttcggcagcacaggcaagaactag

SEQ ID NO: 149822 - DNA, 426 bp, Artificial Sequence
  Description of Artificial Sequence: Synthetic coding sequence
atgcagctgcgctttgcccggctgtctgaacatgccacagcccccacccggggcagcgcccgggctgctggctatgacctgtacagcgcctatgactacaccatcccccccatggagaaggctgtggtgaagacagacatccagatcgccctgcccagcggctgctacggccgggtggcccccaggagcggcctggccgccaagcacttcattgatgtgggcgctggggtgattgatgaggactacagaggaaatgtgggcgtggtgctcttcaactttgggaaggagaagtttgaggtgaagaagggggaccgcatcgcccagctgatctgtgagcgcatcttctacccagaaattgaggaggtgcaggccctggatgacacagagcggggcagcggcggcttcggcagcacaggcaagaactag

SEQ ID NO: 149823 - DNA, 1056 bp, Artificial Sequence
  Description of Artificial Sequence: Synthetic coding sequence
atgcccctgaggaagcaccggcagcacttcaagaagtatggcaactgcttcaccgctggggaggccgtggactggctgtatgacctgctgaggaacaacagcaactttggacctgaggtgacccggcagcagaccatccagctgctgaggaagttcctgaagaaccacgtgattgaggacatcaagggccgctggggctctgaaaatgtggatgacaacaaccagctgttccgcttccctgccaccagccccctgaagaccctgcccaggaggacccccaagagacatggcctgcacctgagccaggagaatggagagaagatcaagcatgagatcatcaatgaagaccaggagaatgccatcgacaaccgggagctgagccaggaggatgtggaggaggtgtggaggtatgtgatcctgatctacctgcagaccatcctgggcgtgcccagcctggaggaggtgatcaaccccaagcaggtgatcccccagtacatcatgtacaacatggccaacaccagcaagaggggcgtggtgatcctgcagaacaagagtgatgacctgccccactgggtgctgagcgccatgaagtgcctggccaactggcccaggagcaatgacatgaacaaccccacctacgtgggctttgaaagagatgtgttccgcaccatcgctgactacttcctggacctgcctgagcccctgctgacctttgagtactatgagctgtttgtgaacatcctgggcaacttcaaggacttccgcagcagcatccctgtggtgtgtggctacatcaccgtgtctgacaggagcagcggcatccacaagatccaggatgacccccagagcagcaagttcctgcacctgaacaacctgaacagcttcaagagcacagaatgtctgctgctgagcctgctgcaccgggagaagaacaaggaggagagtgacagcacagagcggctgcagatcagcaaccctggcttccaggagcgctgtgccaagaagatgcagctggtgaacctgaggaacagaagagcctgctgcaacctgatctag

SEQ ID NO: 149824 - DNA, 1584 bp, Artificial Sequence
  Description of Artificial Sequence: Synthetic coding sequence
atggagagccagggcgtgcccccaggcccctaccgggccaccaagctgtggaatgaggtgaccaccagcttccgggccggcatgcccctgaggaagcaccggcagcacttcaagaagtatggcaactgcttcaccgctggggaggccgtggactggctgtatgacctgctgaggaacaacagcaactttggacctgaggtgacccggcagcagaccatccagctgctgaggaagttcctgaagaaccacgtgattgaggacatcaagggccgctggggctctgaaaatgtggatgacaacaaccagctgttccgcttccctgccaccagccccctgaagaccctgccccggcgctacccagagctgaggaagaacaacatcgagaacttcagcaaggacaaggacagcatcttcaagctgaggaacctgagcaggaggacccccaagagacatggcctgcacctgagccaggagaatggagagaagatcaagcatgagatcatcaatgaagaccaggagaatgccatcgacaaccgggagctgagccaggaggatgtggaggaggtgtggaggtatgtgatcctgatctacctgcagaccatcctgggcgtgcccagcctggaggaggtgatcaaccccaagcaggtgatcccccagtacatcatgtacaacatggccaacaccagcaagaggggcgtggtgatcctgcagaacaagagtgatgacctgccccactgggtgctgagcgccatgaagtgcctggccaactggcccaggagcaatgacatgaacaaccccacctacgtgggctttgaaagagatgtgttccgcaccatcgctgactacttcctggacctgcctgagcccctgctgacctttgagtactatgagctgtttgtgaacatcctgggcctgctgcagccccacctggagcgggtggccattgatgccctgcagctgtgctgcctgctgctgcccccacccaacagaaggaagctgcagctgctgatgaggatgatcagcaggatgagccagaatgtggacatgcccaagctgcatgatgccatgggcaccaggagcctgatgatccacaccttcagccgctgtgtgctgtgctgtgccgaggaggtggacctggatgagctgctggccggccgcctggtgtccttcctgatggaccaccaccaggagatcctgcaggtgcccagctacctgcagacagctgtggagaagcacctggactacctgaagaagggccacatcgagaaccctggagatggcctgtttgcccccctgcccacctacagctactgcaagcagatcagcgcccaggagtttgatgagcagaaggtgtccaccagccaggccgccatcgccgagctgctggagaacatcatcaagaacagaagcctgcccctgaaggagaagaggaagaagctgaagcagttccagaaggagtaccccctcatctaccagaagcgcttccccaccacagagagcgaggccgccctgtttggagacaagcccaccatcaagcagcccatgctgatcctgaggaagcccaagttccgcagcctgaggtag

SEQ ID NO: 149825 - DNA, 2436 bp, Artificial Sequence
  Description of Artificial Sequence: Synthetic coding sequence
atggagagccagggcgtgcccccaggcccctaccgggccaccaagctgtggaatgaggtgaccaccagcttccgggccggcatgcccctgaggaagcaccggcagcacttcaagaagtatggcaactgcttcaccgctggggaggccgtggactggctgtatgacctgctgaggaacaacagcaactttggacctgaggtgacccggcagcagaccatccagctgctgaggaagttcctgaagaaccacgtgattgaggacatcaagggccgctggggctctgaaaatgtggatgacaacaaccagctgttccgcttccctgccaccagccccctgaagaccctgccccggcgctacccagagctgaggaagaacaacatcgagaacttcagcaaggacaaggacagcatcttcaagctgaggaacctgagcaggaggacccccaagagacatggcctgcacctgagccaggagaatggagagaagatcaagcatgagatcatcaatgaagaccaggagaatgccatcgacaaccgggagctgagccaggaggatgtggaggaggtgtggaggtatgtgatcctgatctacctgcagaccatcctgggcgtgcccagcctggaggaggtgatcaaccccaagcaggtgatcccccagtacatcatgtacaacatggccaacaccagcaagaggggcgtggtgatcctgcagaacaagagtgatgacctgccccactgggtgctgagcgccatgaagtgcctggccaactggcccaggagcaatgacatgaacaaccccacctacgtgggctttgaaagagatgtgttccgcaccatcgctgactacttcctggacctgcctgagcccctgctgacctttgagtactatgagctgtttgtgaacatcctggtggtgtgtggctacatcaccgtgtctgacaggagcagcggcatccacaagatccaggatgacccccagagcagcaagttcctgcacctgaacaacctgaacagcttcaagagcacagaatgtctgctgctgagcctgctgcaccgggagaagaacaaggaggagagtgacagcacagagcggctgcagatcagcaaccctggcttccaggagcgctgtgccaagaagatgcagctggtgaacctgaggaacagaagagtgtctgccaatgacatcatgggcggcagctgccacaacctgattggcctgagcaacatgcatgacctgagcagcaacagcaagccccgctgctgcagcctggagggcatcgtggatgtgcccggcaacagcagcaaggaggccagctctgtgttccaccagagcttccccaacatcgagggccagaacaacaagctgttcctggagagcaagcccaagcaggagttcctgctgaacctgcacagcgaggagaacatccagaagcccttctctgctggcttcaagaggaccagcaccctgactgtgcaggaccaggaggagctgtgcaatggcaagtgcaagagcaagcagctgtgccgcagccagagcctgctgctgcggagcagcaccaggagaaattcctacatcaacacccctgtggccgagatcatcatgaagcccaacgtgggccagggcagcacctctgtgcagacagccatggagagcgagctgggggagagcagcgccaccatcaacaagaggctgtgcaagagcaccatcgagctgtctgagaacagcctgctgcctgccagctccatgctgaccggcacccagagcctgctgcagccccacctggagcgggtggccattgatgccctgcagctgtgctgcctgctgctgcccccacccaacagaaggaagctgcagctgctgatgaggatgatcagcaggatgagccagaatgtggacatgcccaagctgcatgatgccatgggcaccaggagcctgatgatccacaccttcagccgctgtgtgctgtgctgtgccgaggaggtggacctggatgagctgctggccggccgcctggtgtccttcctgatggaccaccaccaggagatcctgcaggtgcccagctacctgcagacagctgtggagaagcacctggactacctgaagaagggccacatcgagaaccctggagatggcctgtttgcccccctgcccacctacagctactgcaagcagatcagcgcccaggagtttgatgagcagaaggtgtccaccagccaggccgccatcgccgagctgctggagaacatcatcaagaacagaagcctgcccctgaaggagaagaggaagaagctgaagcagttccagaaggagtaccccctcatctaccagaagcgcttccccaccacagagagcgaggccgccctgtttggagacaagcccaccatcaagcagcccatgctgatcctgaggaagcccaagttccgcagcctgaggtag

SEQ ID NO: 149826 - DNA, 1590 bp, Artificial Sequence
  Description of Artificial Sequence: Synthetic coding sequence
atggagcacagaattgtgggccctggcccctaccgggccacccggctgtggaatgagaccgtggagctgttccgggccaagatgcccctgaggaagcaccgctgccgcttcaagagctatgagcactgcttcaccgctgctgaggccgtggactggctgcacgagctgctgcgctgcagccagaactttggacctgaggtgaccaggaagcagacagtgcagctgctgaagaagttcctgaagaaccacgtgattgaggacatcaagggcaagtggggcgaggaggactttgaggacaacagacacctgtaccgcttcccccccagcagccccctgaagccctaccccaagaagccacccaaccagaaggatgtgatcaagtttcctgagtggaatgacctgcccccaggcaccagccaggagaacatccctgtgcggcctgtggtgatgaacagcgagatgtggtacaagaggcacagcatcgccatcggggaggtgcctgcctgccgcctggtgcaccggcggcagctgacagaggccaacgtggaggagatctggaagtccatgaccctgagctacctgcagaagatcctgggcctggacagcctggaggaggtgctggatgtgaagctggtgaacagcaagttcatcatccacaacgtgtacagcgtgtccaagcagggcgtggtgatcctggatgacaagagcaaggagctgccccactgggtgctgagcgccatgaagtgcctggccaactggcccaactgcagcgacctgaagcagcccatgtacctgggctttgagaaggatgtgttcaagaccatcgctgactactacggccacctgaaggagcccctgctgaccttccacctgtttgatgcctttgtgtctgtgctgggcctgctgcagaaggagaaggtggccgtggaggccttccagatctgctgcctgctgctgcccccagagaacagaaggaagctgcagctgctgatgaggatgatggcccgcatctgcctgaacaaggagatgccacccctgtgtgatggcttcggcaccaggaccctgatggtgcagaccttcagccgctgcatcctgtgcagcaaggatgaggtggacctggatgagctgctggccgcccggctggtgaccttcctgatggacaactaccaggagatcctgaaggtgcccctggccctgcagaccagcattgaggagcgggtggcccacctgcggcgggtgcagatcaagtacccaggagctgacatggacatcaccctgagcgcccccagcttctgccggcagatcagccctgaggagtttgagtaccagaggagctatggcagccaggagcccctggccgccctgctggaggaggtgatcacagatgccaagctgagcaacaaggagaagaagaagaagctgaagcagttccagaagagctacccagaggtgtaccaggagcgcttccccaccccagagagcgctgccctgctcttccctgagaagcccaagcccaagccccagctgctgatgtgggccctgaagaagcccttccagcccttccagaggaccaggagcttcaggatgtag

SEQ ID NO: 149827 - DNA, 1404 bp, Artificial Sequence
  Description of Artificial Sequence: Synthetic coding sequence
atggagcacagaattgtgggccctggcccctaccgggccacccggctgtggaatgagaccgtggagctgttccgggccaagatgcccctgaggaagcaccgctgccgcttcaagagctatgagcactgcttcaccgctgctgaggccgtggactggctgcacgagctgctgcgctgcagccagaactttggacctgaggtgaccaggaagcagacagtgcagctgctgaagaagttcctgaagaaccacgtgattgaggacatcaagggcaagtggggcgaggaggactttgaggacaacagacacctgtaccgcttcccccccagcagccccctgaagccctaccccaagaagccacccaaccagaaggatgtgatcaagtttcctgagtggaatgacctgcccccaggcaccagccaggagaacatccctgtgcggcctgtggtgatgaacagcgagatgtggtacaagaggcacagcatcgccatcggggaggtgcctgcctgccgcctggtgcaccggcggcagctgacagaggccaacgtggaggagatctggaagtccatgaccctgagctacctgcagaagatcctgggcctggacagcctggaggaggtgctggatgtgaagctggtgaacagcaagttcatcatccacaacgtgtacagcgtgtccaagcagggcgtggtgatcctggatgacaagagcaaggagctgccccactgggtgctgagcgccatgaagtgcctggccaactggcccaactgcagcgacctgaagcagcccatgtacctgggctttgagaaggatgtgttcaagaccatcgctgactactacggccacctgaaggagcccctgctgaccttccacctgtttgatgcctttgtgtctgtgctgggcctgctgcagaaggagaaggtggccgtggaggccttccagatctgctgcctgctgctgcccccagagaacagaaggaagctgcagctgctgatgaggatgatggcccgcatctgcctgaacaaggagatgccacccctgtgtgatggcttcggcaccaggaccctgatggtgcagaccttcagccgctgcatcctgtgcagcaaggatgaggtggacctggatgagctgctggccgcccggctggtgaccttcctgatggacaactaccaggagatcctgaaggtgcccctggccctgcagaccagcattgaggagcgggtggcccacctgcggcgggtgcagttccagaagagctacccagaggtgtaccaggagcgcttccccaccccagagagcgctgccctgctcttccctgagaagcccaagcccaagccccagctgctgatgtgggccctgaagaagcccttccagcccttccagaggaccaggagcttcaggatgtag

SEQ ID NO: 149828 - DNA, 1323 bp, Artificial Sequence
  Description of Artificial Sequence: Synthetic coding sequence
atgcccctgaggaagcaccgctgccgcttcaagagctatgagcactgcttcaccgctgctgaggccgtggactggctgcacgagctgctgcgctgcagccagaactttggacctgaggtgaccaggaagcagacagtgcagctgctgaagaagttcctgaagaaccacgtgattgaggacatcaagggcaagtggggcgaggaggactttgaggacaacagacacctgtaccgcttcccccccagcagccccctgaagccctaccccaagaagccacccaaccagaaggatgtgatcaagtttcctgagtggaatgacctgcccccaggcaccagccaggagaacatccctgtgcggcctgtggtgatgaacagcgagatgtggtacaagaggcacagcatcgccatcggggaggtgcctgcctgccgcctggtgcaccggcggcagctgacagaggccaacgtggaggagatctggaagtccatgaccctgagctacctgcagaagatcctgggcctggacagcctggaggaggtgctggatgtgaagctggtgaacagcaagttcatcatccacaacgtgtacagcgtgtccaagcagggcgtggtgatcctggatgacaagagcaaggagctgccccactgggtgctgagcgccatgaagtgcctggccaactggcccaactgcagcgacctgaagcagcccatgtacctgggctttgagaaggatgtgttcaagaccatcgctgactactacggccacctgaaggagcccctgctgaccttccacctgtttgatgcctttgtgtctgtgctgggcctgctgcagaaggagaaggtggccgtggaggccttccagatctgctgcctgctgctgcccccagaaaatagaaggaagctgcagctgctgatgaggatgatggcccgcatctgcctgaacaaggagatgccacccctgtgtgatggcttcggcaccaggaccctgatggtgcagaccttcagccgctgcatcctgtgcagcaaggatgaggtggacctggatgagctgctggccgcccggctggtgaccttcctgatggacaactaccaggagatcctgaaggtgcccctggccctgcagaccagcattgaggagcgggtggcccacctgcggcgggtgcagttccagaagagctacccagaggtgtaccaggagcgcttccccaccccagagagcgctgccctgctcttccctgagaagcccaagcccaagccccagctgctgatgtgggccctgaagaagcccttccagcccttccagaggaccaggagcttcaggatgtag

SEQ ID NO: 149829 - DNA, 4746 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggccccagcggggaggccatccagatccaccaccagacccggcagaacatggccgagctgcagggcagcggccagagggaccccacccacagcagcgctgagctgctggagctggcctaccacgaggccgccggccgccacagcaacagccggcagcctggagatggcatgtccttcctgaacttcagcggcacagaggagctgtctgtgggcctgctgagcaacagcggggccggcatgaaccccaggacccagaacaaggacagcctggaggacagcgtgtccaccagcccagaccccatcctgaccctgagcgcccctcctgtggtgcccggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgaaagtgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctcatcgagagcctgaagttctggaggacccgcttcctgctgctgcctgcctgtgtgacagccaccaagaggatcacagaaggagaggcccactgtgacatctatggagaccggcccagggcagatgaagatgagtggcagctgctggatggctttgtgcgctttgtggagggcctgaaccgcatcagaagaagacacagaagtgacaggatgatgaggaagggcacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcacggcggcaagagcagcgcccagagcgctgagagcagctctgtggccatgacccccacctacatggacagccccaggaaggtgtctgtggaccagacagccacccccatgctggatggcaccagcctgggcatctgcaccggccagagcatggaccggggcaacagccagaccttcggcaacagccagaacatcggggagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccaccgcttcggctttgtgcaggacaagtacagcgccagcgccttcaacttccctgctgagaacaagccccagtacatccacgtgacaggcaccgtcttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149830 - DNA, 3690 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggcatgaaccccaggacccagaacaaggacagcctggaggacagcgtgtccaccagcccagaccccatcctgaccctgagcgcccctcctgtggtgcccggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgaaagtgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctcatcgagagcctgaagttctggaggacccgcttcctgctgctgcctgcctgtgtgacagccaccaagaggatcacagaaggagaggcccactgtgacatctatggagaccggcccagggcagatgaagatgagtggcagctgctggatggctttgtgcgctttgtggagggcctgaaccgcatcagaagaagacacagaagtgacaggatgatgaggaagggcacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcacggcggcaagagcagcgcccagagcgctgagagcagctctgtggccatgacccccacctacatggacagccccaggaaggatggagccttcttcatggagtttgtgcgcagccccaggacagccagcagcgccttctacccccaggtgtctgtggaccagacagccacccccatgctggatggcaccagcctgggcatctgcaccggccagagcatggaccggggcaacagccagaccttcggcaacagccagaacatcggggagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagtggccctgcagcagccccccacctcctggcacccagcaggagtggaccaccagccctgccagcagcgccagcggcctgcgctggcccctgtggcagaagagcagctgcaccctgcgcttcctgcccttcagctgccccggctgcctggccggccagccccccatgcaggtgggcacagcccccctggccgaggtgctggaggatggagcccggcggcagcacttctag

SEQ ID NO: 149831 - DNA, 4512 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtggagaccagctgcttctacctgagcatcggcatgaaccccaggacccagaacaaggacagcctggaggacagcgtgtccaccagcccagaccccatgcctggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgaaagtgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctcatcgagagcctgaagttctggaggacccgcttcctgctgctgcctgcctgtgtgacagccaccaagaggatcacagaaggagaggcccactgtgacatctatggagaccggcccagggcagatgaagatgagtggcagctgctggatggctttgtgcgctttgtggagggcctgaaccgcatcagaagaagacacagaagtgacaggatgatgaggaagggcacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcacggcggcaagagcagcgcccagagcgctgagagcagctctgtggccatgacccccacctacatggacagccccaggaaggtgtctgtggaccagacagccacccccatgctggatggcaccagcctgggcatctgcaccggccagagcatggaccggggcaacagccagaccttcggcaacagccagaacatcggggagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccaccgcttcggctttgtgcaggacaagtacagcgccagcgccttcaacttccctgctgagaacaagccccagtacatccacgtgacaggcaccgtcttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149832 - DNA, 1680 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcacccgggagcacctgggctag

SEQ ID NO: 149833 - DNA, 4659 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggccccagcggggaggccatccagatccaccaccagacccggcagaacatggccgagctgcagggcagcggccagagggaccccacccacagcagcgctgagctgctggagctggcctaccacgaggccgccggccgccacagcaacagccggcagcctggagatggcatgtccttcctgaacttcagcggcacagaggagctgtctgtgggcctgctgagcaacagcggggccggcatgaaccccaggacccagaacaaggacagcctggaggacagcgtgtccaccagcccagaccccatcctgaccctgagcgcccctcctgtggtgcccggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgaaagtgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctcatcgagagcctgaagttctggaggacccgcttcctgctgctgcctgcctgtgtgacagccaccaagaggatcacagaaggagaggcccactgtgacatctatggagaccggcccagggcagatgaagatgagtggcagctgctggatggctttgtgcgctttgtggagggcctgaaccgcatcagaagaagacacagaagtgacaggatgatgaggaagggcacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcacggcggcaagagcagcgcccagagcgctgagagcagctctgtggccatgacccccacctacatggacagccccaggaaggatggagccttcttcatggagtttgtgcgcagccccaggacagccagcagcgccttctacccccaggtgtctgtggaccagacagccacccccatgctggatggcaccagcctgggcatctgcaccggccagagcatggaccggggcaacagccagaccttcggcaacagccagaacatcggggagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagcctgggcctgtacaagatcaacatcctgcccctgctgctgaccagcctgctgcggaccagcctgagcatcagcaccctgcaggagcagtgcttctgcagctgccccaccccatctgccagcagccagggcagcagcggcggcggcggcaccccaccagccccacccaccaggacctgcagcgcccggagcggcagcgccaccaccggccccaccaccccctgcagccccaagcatggagccccagccccccagggcatgaagagcctgctgattggctgctag

SEQ ID NO: 149834 - DNA, 4719 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggccccagcggggaggccatccagatccaccaccagacccggcagaacatggccgagctgcagggcagcggccagagggaccccacccacagcagcgctgagctgctggagctggcctaccacgaggccgccggccgccacagcaacagccggcagcctggagatggcatgtccttcctgaacttcagcggcacagaggagctgtctgtgggcctgctgagcaacagcggggccggcatgaaccccaggacccagaacaaggacagcctggaggacagcgtgtccaccagcccagaccccatgcctggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgagagcgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctgattgagagcctgaagttctggaggacccgcttcctgctgctgcctgcctgtgtgacagccaccaagaggatcacagaaggagaggcccactgtgacatctacggggaccggcccagggcagatgaagatgagtggcagctgctggatggctttgtgcgctttgtggagggcctgaaccgcatcagaagaagacacagaagtgacaggatgatgaggaaaggaacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcatggaggcaagagcagcgcccagagcgctgagagcagctctgtggccatgacccccacctacatggacagccccaggaaggtgtctgtggaccagacagccacccccatgctggatggcaccagcctgggcatctgcaccggccagagcatggaccggggcaacagccagacctttggaaacagccagaacattggagagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccacagatttggatttgtgcaggacaagtacagcgccagcgccttcaacttccctgctgagaacaagccccagtacatccacgtgactggaacagtgttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149835 - DNA, 4719 bp, Artificial Sequence; identical to SEQ ID NO: 149834
  Description of Artificial Sequence: Synthetic coding sequence

SEQ ID NO: 149836 - DNA, 138 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaactag

SEQ ID NO: 149837 - DNA, 4512 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggcatgaaccccaggacccagaacaaggacagcctggaggacagcgtgtccaccagcccagaccccatcctgaccctgagcgcccctcctgtggtgcccggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgaaagtgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctcatcgagagcctgaagttctggaggacccgcttcctgctgctgcctgcctgtgtgacagccaccaagaggatcacagaaggagaggcccactgtgacatctatggagaccggcccagggcagatgaagatgagtggcagctgctggatggctttgtgcgctttgtggagggcctgaaccgcatcagaagaagacacagaagtgacaggatgatgaggaagggcacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcacggcggcaagagcagcgcccagagcgctgagagcagctctgtggccatgacccccacctacatggacagccccaggaaggtgtctgtggaccagacagccacccccatgctggatggcaccagcctgggcatctgcaccggccagagcatggaccggggcaacagccagaccttcggcaacagccagaacatcggggagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccaccgcttcggctttgtgcaggacaagtacagcgccagcgccttcaacttccctgctgagaacaagccccagtacatccacgtgacaggcaccgtcttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149838 - DNA, 1995 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggcatgaaccccaggacccagaacaaggacagcctggaggacagcgtgtccaccagcccagaccccagcaagaggggccagctgaccggggagcggggccggcagggcgtgtggggcggccagagcatgaggaagcaggaggaggccctgtgggaggtgtctggccctgaggtgcacatccccctgggctacggcaaggccatgtggtag

SEQ ID NO: 149839 - DNA, 1263 bp, Artificial Sequence
  Description of Artificial Sequence: Synthetic coding sequence
atgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccacagatttggatttgtgcaggacaagtacagcgccagcgccttcaacttccctgctgagaacaagccccagtacatccacgtgactggaacagtgttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149840 - DNA, 4785 bp, Artificial Sequence
  Description of Artificial Sequence: Synthetic coding sequence
atgaggaccaccaaggtgtacaagctggtgatccacaagaagggctttggaggcagtgatgatgagctggtggtgaaccccaaggtgttcccccacatcaagctgggggacatcgtggagatcgcccaccccaatgatgagtacagccccctgctgctgcaggtgaagagcctgaaggaggacctgcagaaggagaccatctctgtggaccagacagtgacccaggtgttccggctgcggccctaccaggatgtgtatgtgaatgtggtggaccccaaggatgtgaccctggacctggtggagctgaccttcaaggaccagtacatcggccgcggggacatgtggaggctgaagaagagcctggtgtccacctgtgcctacatcacccagaaggtggagtttgctggcatccgggcccaggccggggagctgtgggtgaagaatgagaaggtgatgtgtggctacatcagcgaggacaccagggtggtgttccgcagcaccagcgccatggtgtacatcttcatccagatgagctgtgagatgtgggactttgacatctatggagacctgtactttgagaaggctgtgaatggcttcctggccgacctcttcaccaagtggaaggagaagaactgcagccatgaggtgacagtggtgctcttcagcaggaccttctatgatgccaagtctgtggatgagttccctgagatcaacagagccagcatccggcaggaccacaagggccgcttctatgaggacttctacaaggtggtggtgcagaatgaaagaagagaggagtggaccagcctgctggtgaccatcaagaagctgttcatccagtaccctgtgctggtgcggctggagcaggccgagggcttcccccagggcgacaacagcaccagcgcccagggcaactacctggaggccatcaacctgtccttcaacgtgtttgacaagcactacatcaacagaaactttgacagaacaggccagatgtctgtggtgatcaccccaggagtgggcgtgtttgaggtggaccggctgctgatgatcctgaccaagcagaggatgattgacaatggcatcggcgtggacctggtgtgcatgggagagcagcccctgcatgctgtgcccctcttcaagctgcacaacagaagtgccccccgggacagccggctgggagatgactacaacatcccccactggatcaaccacagcttctacaccagcaagagccagctgttctgcaacagcttcaccccccgcatcaagctggccggcaagaagccagccagcgagaaggccaagaatggccgggacaccagcctgggcagccccaaggagagtgaaaatgccctgcccatccaggtggactatgatgcctatgatgcccaggtgttccggctgcccggccccagccgggcccagtgcctgaccacctgccgctctgtgcgggagcgggagagccacagcaggaagagcgccagcagctgtgatgtgagcagcagccccagcctgcccagcaggaccctgcccacagaggaggtgcgcagccaggccagtgatgacagcagcctgggcaagagcgccaacatcctgatgatcccccacccccacctgcaccagtatgaggtgagcagcagcctgggctacaccagcaccagagatgtgctggagaacatgatggagcccccccagagggacagcagcgcccctggccgcttccacgtgggcagcgctgagagcatgctgcacgtgcggcctgggggctacaccccccagagggccctgatcaacccctttgcccccagcaggatgcccatgaagctgaccagcaacagaagacgctggatgcacaccttccctgtgggccccagcggggaggccatccagatccaccaccagacccggcagaacatggccgagctgcagggcagcggccagagggaccccacccacagcagcgctgagctgctggagctggcctaccacgaggccgccggccgccacagcaacagccggcagcctggagatggcatgtccttcctgaacttcagcggcacagaggagctgtctgtgggcctgctgagcaacagcggggccggcatgaaccccaggacccagaacaaggacagcctggaggacagcgtgtccaccagcccagaccccatgcctggcttctgctgcaccgtgggcgtggactggaagagcctgaccaccccagcctgcctgcccctgaccacagactacttcccagaccggcagggcctgcagaatgactacacagagggctgctatgacctgctgcctgaggccgacatcgacagaagagatgaagatggagtgcagatgacagcccagcaggtgtttgaggagttcatctgccagaggctgatgcagggctaccagatcatcgtgcagcccaagacccagaagcccaacccagctgtgcccccacccctgagcagcagccccctgtacagccggggcctggtgtccaggaacagacctgaggaggaggaccagtactggctgtccatgggccgcaccttccacaaggtgaccctgaaggacaagatgatcaccgtgacccgctacctgcccaagtacccctatgagagcgcccagatccactacacctacagcctgtgccccagccacagcgacagcgagtttgtgtcctgctgggtggagttcagccatgagcggctggaggagtacaagtggaactacctggaccagtacatctgcagcgctggcagcgaggacttcagcctgattgagagcctgaagttctggaggacccgcttcctgctgctgcctgcctgtgtgacagccaccaagaggatcacagaaggagaggcccactgtgacatctacggggaccggcccagggcagatgaagatgagtggcagctgctggatggctttgtgcgctttgtggagggcctgaaccgcatcagaagaagacacagaagtgacaggatgatgaggaaaggaacagccatgaagggcctgcagatgacaggccccatcagcacccacagcctggagagcacagcccctcctgtgggcaagaagggcaccagcgccctgagcgccctgctggagatggaggccagccagaagtgcctgggggagcagcaggccgctgtgcatggaggcaagagcagcgcccagagcgctgagagcagctctgtggccatgacccccacctacatggacagccccaggaaggatggagccttcttcatggagtttgtgcgcagccccaggacagccagcagcgccttctacccccaggtgtctgtggaccagacagccacccccatgctggatggcaccagcctgggcatctgcaccggccagagcatggaccggggcaacagccagacctttggaaacagccagaacattggagagcagggctacagcagcaccaacagcagtgacagcagcagccagcagctggtggccagcagcctgaccagcagcagcaccctgacagagatcctggaggccatgaagcaccccagcactggagtgcagctgctgtctgagcagaagggcctgagcccctactgcttcatctctgctgaggtggtgcactggctggtgaaccacgtggagggcatccagacccaggccatggccatcgacatcatgcagaagatgctggaggagcagctgatcacccacgccagcggggaggcctggaggaccttcatctacggcttctacttctacaagatcgtgacagacaaggagccagacagagtggccatgcagcagcctgccaccacctggcacacagctggggtggatgactttgccagcttccagaggaagtggtttgaggtggcctttgtggccgaggagctggtgcacagcgagatcccagccttcctgctgccctggctgcccagcaggcctgccagctatgccagccgccacagcagcttcagccgcagctttggaggccgcagccaggccgccgccctgctggccgccaccgtgcctgagcagaggacagtgaccctggatgtggatgtgaacaacagaacagaccggctggagtggtgcagctgctactaccacggcaacttcagcctgaatgctgcctttgagatcaagctgcactggatggctgtgacagctgctgtgctgtttgagatggtgcagggctggcacaggaaggccaccagctgtggcttcctgctggtgcctgtgctggagggcccctttgccctgcccagctacctgtatggagaccccctgcgggcccagctgttcatccccctgaacatcagctgcctgctgaaggagggcagcgagcacctgtttgacagctttgagcctgagacctactgggacaggatgcacctgttccaggaggccatcgcccacagatttggatttgtgcaggacaagtacagcgccagcgccttcaacttccctgctgagaacaagccccagtacatccacgtgactggaacagtgttcctgcagctgccctacagcaagaggaagttcagcggccagcagaggagaagaagaaacagcaccagcagcaccaaccagaacatgttctgtgaggagcgggtgggctacaactgggcctacaacaccatgctgaccaagacctggaggagcagcgccactggagatgagaagtttgctgaccggctgctgaaggacttcacagacttctgcatcaacagagacaaccggctggtgaccttctggaccagctgcctggagaagatgcacgccagcgccccctag

SEQ ID NO: 149841 - DNA, 1536 bp, Artificial Sequence
  Description of Artificial Sequence: Synthetic coding sequence
atggccaccgtgcaggagaaggctgctgccctgaacctgagcgccctgcacagccctgcccacaggcctcctggcttctctgtggcccagaagccctttggagccacctacgtgtggagcagcatcatcaacaccctgcagacccaggtggaggtgaagaagagaagacaccggctgaagaggcacaatgactgctttgtgggcagcgaggccgtggatgtgatcttcagccacctgatccagaacaagtactttggagatgtggacatcccccgggccaaggtggtgcgggtgtgccaggccctgatggactacaaggtgtttgaggccgtgcccaccaaggtgtttgggaaggacaagaagcccacctttgaggacagcagctgcagcctgtaccgcttcaccaccatccccaaccaggacagccagctgggcaaggagaacaagctgtacagccctgcccgctatgcagatgccctcttcaagagcagtgacatccgcagcgccagcctggaggacctgtgggagaacctgagcctgaagccagccaacagcccccacgtgaacatcagcgccaccctgagcccccaggtgatcaatgaggtgtggcaggaggagaccatcggccgcctgctgcagctggtggacctgcccctgctggacagcctgctgaagcagcaggaggccgtgcccaagatcccccagcccaagaggcagagcaccatggtgaacagcagcaactacctggaccggggcatcctgaaggcctacagcgacagccaggaggatgagtggctgtctgctgccatcgactgcctggagtacctgcctgaccagatggtggtggagatcagccgctccttccctgagcagcctgacagaacagacctggtgaaggagctgctgtttgatgccatcggccgctactacagcagccgggagcccctgctgaaccacctgagtgatgtgcacaatggaattgctgagctgctggtgaatggcaagacagagatcgccctggaggccacccagctgctgctgaagctgctggacttccagaaccgggaggagttccggcggctgctgtacttcatggctgtggccgccaaccccagcgagttcaagctgcagaaggagagtgacaacaggatggtggtgaagaggatcttcagcaaggccatcgtggacaacaagaacctgagcaagggcaagacagacctgctggtgctcttcctgatggaccaccagaaggatgtgttcaagatccctggcaccctgcacaagatcgtgtctgtgaagctgatggccatccagaatggccgggaccccaacagagatgctggctacatctactgccagagaattgaccagagggactacagcaacaacacagagaagaccaccaaggatgagctgctgaacctgctgaagaccctggatgaggacagcaagctgagcgccaaggagaagaagaagctgctgggccagttctacaagtgccacccagacatcttcatcgagcactttggagactag

SEQ ID NO: 149842 - DNA, 1509 bp, Artificial Sequence
  Description of Artificial Sequence: Synthetic coding sequence
atgaggggcctgtgtgagttctactggcaggagtttggcatcaagggcttctctgtggcccagaagccctttggagccacctacgtgtggagcagcatcatcaacaccctgcagacccaggtggaggtgaagaagaggaggcaccggctgaagaggcacaatgactgctttgtgggcagcgaggccgtggatgtgatcttcagccacctgatccagaacaagtactttggagatgtggacatcccccgggccaaggtggtgcgggtgtgccaggccctgatggactacaaggtgtttgaagctgtgcccaccaaggtgtttgggaaggacaagaagcccacctttgaggacagcagctgcagcctgtaccgcttcaccaccatccccaaccaggacagccagctgggcaaggagaacaagctgtacagccctgcccgctatgcagatgccctcttcaagagcagtgacatccgcagcgccagcctggaggacctgtgggagaacctgagcctgaagccagccaacagcccccacgtgaacatcagcgccaccctgagcccccaggtgatcaatgaggtgtggcaggaggagaccatcggccgcctgctgcagctggtggacctgcccctgctggacagcctgctgaagcagcaggaggccgtgcccaagatcccccagcccaagaggcagagcaccatggtgaacagcagcaactacctggaccggggcatcctgaaggcctacagcgacagccaggaggatgagtggctgtctgctgccatcgactgcctggagtacctgcctgaccagatggtggtggagatcagccgctccttccctgagcagcctgacagaacagacctggtgaaggagctgctgtttgatgccatcggccgctactacagcagccgggagcccctgctgaaccacctgagtgatgtgcacaacggcattgctgagctgctggtgaatggcaagacagaaattgccctggaggccacccagctgctgctgaagctgctggacttccagaaccgggaggagttccggcggctgctgtacttcatggctgtggccgccaaccccagcgagttcaagctgcagaaggagagtgacaacaggatggtggtgaagaggatcttcagcaaggccatcgtggacaacaagaacctgagcaagggcaagacagacctgctggtgctcttcctgatggaccaccagaaggatgtgttcaagatccctggcaccctgcacaagatcgtgtctgtgaagctgatggccatccagaatggccgggaccccaacagagatgctggctacatctactgccagagaattgaccagagggactacagcaacaacacagagaagaccaccaaggatgagctgctgaacctgctgaagaccctggatgaggacagcaagctgagcgccaaggagaagaagaagctgctgggccagttctacaagtgccacccagacatcttcatcgagcactttggagactag

SEQ ID NO: 149843 - DNA, 1230 bp, Artificial Sequence
  Description of Artificial Sequence: Synthetic coding sequence
atggaggagggcggcagcactggatctgctggcagtgacagcagcaccagcggcagcggcggggcccagcagcgggagctggagaggatggccgaggtgctggtgactggagagcagctgcggctgcggctgcacgaggagaaggtgatcaaggacagaagacaccacctgaagacctaccccaactgctttgtggccaaggagctgattgactggctgattgagcacaaggaggccagtgaccgggagacagccatcaagctgatgcagaagctggccgaccggggcatcatccaccacgtgtgtgatgagcacaaggagttcaaggatgtgaagctgttctaccgcttcaggaaggatgatggcaccttccccctggacaatgaggtgaaggccttcatgaggggccagaggctgtatgagaagctgatgagccctgagaacaccctgctgcagccccgggaggaggagggcgtgaagtatgaaagaaccttcatggccagcgagttcctggactggctggtgcaggagggggaggccaccaccaggaaggaggccgagcagctgtgccaccggctgatggagcacggcatcatccagcacgtgagcaacaagcacccctttgtggacagcaacctgctgtaccagttcaggatgaacttcagaagaagaagaaggctgatggagctgctgaatgagaagagccccagcagccaggagacccatgacagccccttctgcctgaggaagcagagccatgacaacaggaagagcaccagcttcatgtctgtgagccccagcaaggagatcaagatcgtgtctgctgtgagaagaagctccatgagcagctgtggcagcagcggctacttcagcagcagccccaccctgagcagcagcccccctgtgctgtgcaaccccaagtctgtgctgaagaggcctgtgaccagcgaggagctgctgacccctggggccccctatgccaggaagaccttcaccatcgtgggagatgctgtgggctggggctttgtggtgcggggcagcaagccctgccacatccaggccgtggaccccagcggccctgctgctgctgctggcatgaaggtgtgccagtttgtggtgtctgtgaatggcctgaatgtgctgcacgtggactacagaacagtgagcaacctgatcctgaccggccccaggaccatcgtgatggaggtgatggaggagctggagtgctag

SEQ ID NO: 149844 - DNA, 2877 bp, Artificial Sequence
  Description of Artificial Sequence: Synthetic coding sequence
atgaggacccacaccaggggggcccccagcgtcttcttcatctacctgctgtgctttgtgtctgcctacatcacagatgaaaatcctgaggtgatgatccccttcaccaatgccaactatgacagccaccccatgctgtacttcagcagagctgaggtggccgagctgcagctgcgggccgccagcagccatgagcacatcgccgcccggctgacagaggccgtgcacaccatgctgagcagccccctggagtacctgcccccctgggaccccaaggactacagcgcccgctggaatgagatcttcggcaacaacctgggcgccctggccatgttctgtgtgctgtacccagagaacatcgaggcccgggacatggccaaggactacatggagaggatggccgcccagcccagctggctggtgaaggatgccccctgggatgaggtgcccctggcccacagcctggtgggctttgccacagcctatgacttcctgtacaactacctgagcaagacccagcaggagaagttcctggaggtgattgccaatgccagcggctacatgtatgagaccagctaccgccggggctggggcttccagtacctgcacaaccaccagcccaccaactgcatggccctgctgaccggcagcctggtgctgatgaaccagggctacctgcaggaggcctacctgtggaccaagcaggtgctgaccatcatggagaagagcctggtgctgctgcgggaggtgacagatggcagcctgtatgagggcgtggcctacggcagctacaccaccaggagcctcttccagtacatgttcctggtgcagaggcacttcaacatcaaccacttcggccacccctggctgaagcagcactttgccttcatgtaccgcaccatcctgcccggcttccagaggacagtggccatcgctgacagcaactacaactggttctacggccctgagagccagctggtgttcctggacaagtttgtgatgagaaatggcagcggcaactggctggccgaccagatcagaagaaacagagtggtggagggccctggcacccccagcaagggccagcgctggtgcaccctgcacacagagttcctgtggtatgatggcagcctgaagtctgtgcccccaccagactttggcacccccaccctgcactactttgaggactggggcgtggtgacctacggcagcgccctgcctgctgagatcaacagaagcttcctgtccttcaagagcggcaagctgggcggccgggccatctatgacatcgtgcacaggaacaagtacaaggactggatcaagggctggaggaacttcaatgccggccacgagcacccagaccagaacagcttcacctttgccccaaatggagtgcccttcatcacagaggccctgtatggccccaagtacaccttcttcaacaacgtgctgatgttcagccctgctgtgtccaagagctgcttcagcccctgggtgggccaggtgacagaggactgcagcagcaagtggagcaagtacaagcatgacctggccgccagctgccagggccgggtggtggccgctgaggagaagaatggagtggtgttcatccggggggagggcgtgggcgcctacaacccccagctgaacctgaagaatgtgcagaggaacctgatcctgctgcacccccagctgctgctgctggtggaccagatccacctgggggaggagagccccctggagacagctgccagcttcttccacaacgtggatgtgccctttgaggagaccgtggtggatggagtgcatggagccttcatccggcagagagatggcctgtacaagatgtactggatggatgacaccggctacagcgagaaggccacctttgcctctgtgacctacccccggggctacccctacaacggcaccaactacgtgaatgtgaccatgcacctgcggagccccatcacccgggccgcctacctgttcatcggccccagcattgatgtgcagagcttcaccgtgcatggagacagccagcagctggatgtgttcatcgccaccagcaagcacgcctatgccacctacctgtggacaggagaggccaccggccagagcgcctttgcccaggtgattgctgacagacacaagatcctgtttgacagaaattctgccatcaagagcagcatcgtgcctgaggtgaaggactatgctgccatcgtggagcagaacctgcagcacttcaagcctgtgttccagctgctggagaagcagatcctgagccgggtgaggaacacagccagcttcaggaagacagctgagcggctgctgcgcttcagtgacaagaggcagacagaggaggccatcgaccgcatctttgccatcagccagcagcagcagcagcagagcaagagcaagaagaacagaagagctgggaagcgctacaagtttgtggatgctgtgcctgacatctttgcccagatcgaggtgaatgagaagaagatccggcagaaggcccagatcctggcccagaaggagctgcccattgatgaagatgaggagatgaaggacctgctggactttgctgatgtgacctatgagaagcacaagaatggaggcctcatcaagggccgcttcggccaggccaggatggtgaccaccacccacagccgggcccccagcctgagcgccagctacaccaggctcttcctgatcctgaacatcgccatcttctttgtgatgctggccatgcagctgacctacttccagagggcccagagcctgcacggccagcgctgcctgtatgctgtgctgctgattgacagctgcatcctgctgtggctgtacagcagctgcagccagagccagtgctag

SEQ ID NO: 149845 - DNA, 2877 bp, Artificial Sequence; identical to SEQ ID NO: 149844
  Description of Artificial Sequence: Synthetic coding sequence

SEQ ID NO: 149846 - DNA, 501 bp, Artificial Sequence
  Description of Artificial Sequence: Synthetic coding sequence
atgaggacccacaccaggggggcccccagcgtcttcttcatctacctgctgtgctttgtgtctgcctacatcacagatgaaaatcctgaggtgatgatccccttcaccaatgccaactatgacagccaccccatgctgtacttcagcagagctgaggtggccgagctgcagctgcgggccgccagcagccatgagcacatcgccgcccggctgacagaggccgtgcacaccatgctgagcagccccctggagtacctgcccccctgggaccccaaggactacagcgcccgctggaatgagatcttcggcaacaacctgggcgccctggccatgttctgtgtgctgtacccagagaacatcgaggcccgggacatggccaaggactacatggagaggatggccgcccagcccagctggctggtgaaggatgccccctgggatgaggtgcccctggcccacagcctggtgggctttgccacagcctatgacttcctgtactag

SEQ ID NO: 149847 - DNA, 2877 bp, Artificial Sequence; identical to SEQ ID NO: 149844
  Description of Artificial Sequence: Synthetic coding sequence

SEQ ID NO: 149848 - DNA, 2934 bp, Artificial Sequence
  Description of Artificial Sequence: Synthetic coding sequence
atgggcagctttgaagatggcctggccgccctggagatctggaggagtgatgccaccatgaggacccacaccaggggggcccccagcgtcttcttcatctacctgctgtgctttgtgtctgcctacatcacagatgagaaccctgaggtgatgatccccttcaccaatgccaactatgacagccaccccatgctgtacttcagcagagctgaggtggccgagctgcagctgcgggccgccagcagccatgagcacatcgccgcccggctgacagaagctgtgcacaccatgctgagcagccccctggagtacctgcccccctgggaccccaaggactacagcgcccgctggaatgagatctttggaaacaacctgggcgccctggccatgttctgtgtgctgtacccagaaaatattgaggcccgggacatggccaaggactacatggagaggatggccgcccagcccagctggctggtgaaggatgccccctgggatgaggtgcccctggcccacagcctggtgggctttgccacagcctatgacttcctgtacaactacctgagcaagacccagcaggagaagttcctggaggtgattgccaatgccagcggctacatgtatgagaccagctacagaagaggctggggcttccagtacctgcacaaccaccagcccaccaactgcatggccctgctgaccggcagcctggtgctgatgaaccagggctacctgcaggaggcctacctgtggaccaagcaggtgctgaccatcatggagaagagcctggtgctgctgcgggaggtgacagatggcagcctgtatgaaggagtggcctacggcagctacaccaccaggagcctcttccagtacatgttcctggtgcagaggcacttcaacatcaaccacttcggccacccctggctgaagcagcactttgccttcatgtaccgcaccatcctgcccggcttccagaggacagtggccatcgctgacagcaactacaactggttctacggccctgagagccagctggtgttcctggacaagtttgtgatgagaaatggaagtggcaactggctggccgaccagatcagaagaaacagagtggtggagggccctggcacccccagcaagggccagcgctggtgcaccctgcacacagagttcctgtggtatgatggcagcctgaagtctgtgcccccaccagactttggcacccccaccctgcactactttgaggactggggcgtggtgacctacggcagcgccctgcctgctgagatcaacagaagcttcctgtccttcaagagcggcaagctgggcggccgggccatctatgacatcgtgcacaggaacaagtacaaggactggatcaagggctggaggaacttcaatgccggccacgagcacccagaccagaacagcttcacctttgcccccaacggggtgcccttcatcacagaggccctgtatggccccaagtacaccttcttcaacaacgtgctgatgttctccccagctgtgtccaagagctgcttcagcccctgggtgggccaggtgacagaggactgcagcagcaagtggagcaagtacaagcatgacctggccgccagctgccagggccgggtggtggccgctgaggagaagaatggagtggtgttcatccggggggagggcgtgggcgcctacaacccccagctgaacctgaagaatgtgcagaggaacctgatcctgctgcacccccagctgctgctgctggtggaccagatccacctgggggaggagagccccctggagacagctgccagcttcttccacaacgtggatgtgccctttgaggagaccgtggtggatggagtgcacggggccttcatccggcagagagatggcctgtacaagatgtactggatggatgacaccggctacagcgagaaggccacctttgcctctgtgacctacccccggggctacccctacaacggcaccaactacgtgaatgtgaccatgcacctgcggagccccatcaccagggctgcctacctgttcatcggccccagcattgatgtgcagagcttcaccgtgcacggggacagccagcagctggatgtgttcatcgccaccagcaagcacgcctatgccacctacctgtggacaggagaggccaccggccagagcgcctttgcccaggtgattgctgacagacacaagatcctgtttgacaggaacagcgccatcaagagcagcatcgtgcctgaggtgaaggactatgctgccatcgtggagcagaacctgcagcacttcaagcctgtgttccagctgctggagaagcagatcctgagccgggtgaggaacacagccagcttcaggaagacagctgagcggctgctgcgcttcagtgacaagaggcagacagaggaggccatcgaccgcatctttgccatcagccagcagcagcagcagcagagcaagagcaagaagaacagaagagctgggaagcgctacaagtttgtggatgctgtgcctgacatctttgcccagatcgaggtgaatgagaagaagatccggcagaaggcccagatcctggcccagaaggagctgcccattgatgaagatgaggagatgaaggacctgctggactttgctgatgtgacctatgagaagcacaagaatggaggcctcatcaagggccgcttcggccaggccaggatggtgaccaccacccacagccgggcccccagcctgagcgccagctacaccaggctcttcctgatcctgaacatcgccatcttctttgtgatgctggccatgcagctgacctacttccagagggcccagagcctgcacggccagcgctgcctgtatgctgtgctgctgattgacagctgcatcctgctgtggctgtacagcagctgcagccagagccagtgctag

SEQ ID NO: 149849 - DNA, 570 bp, Artificial Sequence
  Description of Artificial Sequence: Synthetic coding sequence
atggccgccctgaagggccggcaggtgtactgggccacagctgggaagatcagcggctggacctggccccacgccccccggcggccccacgtgctgctgctgaatggaattggagtgggcggggccctgggcagcattgatgagctgctgtgccaggccctgagcaatggcctgaatgtgcctgagggcagcctgaccagcacctgtgcccagcagccagatggcctcatccacacagccaagtggggccacgtgcacagcctgagcagccacagccctggggccccaaatgcctgtggggtgctgcccggcaccaccgtggatgatggagtgcaccaggacctgcagagggtgctggcctgtgagcaggtgtatgacctggagggcatgctggatgatgcccacagccatgagctgctggccgtggtggccgctgtgcaccaccacggcgtgtccaaggccctgcacaacggcaccctgagctttgtggaggccttcggcggcatccccccctgcaccgtgcgcatcttccgccgctggtttggctgcctgggggacctggagatctag

SEQ ID NO: 149850 - DNA, 3669 bp, Artificial Sequence
  Description of Artificial Sequence: Synthetic coding sequence
atgcccaagggcggggccccaccctggatcatggccctgatgttcaccggccacctgctcttcctggccctgctgatgtttgccttcagcacctttgaggagagcgtgagcaactacagcgagtgggccgtgttcacagatgacatcgaccagttcaagacccagaaggtgcaggacttccggcccaaccagaagctgaagaagtccatgctgcaccccagcctgtactttgatgctggggagatccaggccatgaggcagaagagccgggccagccacctgcacctgttccgggccatccgctctgctgtgacagtgatgctgagcaaccccacctactacctgcccccacccaagcatgctgactttgctgccaagtggaatgagatctacggcaacaacctgccccccctggccctgtactgcctgctgtgcccagaggacaaggtggcctttgaatttgtgctggagtacatggacaggatggtgggctacaaggactggctggtggagaatgcccctggagatgaggtgcccatcggccacagcctgactggatttgccacagcctttgacttcctgtacaacctgctggacaaccaccggcggcagaagtacctggagaagatctgggtgatcacagaggagatgtatgagtacagcaaggtgcgctcctggggcaagcagctgctgcacaaccaccaggccaccaacatgattgccctgctgaccggggccctggtgactggagtggacaagggcagcaaggccaacatctggaagcaggccgtggtggatgtgatggagaagaccatgttcctgctgaaccacatcgtggatggcagcctggatgagggcgtggcctacggcagctacacagccaagtctgtgacccagtatgtgttcctggcccagaggcacttcaacatcaacaacctggacaacaactggctgaagatgcacttctggttctactatgccaccctgctgcccggcttccagaggacagtgggcattgctgacagcaactacaactggttctacggccctgagagccagctggtgttcctggacaagttcatcctgaagaatggagctggcaactggctggcccagcagatcaggaagcaccggcccaaggatggccccatggtgcccagcacagcccagcgctggagcaccctgcacacagagtacatctggtatgacccccagctgaccccccagcccccagctgactatggaacagccaagatccacaccttccccaactggggcgtggtgacctacggggccggcctgcccaacacccagaccaacacctttgtgtccttcaagagcggcaagctgggcggccgggctgtgtatgacatcgtgcacttccagccctacagctggattgatggctggaggagcttcaaccctggccacgagcacccagaccagaacagcttcacctttgcccccaacggccaggtgtttgtgtctgaggccctgtatggccccaagctgagccacctgaacaacgtgctggtgtttgcccccagccccagcagccagtgcaacaagccctgggagggccagctgggagaatgtgcccagtggctgaagtggacaggagaggaggtgggagatgctgctggggagatcatcacagccagccagcacggggagatggtgtttgtgtctggagaggccgtgtctgcctacagcagcgccatgaggctgaagtctgtgtaccgggccctgctgctgctgaacagccagaccctgctggtggtggaccacatcgagcggcaggaggacagccccatcaacagcgtgtctgccttcttccacaacctggacatcgacttcaagtacatcccctacaagttcatgaaccgctacaatggagccatgatggatgtgtgggatgcccactacaagatgttctggtttgaccaccacggcaacagccccatggccagcatccaggaggccgagcaggccgctgagttcaagaagcgctggacccagtttgtgaatgtgaccttccagatggagcccaccatcacccgcatcgcctacgtgttctacggcccctacatcaacgtgagcagctgccgcttcatcgacagcagcaaccctggcctgcagatcagcctgaatgtgaacaacacagaacatgtggtgtccatcgtgacagactaccacaacctgaagacccgcttcaactacctgggctttggaggctttgcctctgtggccgaccagggccagatcacccgcttcggcctgggcacccaggccatcgtgaagcctgtgagacatgaccgcatcatcttccccttcggcttcaagttcaacattgctgtgggcctcatcctgtgcatcagcctggtgatcctgaccttccagtggaggttctacctgtccttcaggaagctgatgcgctggatcctgatcctggtgattgccctgtggttcatcgagctgctggatgtgtggagcacctgcagccagcccatctgtgccaagtggaccaggacagaggccgagggcagcaagaagagcctgagcagcgagggccaccacatggacctgcctgatgtggtgatcaccagcctgcccggcagcggggctgagatcctgaagcagctgttcttcaacagcagtgacttcctgtacatccgggtgcccacagcctacatcgacatccctgagacagagctggagattgacagctttgtggatgcctgtgagtggaaggtgtctgacatccgcagcggccacttccggctgctgcggggctggctgcagagcctggtgcaggacaccaagctgcacctgcagaacatccacctgcacgagcccaacagaggcaagctggcccagtactttgccatgaacaaggacaagaagaggaagttcaagagaagagagagcctgcctgagcagaggagccagatgaagggggcctttgacagagatgctgagtacatccgggccctgcggcggcacctggtgtactaccccagcgcccggcctgtgctgagcctgagcagcggctcctggaccctgaagctgcacttcttccaggaggtgctgggcgcctccatgagggccctgtacatcgtgcgggacccccgggcctggatctacagcatgctgtacaacagcaagcccagcctgtacagcctgaagaatgtgcctgagcacctggccaagctgttcaagattgagggcggcaagggcaagtgcaacctgaacagcggctacgcctttgaatatgagcccctgaggaaggagctgagcaagagcaagagcaatgctgtgtccctgctgagccacctgtggctggccaacacagctgctgccctgcgcatcaacacagacctgctgcccaccagctaccagctggtgaagtttgaggacatcgtgcacttcccccagaagaccacagagcgcatctttgccttcctgggcatccccctgagccctgccagcctgaaccagatcctgtttgccaccagcaccaacctcttctacctgccctatgaaggagagatcagccccaccaacaccaacgtgtggaagcagaacctgcccagagatgagatcaagctgattgagaacatctgctggaccctgatggaccggctgggctaccccaagttcatggactag

SEQ ID NO: 149851 - DNA, 3639 bp, Artificial Sequence
  Description of Artificial Sequence: Synthetic coding sequence
atggccctgatgttcaccggccacctgctcttcctggccctgctgatgtttgccttcagcacctttgaggagagcgtgagcaactacagcgagtgggccgtgttcacagatgacatcgaccagttcaagacccagaaggtgcaggacttccggcccaaccagaagctgaagaagtccatgctgcaccccagcctgtactttgatgctggggagatccaggccatgaggcagaagagccgggccagccacctgcacctgttccgggccatccgctctgctgtgacagtgatgctgagcaaccccacctactacctgcccccacccaagcatgctgactttgctgccaagtggaatgagatctacggcaacaacctgccccccctggccctgtactgcctgctgtgcccagaggacaaggtggcctttgaatttgtgctggagtacatggacaggatggtgggctacaaggactggctggtggagaatgcccctggagatgaggtgcccatcggccacagcctgactggatttgccacagcctttgacttcctgtacaacctgctggacaaccaccggcggcagaagtacctggagaagatctgggtgatcacagaggagatgtatgagtacagcaaggtgcgctcctggggcaagcagctgctgcacaaccaccaggccaccaacatgattgccctgctgaccggggccctggtgactggagtggacaagggcagcaaggccaacatctggaagcaggccgtggtggatgtgatggagaagaccatgttcctgctgaaccacatcgtggatggcagcctggatgagggcgtggcctacggcagctacacagccaagtctgtgacccagtatgtgttcctggcccagaggcacttcaacatcaacaacctggacaacaactggctgaagatgcacttctggttctactatgccaccctgctgcccggcttccagaggacagtgggcattgctgacagcaactacaactggttctacggccctgagagccagctggtgttcctggacaagttcatcctgaagaatggagctggcaactggctggcccagcagatcaggaagcaccggcccaaggatggccccatggtgcccagcacagcccagcgctggagcaccctgcacacagagtacatctggtatgacccccagctgaccccccagcccccagctgactatggaacagccaagatccacaccttccccaactggggcgtggtgacctacggggccggcctgcccaacacccagaccaacacctttgtgtccttcaagagcggcaagctgggcggccgggctgtgtatgacatcgtgcacttccagccctacagctggattgatggctggaggagcttcaaccctggccacgagcacccagaccagaacagcttcacctttgcccccaacggccaggtgtttgtgtctgaggccctgtatggccccaagctgagccacctgaacaacgtgctggtgtttgcccccagccccagcagccagtgcaacaagccctgggagggccagctgggagaatgtgcccagtggctgaagtggacaggagaggaggtgggagatgctgctggggagatcatcacagccagccagcacggggagatggtgtttgtgtctggagaggccgtgtctgcctacagcagcgccatgaggctgaagtctgtgtaccgggccctgctgctgctgaacagccagaccctgctggtggtggaccacatcgagcggcaggaggacagccccatcaacagcgtgtctgccttcttccacaacctggacatcgacttcaagtacatcccctacaagttcatgaaccgctacaatggagccatgatggatgtgtgggatgcccactacaagatgttctggtttgaccaccacggcaacagccccatggccagcatccaggaggccgagcaggccgctgagttcaagaagcgctggacccagtttgtgaatgtgaccttccagatggagcccaccatcacccgcatcgcctacgtgttctacggcccctacatcaacgtgagcagctgccgcttcatcgacagcagcaaccctggcctgcagatcagcctgaatgtgaacaacacagaacatgtggtgtccatcgtgacagactaccacaacctgaagacccgcttcaactacctgggctttggaggctttgcctctgtggccgaccagggccagatcacccgcttcggcctgggcacccaggccatcgtgaagcctgtgagacatgaccgcatcatcttccccttcggcttcaagttcaacattgctgtgggcctcatcctgtgcatcagcctggtgatcctgaccttccagtggaggttctacctgtccttcaggaagctgatgcgctggatcctgatcctggtgattgccctgtggttcatcgagctgctggatgtgtggagcacctgcagccagcccatctgtgccaagtggaccaggacagaggccgagggcagcaagaagagcctgagcagcgagggccaccacatggacctgcctgatgtggtgatcaccagcctgcccggcagcggggctgagatcctgaagcagctgttcttcaacagcagtgacttcctgtacatccgggtgcccacagcctacatcgacatccctgagacagagctggagattgacagctttgtggatgcctgtgagtggaaggtgtctgacatccgcagcggccacttccggctgctgcggggctggctgcagagcctggtgcaggacaccaagctgcacctgcagaacatccacctgcacgagcccaacagaggcaagctggcccagtactttgccatgaacaaggacaagaagaggaagttcaagagaagagagagcctgcctgagcagaggagccagatgaagggggcctttgacagagatgctgagtacatccgggccctgcggcggcacctggtgtactaccccagcgcccggcctgtgctgagcctgagcagcggctcctggaccctgaagctgcacttcttccaggaggtgctgggcgcctccatgagggccctgtacatcgtgcgggacccccgggcctggatctacagcatgctgtacaacagcaagcccagcctgtacagcctgaagaatgtgcctgagcacctggccaagctgttcaagattgagggcggcaagggcaagtgcaacctgaacagcggctacgcctttgaatatgagcccctgaggaaggagctgagcaagagcaagagcaatgctgtgtccctgctgagccacctgtggctggccaacacagctgctgccctgcgcatcaacacagacctgctgcccaccagctaccagctggtgaagtttgaggacatcgtgcacttcccccagaagaccacagagcgcatctttgccttcctgggcatccccctgagccctgccagcctgaaccagatcctgtttgccaccagcaccaacctcttctacctgccctatgaaggagagatcagccccaccaacaccaacgtgtggaagcagaacctgcccagagatgagatcaagctgattgagaacatctgctggaccctgatggaccggctgggctaccccaagttcatggactag

SEQ ID NO: 149852 - DNA, 606 bp, Artificial Sequence
  Description of Artificial Sequence: Synthetic coding sequence
atggacctgagcctgctgtgggtgctgctgcccctggtgaccatggcctggggccagtacggggactatggctacccctaccagcagtaccatgactacagtgatgatggctgggtgaacctgaaccggcagggcttctcctaccagtgcccccagggccaggtgattgtggccgtgcgcagcatcttcagcaagaaggagggcagtgaccggcagtggaactatgcctgcatgcccaccccccagagcctgggggagcccacagagtgctggtgggaggagatcaacagagctggcatggagtggtaccagacctgcagcaacaacggcctggtggccggcttccagagccgctactttgagagcgtgctggaccgggagtggcagttctactgctgccgctacagcaagcgctgcccctacagctgctggctgaccacagagtacccaggccactatggagaggagatggacatgatctcctacaactatgactactacatccggggggccaccaccaccttctctgctgtggagcgggaccggcagtggaagttcatcatgtgcaggatgacagaatatgactgtgaatttgccaacgtgtag

SEQ ID NO: 149853 - DNA, 333 bp, Artificial Sequence
  Description of Artificial Sequence: Synthetic coding sequence
atgaggttcatgaccctgctcttcctgacagccctggccggggccctggtgtgtgcctatgaccctgaggccgccagcgcccctggcagcggcaacccctgccacgaggccagcgctgcccagaaggaaaatgctggagaagatcctggcctggcccggcaggcccccaagcccaggaagcagaggagcagcctgctggagaagggcctggatggagccaagaaggctgtgggcggcctgggcaagctgggcaaggatgctgtggaggacctggagagcgtgggcaaaggagctgtgcatgatgtgaaggatgtgctggacagcgtgctgtag

SEQ ID NO: 149854 - DNA, 1191 bp, Artificial Sequence
  Description of Artificial Sequence: Synthetic coding sequence
atggccctgctgaccaacctgctgcccctgtgctgcctggccctgctggccctgcctgcccagagctgtggccctggccggggccctgtgggcagaagaagatatgccaggaagcagctggtgcccctgctgtacaagcagtttgtgcctggggtgcctgagaggaccctgggcgccagcggccctgctgagggccgggtggcccggggcagcgagcgcttccgggacctggtgcccaactacaacccagacatcatcttcaaggatgaagaaaattctggagctgaccggctgatgacagagcgctgcaaggagcgggtgaatgccctggccatcgctgtgatgaacatgtggccaggagtgcggctgcgggtgacagagggctgggatgaagatggccaccacgcccaggacagcctgcactatgagggccgggccctggacatcaccaccagtgaccgggacaggaacaagtatggcctgctggcccggctggccgtggaggccggctttgactgggtgtactatgagagcagaaatcatgtgcacgtgtctgtgaaggctgacaacagcctggccgtgcgggccggcggctgcttccctggaaatgccaccgtgcggctgtggagcggggagaggaagggcctgcgggagctgcacagaggagactgggtgctggccgcagatgccagcggccgggtggtgcccacccctgtgctgctcttcctggaccgggacctgcagaggcgggccagctttgtggccgtggagacagagtggccacccaggaagctgctgctgaccccctggcacctggtgtttgctgcccggggccctgccccagcccctggggactttgcccctgtgtttgcccggcggctgcgggccggggacagcgtgctggcccctggaggagatgccctgcggcctgcccgggtggcccgggtggcccgggaggaggccgtgggcgtgtttgcccccctgacagcccacggcaccctgctggtgaatgatgtgctggccagctgctatgctgtgctggagagccaccagtgggcccaccgggcctttgcccccctgcggctgctgcacgccctgggcgccctgctgcctggaggagctgtgcagcccaccggcatgcactggtacagccggctgctgtaccgcctggccgaggagctgctgggctag

SEQ ID NO: 149855 - DNA, 1413 bp, Artificial Sequence
  Description of Artificial Sequence: Synthetic coding sequence
atgagccaggcctacagcagcagccagagggtgtcctcctacagaaggaccttcggcggggcccctggcttccccctgggcagccccctgagcagccctgtgttcccccgggccggcttcggcagcaagggcagcagcagctctgtgaccagccgggtgtaccaggtgtccaggaccagcggcggggccggcggcctgggcagcctgcgggccagccggctgggcaccaccaggacccccagcagctatggagctggggagctgctggacttcagcctggctgatgctgtgaaccaggagttcctgaccaccaggaccaatgagaaggtggagctgcaggagctgaatgacagatttgccaactacatcgagaaggtgcgcttcctggagcagcagaatgctgccctggccgctgaggtgaaccggctgaagggccgggagcccaccagggtggccgagctgtatgaggaggagctgcgggagctgcggcggcaggtggaggtgctgaccaaccagagggcccgggtggatgtggagcgggacaacctgctggatgacctgcagaggctgaaggccaagctgcaggaggagatccagctgaaggaggaggccgagaacaacctggccgccttccgggcagatgtggatgctgccaccctggccagaattgacctggagaggagaattgagagcctgaatgaggagatcgccttcctgaagaaggtgcatgaggaggagatccgggagctgcaggcccagctgcaggagcagcaggtgcaggtggagatggacatgagcaagccagacctgacagctgccctgcgggacatccgggcccagtatgagaccatcgccgccaagaacatcagcgaggccgaggagtggtacaagagcaaggtgtctgacctgacccaggccgccaacaagaacaatgatgccctgcggcaggccaagcaggagatgatggagtaccgccaccagatccagagctacacctgtgaaattgatgccctgaagggcaccaatgacagcctgatgaggcagatgagggagctggaggacagatttgccagcgaggccagcggctaccaggacaacatcgcccggctggaggaggagatccgccacctgaaggatgagatggcccggcacctgcgggagtaccaggacctgctgaatgtgaagatggccctggatgtggagatcgccacctacaggaagctgctggagggggaggagagccgcatcaacctgcccatccagacctacagcgccctgaacttccgggagaccagccctgagcagaggggcagcgaggtgcacaccaagaagacagtgatgatcaagaccatcgagaccagagatggagaggtggtgtctgaggccacccagcagcagcacgaggtgctgtag

SEQ ID NO: 149856 - DNA, 2523 bp, Artificial Sequence
  Description of Artificial Sequence: Synthetic coding sequence
atggccctggccagcgctgcccctggcagcatcttctgcaagcagctgctcttcagcctgctggtgctgaccctgctgtgtgatgcctgccagaaggtgtacctgcgggtgcccagccacctgcaggccgagaccctggtgggcaaggtgaacctggaggagtgcctgaagagcgccagcctcatccgcagcagtgaccctgccttccgcatcctggaggatggcagcatctacaccacccatgacctgatcctgagcagcgagaggaagagcttcagcatcttcctgagtgatggccagaggcgggagcagcaggagatcaaggtggtgctgagcgcccgggagaacaagagccccaagaagaggcacaccaaggacacagccctgaagaggagcaagaggcgctgggcccccatcccagccagcctgatggagaacagcctgggccccttcccccagcacgtgcagcagatccagagtgatgctgcccagaactacaccatcttctacagcatcagcggccctggggtggacaaggagcccttcaacctcttctacatcgagaaggacacaggagacatcttctgcaccaggagcattgaccgggagaagtatgagcagtttgccctgtatggctacgccaccacagcagatggctacgcccctgagtaccccctgcccctcatcatcaagattgaagatgacaatgacaatgccccctactttgagcaccgggtgaccatcttcaccgtgcctgagaactgccgcagcggcacctctgtgggcaaggtgacagccacagacctggatgagccagacaccctgcacacccggctgaagtacaagatcctgcagcagatcccagaccaccccaagcacttcagcatccacccagacaccggggtcatcaccaccaccacccccttcctggaccgggagaagtgtgacacctaccagctgatcatggaggtgcgggacatgggcggccagcccttcggcctcttcaacacaggcaccatcaccatcagcctggaggatgaaaatgacaaccccccatccttcacagagaccagctatgtgacagaggtggaggagaacagaattgatgtggagatcctgaggatgaaggtgcaggaccaggacctgcccaacaccccccacagcaaggctgtgtacaagatcctgcagggcaatgaaaatggaaacttcatcatcagcacagaccccaacaccaatgaaggagtgctgtgtgtggtgaagcccctgaactatgaggtgaaccggcaggtgatcctgcaggtgggcgtcatcaatgaggcccagttcagcaaggccgccagcagccagacccccaccatgtgcaccaccaccgtgacagtgaagatcatcgacagtgatgagggccctgagtgccacccccctgtgaaggtgatccagagccaggacggcttccctgctggccaggagctgctgggctacaaggccctggaccctgagatcagcagcggggagggcctgcgctaccagaagctgggagatgaggacaactggtttgagatcaaccagcacactggagacctgcggaccctgaaggtgctggaccgggagagcaagtttgtgaagaacaaccagtacaacatctctgtggtggccgtggatgctgtgggccgcagctgcaccggcaccctggtggtgcacctggatgactacaatgaccacgccccccagattgacaaggaggtgaccatctgccagaacaatgaagattttgctgtgctgaagcctgtggaccctgatggcccagaaaatggaccacccttccagttcttcctggacaacagcgccagcaagaactggaacatcgaggagaaggatggcaagacagccatcctgcggcagaggcagaacctggactacaactactacagcgtgcccatccagatcaaggacagacatggcctggtggccacccacatgctgactgtgcgggtgtgtgactgcagcaccccatctgagtgcaggatgaaggacaagagcaccagagatgtgcggcccaacgtcatcctgggccgctgggccatcctggccatggtgctgggctctgtgctgctgctgtgcatcctcttcacctgcttctgtgtgacagccaagaggacagtgaagaagtgcttccctgaggacatcgcccagcagaacctgattgtgagcaacacagagggccctggagaggaggtgacagaggccaacatccggctgcccatgcagaccagcaacatctgtgacacctccatgtctgtgggcaccgtgggcggccagggcatcaagacccagcagagctttgagatggtgaagggcggctacaccctggacagcaacaagggcggcggccaccagaccctggagagcgtgaagggcgtgggccagggcgacaccggccgctatgcctacacagactggcagagcttcacccagccccggctgggggaggagagcatccggggccacaccctcatcaagaactag

SEQ ID NO: 149857 - DNA, 2685 bp, Artificial Sequence
  Description of Artificial Sequence: Synthetic coding sequence
atggccctggccagcgctgcccctggcagcatcttctgcaagcagctgctcttcagcctgctggtgctgaccctgctgtgtgatgcctgccagaaggtgtacctgcgggtgcccagccacctgcaggccgagaccctggtgggcaaggtgaacctggaggagtgcctgaagagcgccagcctcatccgcagcagtgaccctgccttccgcatcctggaggatggcagcatctacaccacccatgacctgatcctgagcagcgagaggaagagcttcagcatcttcctgagtgatggccagaggcgggagcagcaggagatcaaggtggtgctgagcgcccgggagaacaagagccccaagaagaggcacaccaaggacacagccctgaagaggagcaagaggcgctgggcccccatcccagccagcctgatggagaacagcctgggccccttcccccagcacgtgcagcagatccagagtgatgctgcccagaactacaccatcttctacagcatcagcggccctggggtggacaaggagcccttcaacctcttctacatcgagaaggacacaggagacatcttctgcaccaggagcattgaccgggagaagtatgagcagtttgccctgtatggctacgccaccacagcagatggctacgcccctgagtaccccctgcccctcatcatcaagattgaagatgacaatgacaatgccccctactttgagcaccgggtgaccatcttcaccgtgcctgagaactgccgcagcggcacctctgtgggcaaggtgacagccacagacctggatgagccagacaccctgcacacccggctgaagtacaagatcctgcagcagatcccagaccaccccaagcacttcagcatccacccagacaccggggtcatcaccaccaccacccccttcctggaccgggagaagtgtgacacctaccagctgatcatggaggtgcgggacatgggcggccagcccttcggcctcttcaacacaggcaccatcaccatcagcctggaggatgaaaatgacaaccccccatccttcacagagaccagctatgtgacagaggtggaggagaacagaattgatgtggagatcctgaggatgaaggtgcaggaccaggacctgcccaacaccccccacagcaaggctgtgtacaagatcctgcagggcaatgaaaatggaaacttcatcatcagcacagaccccaacaccaatgaaggagtgctgtgtgtggtgaagcccctgaactatgaggtgaaccggcaggtgatcctgcaggtgggcgtcatcaatgaggcccagttcagcaaggccgccagcagccagacccccaccatgtgcaccaccaccgtgacagtgaagatcatcgacagtgatgagggccctgagtgccacccccctgtgaaggtgatccagagccaggacggcttccctgctggccaggagctgctgggctacaaggccctggaccctgagatcagcagcggggagggcctgcgctaccagaagctgggagatgaggacaactggtttgagatcaaccagcacactggagacctgcggaccctgaaggtgctggaccgggagagcaagtttgtgaagaacaaccagtacaacatctctgtggtggccgtggatgctgtgggccgcagctgcaccggcaccctggtggtgcacctggatgactacaatgaccacgccccccagattgacaaggaggtgaccatctgccagaacaatgaagattttgctgtgctgaagcctgtggaccctgatggcccagaaaatggaccacccttccagttcttcctggacaacagcgccagcaagaactggaacatcgaggagaaggatggcaagacagccatcctgcggcagaggcagaacctggactacaactactacagcgtgcccatccagatcaaggacagacatggcctggtggccacccacatgctgactgtgcgggtgtgtgactgcagcaccccatctgagtgcaggatgaaggacaagagcaccagagatgtgcggcccaacgtcatcctgggccgctgggccatcctggccatggtgctgggctctgtgctgctgctgtgcatcctcttcacctgcttctgtgtgacagccaagaggacagtgaagaagtgcttccctgaggacatcgcccagcagaacctgattgtgagcaacacagagggccctggagaggaggtgacagaggccaacatccggctgcccatgcagaccagcaacatctgtgacacctccatgtctgtgggcaccgtgggcggccagggcatcaagacccagcagagctttgagatggtgaagggcggctacaccctggacagcaacaagggcggcggccaccagaccctggagagcgtgaagggcgtgggccagggcgacaccggccgctatgcctacacagactggcagagcttcacccagccccggctgggggagaaggtgtacctgtgtggccaggatgaggagcacaagcactgtgaggactatgtgtgcagctacaactatgagggcaagggcagcctggccggctctgtgggctgctgcagcgaccggcaggaggaggagggcctggagttcctggaccacctggagcccaagttccgcaccctggccaagacctgcatcaagaagtag

SEQ ID NO: 149858 - DNA, 2691 bp, Artificial Sequence
  Description of Artificial Sequence: Synthetic coding sequence
atggctgctgctggccccaggagatctgtgagaggagctgtgtgcctgcacctgctgctgaccctggtgatcttcagccgggccggggaggcctgcaagaaggtgatcctgaatgtgcccagcaagctggaggccgacaagatcatcggccgggtgaacctggaggagtgcttccgctctgctgacctgatccgcagcagtgaccctgacttccgggtgctgaatgatggctctgtgtacacagcccgggctgtggccctgagtgacaagaagaggagcttcaccatctggctgagtgacaagaggaagcagacccagaaggaggtgacagtgctgctggagcaccagaagaaggtgtccaagaccaggcacacccgggagaccgtgctgcggcgggccaagaggcgctgggcccccatcccctgcagcatgcaggagaacagcctgggccccttccccctcttcctgcagcaggtggagagtgatgctgcccagaactacaccgtcttctacagcatcagcggccggggcgtggacaaggagcccctgaacctcttctacatcgagcgggacaccggcaacctcttctgcaccaggcctgtggaccgggaggagtatgatgtgtttgacctgattgcctatgccagcacagcagatggctacagcgctgacctgcccctgcccctgcccatccgggtggaggatgaaaatgacaaccaccctgtgttcacagaggccatctacaactttgaggtgctggagagcagccggcccggcaccaccgtgggcgtggtgtgtgccacagacagagatgagccagacaccatgcacacccggctgaagtacagcatcctgcagcagacccccaggagccctggcctcttctctgtgcaccccagcactggagtcatcaccaccgtgagccactacctggaccgggaggtggtggacaagtacagcctcatcatgaaggtgcaggacatggatggccagttcttcggcctcatcggcaccagcacctgcatcatcaccgtgacagacagcaatgacaatgcccccaccttccggcagaatgcctatgaggcctttgtggaggagaatgccttcaacgtggagatcctgcgcatccccatcgaggacaaggacctgatcaacacagccaactggagggtgaacttcaccatcctgaagggaaatgaaaatggccacttcaagatcagcacagacaaggagaccaatgaaggagtgctgtctgtggtgaagcccctgaactatgaagaaaatcggcaggtgaacctggagattggagtgaacaatgaggccccctttgcccgggacatcccccgggtgacagccctgaacagagccctggtgacagtgcacgtgcgggacctggatgagggccctgagtgcaccccagctgcccagtatgtgcgcatcaaggagaacctggccgtgggcagcaagatcaatggctacaaggcctatgaccctgaaaatagaaatggaaatggcctgcgctacaagaagctgcatgaccccaagggctggatcaccattgatgagatcagcggcagcatcatcaccagcaagatcctggaccgggaggtggagacccccaagaatgagctgtacaacatcaccgtgctggccatcgacaaggatgacaggagctgcaccggcaccctggccgtgaacattgaagatgtgaatgacaaccccccagagatcctgcaggagtatgtggtgatctgcaagcccaagatgggctacacagacatcctggccgtggaccctgatgagcctgtgcacggggcccccttctacttcagcctgcccaacaccagccctgagatcagccggctgtggagcctgaccaaggtgaatgacacagctgcccggctgagctaccagaagaatgccggcttccaggagtacaccatccccatcaccgtgaaggaccgggccggccaggccgccaccaagctgctgcgggtgaacctgtgtgagtgcacccaccccacccagtgccgggccaccagccgcagcactggagtcatcctgggcaagtgggccatcctggccatcctgctgggcatcgccctgctcttctctgtgctgctgaccctggtgtgtggggtgtttggagccaccaagggcaagcgcttccctgaggacctggcccagcagaacctgatcatcagcaacacagaggcccctggagatgacagagtgtgcagcgccaacggcttcatgacccagaccaccaacaacagcagccagggcttctgtggcaccatgggcagcggcatgaagaatggaggccaggagaccatcgagatgatgaagggcggcaaccagaccctggagagctgcagaggagctggccaccaccacaccctggacagctgccggggcggccacacagaggtggacaactgccgctacacctacagcgagtggcacagcttcacccagccccggctgggggagaagctgcaccgctgcaaccagaatgaagacaggatgcccagccaggactatgtgctgacctacaactatgagggccggggcagccctgctggctctgtgggctgctgcagcgagaagcaggaggaggatggcctggacttcctgaacaacctggagcccaagttcatcaccctggccgaggcctgcaccaagaggtag

SEQ ID NO: 149859 - DNA, 2520 bp, Artificial Sequence
  Description of Artificial Sequence: Synthetic coding sequence
atggctgctgctggccccaggagatctgtgagaggagctgtgtgcctgcacctgctgctgaccctggtgatcttcagccgggccggggaggcctgcaagaaggtgatcctgaatgtgcccagcaagctggaggccgacaagatcatcggccgggtgaacctggaggagtgcttccgctctgctgacctgatccgcagcagtgaccctgacttccgggtgctgaatgatggctctgtgtacacagcccgggctgtggccctgagtgacaagaagaggagcttcaccatctggctgagtgacaagaggaagcagacccagaaggaggtgacagtgctgctggagcaccagaagaaggtgtccaagaccaggcacacccgggagaccgtgctgcggcgggccaagaggcgctgggcccccatcccctgcagcatgcaggagaacagcctgggccccttccccctcttcctgcagcaggtggagagtgatgctgcccagaactacaccgtcttctacagcatcagcggccggggcgtggacaaggagcccctgaacctcttctacatcgagcgggacaccggcaacctcttctgcaccaggcctgtggaccgggaggagtatgatgtgtttgacctgattgcctatgccagcacagcagatggctacagcgctgacctgcccctgcccctgcccatccgggtggaggatgaaaatgacaaccaccctgtgttcacagaggccatctacaactttgaggtgctggagagcagccggcccggcaccaccgtgggcgtggtgtgtgccacagacagagatgagccagacaccatgcacacccggctgaagtacagcatcctgcagcagacccccaggagccctggcctcttctctgtgcaccccagcactggagtcatcaccaccgtgagccactacctggaccgggaggtggtggacaagtacagcctcatcatgaaggtgcaggacatggatggccagttcttcggcctcatcggcaccagcacctgcatcatcaccgtgacagacagcaatgacaatgcccccaccttccggcagaatgcctatgaggcctttgtggaggagaatgccttcaacgtggagatcctgcgcatccccatcgaggacaaggacctgatcaacacagccaactggagggtgaacttcaccatcctgaagggaaatgaaaatggccacttcaagatcagcacagacaaggagaccaatgaaggagtgctgtctgtggtgaagcccctgaactatgaagaaaatcggcaggtgaacctggagattggagtgaacaatgaggccccctttgcccgggacatcccccgggtgacagccctgaacagagccctggtgacagtgcacgtgcgggacctggatgagggccctgagtgcaccccagctgcccagtatgtgcgcatcaaggagaacctggccgtgggcagcaagatcaatggctacaaggcctatgaccctgaaaatagaaatggaaatggcctgcgctacaagaagctgcatgaccccaagggctggatcaccattgatgagatcagcggcagcatcatcaccagcaagatcctggaccgggaggtggagacccccaagaatgagctgtacaacatcaccgtgctggccatcgacaaggatgacaggagctgcaccggcaccctggccgtgaacattgaagatgtgaatgacaaccccccagagatcctgcaggagtatgtggtgatctgcaagcccaagatgggctacacagacatcctggccgtggaccctgatgagcctgtgcacggggcccccttctacttcagcctgcccaacaccagccctgagatcagccggctgtggagcctgaccaaggtgaatgacacagctgcccggctgagctaccagaagaatgccggcttccaggagtacaccatccccatcaccgtgaaggaccgggccggccaggccgccaccaagctgctgcgggtgaacctgtgtgagtgcacccaccccacccagtgccgggccaccagccgcagcactggagtcatcctgggcaagtgggccatcctggccatcctgctgggcatcgccctgctcttctctgtgctgctgaccctggtgtgtggggtgtttggagccaccaagggcaagcgcttccctgaggacctggcccagcagaacctgatcatcagcaacacagaggcccctggagatgacagagtgtgcagcgccaacggcttcatgacccagaccaccaacaacagcagccagggcttctgtggcaccatgggcagcggcatgaagaatggaggccaggagaccatcgagatgatgaagggcggcaaccagaccctggagagctgcagaggagctggccaccaccacaccctggacagctgccggggcggccacacagaggtggacaactgccgctacacctacagcgagtggcacagcttcacccagccccggctgggggaggagagcatccggggccacactggatag

SEQ ID NO: 149860 - DNA, 3150 bp, Artificial Sequence
  Description of Artificial Sequence: Synthetic coding sequence
atggactggagcttcttccgggtggtggccatgctgttcatcttcctggtggtggtggaggtgaacagcgagttccgcatccaggtgcgggactacaacaccaagaatggcaccatcaagtggcacagcatccggcggcagaagcgggagtggatcaagtttgctgctgcctgccgggagggggaggacaacagcaagaggaaccccatcgccaagatccacagcgactgtgccgccaaccagcaggtgacctaccgcatcagcggcgtgggcatcgaccagcccccctacggcatcttcgtcatcaaccagaagacaggagagatcaacatcaccagcatcgtggaccgggaggtgacccccttcttcatcatctactgccgggccctgaacagcatgggccaggacctggagcggcccctggagctgcgggtgcgggtgctggacatcaatgacaacccccctgtgttctccatggccacctttgctggccagatcgaggagaacagcaatgccaacaccctggtgatgatcctgaatgccacagatgctgatgagcccaacaacctgaacagcaagatcgccttcaagatcatccggcaggagcccagcgacagccccatgttcatcatcaacagaaatactggagagatccgcaccatgaacaacttcctggaccgggagcagtatggccagtatgccctggccgtgcggggcagtgacagagatggaggagcagatggcatgtctgcagaatgtgagtgcaacatcaagatcctggatgtgaatgacaacatcccctacatggagcagagcagctacaccatcgagatccaggagaacaccctgaacagcaacctgctggagatccgggtgattgacctggatgaggagttcagcgccaactggatggctgtgatcttcttcatctctggaaatgaaggcaactggtttgaaattgagatgaatgaaagaacaaatgtgggcatcctgaaggtggtgaagcccctggactatgaggccatgcagagcctgcagctgagcattggagtgaggaacaaggccgagttccaccacagcatcatgagccagtacaagctgaaggccagcgccatctctgtgacagtgctgaatgtcatcgagggccctgtgttccggcccggcagcaagacctacgtggtgactggaaacatgggcagcaatgacaaggtgggggactttgtggccacagacctggacaccggccggcccagcaccaccgtgcgctacgtgatgggcaacaacccagctgacctgctggccgtggacagcaggacaggcaagctgaccctgaagaacaaggtgaccaaggagcagtacaacatgctgggcggcaagtaccagggcaccatcctgagcattgatgacaacctgcagaggacctgcaccggcaccatcaacatcaacatccagagctttggaaatgatgacaggaccaacacagagcccaacaccaagatcaccaccaacacaggccggcaggagagcaccagcagcaccaactatgacaccagcaccaccagcacagacagcagccaggtgtacagcagcgagcctggaaatggagccaaggacctgctgagtgacaacgtgcacttcggccctgctggcatcggcctgctgatcatgggcttcctggtgctgggcctggtgcccttcctgatgatctgctgtgactgtggcggggcccccaggtctgctgctggctttgagcctgtgcctgagtgcagtgatggagccatccacagctgggccgtggagggcccccagcctgagccccgggacatcaccaccgtcatcccccagatccccccagacaatgccaacatcattgaatgtattgacaacagcggcgtgtacaccaatgaatatggaggccgggagatgcaggacctgggcggcggggagaggatgacaggctttgagctgacagaaggagtgaagaccagcggcatgcctgagatctgccaggagtacagcggcaccctgcggaggaacagcatgagagaatgtcgggagggcggcctgaacatgaacttcatggagagctacttctgccagaaggcctatgcctatgcagatgaagatgagggccggcccagcaatgactgcctgctgatctatgacattgaaggagtgggcagccctgctggctctgtgggctgctgcagcttcatcggggaggacctggatgacagcttcctggacaccctgggccccaagttcaagaagctggccgacatcagcctgggcaaggagagctacccagacctggaccccagctggccaccccagagcacagagcctgtgtgcctgccccaggagacagagcctgtggtgtctggccacccccccatcagcccccacttcggcaccaccaccgtcatcagcgagagcacctaccccagcggccctggggtgctgcaccccaagcccatcctggaccccctgggctatggaaatgtgacagtgacagagagctacaccaccagtgacaccctgaagcccagcgtgcacgtgcatgacaacagacctgccagcaatgtggtggtgacagagcgggtggtgggccccatctctggagctgacctgcacggcatgctggagatgccagacctgagagatggcagcaatgtgattgtgacagagcgggtgattgcccccagcagcagcctgcccaccagcctgaccatccaccacccccgggagagcagcaatgtggtggtgacagagagggtcatccagcccaccagcggcatgattggcagcctgtccatgcaccctgagctggccaatgcccacaacgtcatcgtgacagagcgggtggtgtctggagctggggtgacaggcatcagcggcaccaccggcatcagcggcggcatcggcagcagcggcctggtgggcacctccatgggcgccggcagcggggccctgagcggggccggcatcagcggcggcggcatcggcctgagcagcctgggcggcacagccagcatcggccacatgaggagcagcagtgaccaccacttcaaccagaccatcggcagcgccagccccagcacagcccggagccgcatcaccaagtacagcacagtgcagtacagcaagtag

SEQ ID NO: 149861 - DNA, 3357 bp, Artificial Sequence
  Description of Artificial Sequence: Synthetic coding sequence
atggcccggagccctggccgggcctatgccctgctgctgctgctgatctgcttcaacgtgggcagcggcctgcacctgcaggtgctgagcaccagaaatgaaaacaagctgctgcccaagcacccccacctggtgcggcagaagagggcctggatcacagcccctgtggccctgcgggagggggaggacctgagcaagaagaaccccatcgccaagatccacagcgacctggccgaggagcggggcctgaagatcacctacaagtacaccgggaagggcatcacagagcccccatttggcatctttgtgttcaacaaggacaccggggagctgaatgtgaccagcatcctggaccgggaggagacccccttcttcctgctgaccggctacgccctggatgcccggggcaacaacgtggagaagcccctggagctgcgcatcaaggtgctggacatcaatgacaatgaacctgtgttcacccaggatgtgtttgtgggctctgtggaggagctgtctgctgcccacaccctggtgatgaagatcaatgccacagatgctgatgagcccaacaccctgaacagcaagatctcctaccgcatcgtgtccctggagcccgcctacccacctgtgttctacctgaacaaggacacaggagagatctacaccacctctgtgaccctggaccgggaggagcacagcagctacaccctgactgtggaggccagagatggaaatggagaggtgacagacaagcctgtgaagcaggcccaggtgcagatccgcatcctggatgtgaatgacaacatccctgtggtggagaacaaggtgctggagggcatggtggaggagaaccaggtgaatgtggaggtgacccgcatcaaggtgtttgatgctgatgaaattggaagtgacaactggctggccaacttcacctttgccagcggaaatgaaggaggctacttccacattgaaacagatgcccagaccaatgaaggaattgtgaccctcatcaaggaggtggactatgaggagatgaagaacctggacttctctgtgattgtggccaacaaggccgccttccacaagagcatccgcagcaagtacaagcccacccccatccccatcaaggtgaaggtgaagaatgtgaaggagggcatccacttcaagagcagcgtcatcagcatctacgtgtctgagagcatggacaggagcagcaagggccagatcatcggcaacttccaggcctttgatgaggacaccggcctgcctgcccacgcccgctacgtgaagctggaggaccgggacaactggatctctgtggacagcgtgaccagcgagatcaagctggccaagctgcctgactttgagagccgctacgtgcagaatggcacctacacagtgaagatcgtggccatcagcgaggactaccccaggaagaccatcaccggcaccgtgctgatcaacgtggaggacatcaatgacaactgccccaccctcatcgagcctgtgcagaccatctgccatgatgctgaatatgtgaatgtgacagctgaggacctggatggccaccccaacagcggccccttctccttcagcgtcatcgacaagcccccaggcatggccgagaagtggaagatcgcccggcaggagagcacctctgtgctgctgcagcagagcgagaagaagctgggccgctctgagatccagttcctgatcagtgacaaccagggcttcagctgcccagagaagcaggtgctgaccctgactgtgtgtgagtgcctgcacggcagcggctgccgggaggcccagcacgacagctatgtgggcctgggccctgctgccatcgccctgatgatcctggccttcctgctgctgctgctggtgcccctgctgctgctgatgtgccactgtgggaaaggagccaagggcttcacccccatccctggcaccatcgagatgctgcacccctggaacaatgaaggagcccccccagaggacaaggtggtgcccagcttcctgcctgtggaccagggcggcagcctggtgggcagaaatggagtgggcggcatggccaaggaggccaccatgaagggcagcagcagcgccagcatcgtgaagggccagcacgagatgtctgagatggatggccgctgggaggagcacaggagcctgctgagcggccgggccacccagttcaccggggccaccggggccatcatgaccacagagaccaccaagacagcccgggccactggagccagccgggacatggccggggcccaggccgctgctgtggccctgaatgaggagttcctgaggaactacttcacagacaaggccgccagctacacagaggaggatgagaaccacacagccaaggactgcctgctggtgtacagccaggaggagacagagagcctgaatgccagcatcggctgctgcagcttcattgaaggagagctggatgaccgcttcctggatgacctgggcctgaagttcaagaccctggccgaggtgtgcctgggccagaagattgacatcaacaaggagattgagcagaggcagaagccagccacagagacctccatgaacacagccagccacagcctgtgtgagcagaccatggtgaacagcgagaacacctacagcagcggcagcagcttccctgtgcccaagagcctgcaggaggccaatgctgagaaggtgacccaggagatcgtgacagagaggtctgtgagcagccggcaggcccagaaggtggccacccccctgcctgaccccatggccagcagaaatgtcatcgccacagagaccagctatgtgacaggcagcaccatgccacccaccaccgtcatcctgggccccagccagccccagagcctcatcgtgacagagcgggtgtatgccccagccagcaccctggtggaccagccctatgccaatgaaggcaccgtggtggtgacagagagggtcatccagccccatggaggcggcagcaaccccctggagggcacccagcacctgcaggatgtgccctacgtgatggtgcgggagcgggagagcttcctggcccccagcagtggagtgcagcccaccctggccatgcccaacattgctgtgggccagaatgtgacagtgacagagcgggtgctggccccagccagcaccctgcagagcagctaccagatccccacagagaacagcatgacagccaggaacaccaccgtgtctggagctggggtgcccggccccctgcctgactttggcctggaggagagcggccacagcaacagcaccatcaccaccagcagcaccagggtgaccaagcacagcacagtgcagcacagctacagctag

SEQ ID NO: 149862 - DNA, 3123 bp, Artificial Sequence
  Description of Artificial Sequence: Synthetic coding sequence
atggactggctgttcttcaggaacatctgcctgctgatcatcctgatggtggtgatggaggtgaacagcgagttcatcgtggaggtgaaggagtttgatattgaaaatggcaccaccaagtggcagacagtgcggcggcagaagcgggagtggatcaagtttgctgctgcctgccgggagggggaggacaacagcaagaggaaccccatcgccaagatccgcagtgactgtgagagcaaccagaagatcacctaccgcatcagcggcgtgggcatcgacaggcctccctatggagtcttcaccatcaaccccaggactggagagatcaacatcacctctgtggtggaccgggagatcacccccctcttcctgatctactgccgggccctgaacagcagaggagaggacctggagcggcccctggagctgcgggtgaaggtgatggacatcaatgacaatgcccctgtgttcagccagagcgtgtacacagccagcattgaggagaacagtgatgccaacaccctggtggtgaagctgtgtgccacagatgctgatgaggagaaccacctgaacagcaagatcgcctacaagatcgtgtcccaggagcccagcggggcccccatgttcatcctgaaccgctacacaggagaggtgtgcaccatgagcagcttcctggaccgggagcagcacagcatgtacaacctggtggtgcggggcagtgacagagatggagctgctgatggcctgagcagtgaatgtgactgccgcatcaaggtgctggatgtgaatgacaacttccccaccctggagaagaccagctacagcgccagcattgaggagaactgcctgagcagcgagctgatccggctgcaggccatcgacctggatgaggagggcacagacaactggctggcccagtacctgatcctgtctggaaatgatggcaactggtttgacatccagacagacccccagaccaatgaaggcatcctgaaggtggtgaagatgctggactatgagcaggcccccaacatccagctgagcattggagtgaagaaccaggccgacttccactacagcgtggccagccagttccagatgcaccccacccctgtgcgcatccaggtggtggatgtgcgggagggccctgccttccaccccagcaccatggccttctctgtgcgggagggcatcaagggcagcagcctgctgaactacgtgctgggcacctacacagccatcgacctggacaccggcaacccagccacagatgtgcgctacatcattggacatgatgctggctcctggctgaagattgacagcaggactggagagatccagttcagccgggagtttgacaagaagagcaagtacatcatcaatggcatctacacagctgagatcctggccattgatgatggcagcggcaagacagccaccggcaccatctgcatcgaggtgcctgacatcaatgactactgccccaacatcttccctgagaggaggaccatctgcatcgacagccccagcgtgctgatctctgtgaatgagcacagctatggcagccccttcaccttctgtgtggtggatgagcccccaggcattgctgacatgtgggatgtgcgcagcaccaatgccaccagcgccatcctgacagccaagcaggtgctgagccctggcttctatgagatccccatcctggtgaaggacagctacaacagagcctgtgagctggcccagatggtgcagctgtatgcctgtgactgtgatgacaaccacatgtgcctggacagcggggctgctggcatctacacagaggacatcactggagacacctacggccctgtgacagaggaccaggccggcgtgtccaatgtgggcctgggccctgctggcatcggcatgatggtgctgggcatcctgctgctgatcctggcccccctgctgctgctgctgtgctgctgcaagcagaggcagcctgagggcctgggcaccaggtttgcccctgtgcctgagggcggggagggcgtgatgcagagctggagaattgaaggagcccacccagaagatagagatgtgagcaacatctgtgcccccatgacagccagcaacacccaggacaggatggacagcagcgagatctacaccaacacctacgccgccggcggcaccgtggagggcggcgtgtctggagtggagctgaacacaggcatgggcacagctgtgggcctgatggctgctggagctgctggggccagcggggccgccaggaagaggagcagcaccatgggcaccctgcgggactatgcagatgctgacatcaacatggccttcctggacagctacttcagcgagaaggcctatgcctatgcagatgaagatgagggccggcctgccaatgactgcctgctgatctatgaccacgagggcgtgggcagccctgtgggcagcatcggctgctgctcctggatcgtggatgacctggatgagagctgcatggagaccctggaccccaagttccgcaccctggccgagatctgcctgaacacagaaattgagcccttccccagccaccaggcctgcatccccatcagcacagacctgcccctgctgggccccaactactttgtgaatgaatcttctggcctgacccccagcgaggtggagttccaggaggagatggccgccagcgagcctgtggtgcacggggacatcatcgtgacagagacctatggaaatgctgacccctgtgtgcagcccaccaccatcatctttgacccccagctggcccccaacgtggtggtgacagaggccgtgatggcccctgtgtatgacatccagggcaacatctgtgtgcctgctgagctggccgactacaacaacgtcatctatgcagagcgggtgctggccagccctggggtgcctgacatgagcaacagcagcaccacagagggctgcatgggccctgtgatgagcggcaacatcctggtgggccctgagatccaggtgatgcagatgatgagcccagacctgcccatcggccagacagtgggcagcaccagccccatgaccagccgccaccgggtgacccgctacagcaacatccactacacccagcagtag

SEQ ID NO: 149863 - DNA, 3180 bp, Artificial Sequence
  Description of Artificial Sequence: Synthetic coding sequence
atggactggctgttcttcaggaacatctgcctgctgatcatcctgatggtggtgatggaggtgaacagcgagttcatcgtggaggtgaaggagtttgatattgaaaatggcaccaccaagtggcagacagtgcggcggcagaagcgggagtggatcaagtttgctgctgcctgccgggagggggaggacaacagcaagaggaaccccatcgccaagatccgcagtgactgtgagagcaaccagaagatcacctaccgcatcagcggcgtgggcatcgacaggcctccctatggagtcttcaccatcaaccccaggactggagagatcaacatcacctctgtggtggaccgggagatcacccccctcttcctgatctactgccgggccctgaacagcagaggagaggacctggagcggcccctggagctgcgggtgaaggtgatggacatcaatgacaatgcccctgtgttcagccagagcgtgtacacagccagcattgaggagaacagtgatgccaacaccctggtggtgaagctgtgtgccacagatgctgatgaggagaaccacctgaacagcaagatcgcctacaagatcgtgtcccaggagcccagcggggcccccatgttcatcctgaaccgctacacaggagaggtgtgcaccatgagcagcttcctggaccgggagcagcacagcatgtacaacctggtggtgcggggcagtgacagagatggagctgctgatggcctgagcagtgaatgtgactgccgcatcaaggtgctggatgtgaatgacaacttccccaccctggagaagaccagctacagcgccagcattgaggagaactgcctgagcagcgagctgatccggctgcaggccatcgacctggatgaggagggcacagacaactggctggcccagtacctgatcctgtctggaaatgatggcaactggtttgacatccagacagacccccagaccaatgaaggcatcctgaaggtggtgaagatgctggactatgagcaggcccccaacatccagctgagcattggagtgaagaaccaggccgacttccactacagcgtggccagccagttccagatgcaccccacccctgtgcgcatccaggtggtggatgtgcgggagggccctgccttccaccccagcaccatggccttctctgtgcgggagggcatcaagggcagcagcctgctgaactacgtgctgggcacctacacagccatcgacctggacaccggcaacccagccacagatgtgcgctacatcattggacatgatgctggctcctggctgaagattgacagcaggactggagagatccagttcagccgggagtttgacaagaagagcaagtacatcatcaatggcatctacacagctgagatcctggccattgatgatggcagcggcaagacagccaccggcaccatctgcatcgaggtgcctgacatcaatgactactgccccaacatcttccctgagaggaggaccatctgcatcgacagccccagcgtgctgatctctgtgaatgagcacagctatggcagccccttcaccttctgtgtggtggatgagcccccaggcattgctgacatgtgggatgtgcgcagcaccaatgccaccagcgccatcctgacagccaagcaggtgctgagccctggcttctatgagatccccatcctggtgaaggacagctacaacagagcctgtgagctggcccagatggtgcagctgtatgcctgtgactgtgatgacaaccacatgtgcctggacagcggggctgctggcatctacacagaggacatcactggagacacctacggccctgtgacagaggaccaggccggcgtgtccaatgtgggcctgggccctgctggcatcggcatgatggtgctgggcatcctgctgctgatcctggcccccctgctgctgctgctgtgctgctgcaagcagaggcagcctgagggcctgggcaccaggtttgcccctgtgcctgagggcggggagggcgtgatgcagagctggagaattgaaggagcccacccagaagatagactcttcagcgcctatgccctgcccggcggcggcggcacagcagatggcggcggctctgtgctgggccgctgtgccctgcaggccaccccagccctgctgaaccagcacccccccttcagcgagatctacaccaacacctatgctgctgggggcaccgtggagggcggcgtgtctggagtggagctgaacacaggcatgggcacagctgtgggcctgatggccgccggggctgctggggccagcggggccgccaggaagaggagcagcaccatgggcaccctgcgggactatgcagatgctgacatcaacatggccttcctggacagctacttcagcgagaaggcctatgcctatgcagatgaagatgagggccgcccagccaatgactgcctgctgatctatgaccatgaaggagtgggcagccctgtgggcagcatcggctgctgctcctggatcgtggatgacctggatgagagctgcatggagaccctggaccccaagttccgcaccctggccgagatctgcctgaacacagaaattgagcccttccccagccaccaggcctgcatccccatcagcacagacctgcccctgctgggccccaactactttgtgaatgaaagcagcggcctgaccccatctgaggtggagttccaggaggagatggccgccagcgagcctgtggtgcatggagacatcatcgtgacagagacctatggaaatgctgacccctgtgtgcagcccaccaccatcatctttgacccccagctggccccaaatgtggtggtgacagaagctgtgatggcccctgtgtatgacatccagggcaacatctgtgtgcctgctgagctggccgactacaacaacgtcatctatgcagagcgggtgctggccagccctggggtgcctgacatgagcaacagcagcaccacagagggctgcatgggccctgtgatgagcggcaacatcctggtgggccctgagatccaggtgatgcagatgatgagcccagacctgcccatcggccagacagtgggcagcaccagccccatgaccagccgccaccgggtgacccgctacagcaacatccactacacccagcagtag

SEQ ID NO: 149864 - DNA, 498 bp, Artificial Sequence
  Description of Artificial Sequence: Synthetic coding sequence
atggccagcggcgtgcaggtggctgatgaggtgtgccgcatcttctatgacatgaaggtgaggaagtgcagcaccccagaggagatcaagaagaggaagaaggctgtgatcttctgcctgtctgctgacaagaagtgcatcatcgtggaggagggcaaggagatcctggtgggagatgtgggcgtgaccatcacagaccccttcaagcactttgtgggcatgctgcctgagaaggactgccgctatgccctgtatgatgccagctttgagaccaaggagagcaggaaggaggagctgatgttcttcctgtgggcccctgagctggcccccctgaagagcaagatgatctatgccagcagcaaggatgccatcaagaagaagttccagggcatcaagcatgagtgccaggccaacggccctgaggacctgaacagagcctgcatcgccgagaagctgggcggcagcctgattgtggcctttgagggctgccctgtgtag

SEQ ID NO: 149865 - DNA, 447 bp, Artificial Sequence
  Description of Artificial Sequence: Synthetic coding sequence
atgaaggtgaggaagtgcagcaccccagaggagatcaagaagaggaagaaggccgtcatcttctgcctgtctgctgacaagaagtgcatcatcgtggaggagggcaaggagatcctggtgggagatgtgggcgtgaccatcacagaccccttcaagcactttgtgggcatgctgcctgagaaggactgccgctatgccctgtatgatgccagctttgagaccaaggagagcaggaaggaggagctgatgttcttcctgtgggcccctgagctggcccccctgaagagcaagatgatctatgccagcagcaaggatgccatcaagaagaagttccagggcatcaagcatgagtgccaggccaatggacctgaggacctgaacagagcctgcatcgccgagaagctgggcggcagcctcatcgtggcctttgagggctgccctgtgtag

SEQ ID NO: 149866 - DNA, 897 bp, Artificial Sequence
  Description of Artificial Sequence: Synthetic coding sequence
atgtctgatgccaacctggacagcagcaagaagaacttcctggagggggaggtggatgatgaggagagcgtcatcctgaccctggtgcctgtgaaggatgatgccaacatggagcagatggagcccagcgtgagcagcaccagtgatgtgaagctggagaagcccaagaagtacaaccctggccacctgctgcagaccaatgagcagttcaccgccccccagaaggcccgctgcaagatcccagccctgcccctgcccaccatcctgccccccatcaacaaggtgtgccgggacaccctgcgggactggtgccagcagctgggcctgagcaccaacgggaagaagattgaggtgtacctgcggctgcacagacatgcctacccagagcagaggcaggacatgcctgagatgagccaggagacccggctgcagcgctgcagcaggaagaggaaggctgtgaccaagagggcccggctgcagaggagctatgagatgaatgaaagagctgaggagaccaacacagtggaggtgatcaccagcgcccctggggccatgctggcctcctgggccagaattgctgcccgggctgtgcagcccaaggccctgaacagctgcagcatccctgtgtctgtggaggccttcctgatgcaggccagcggcgtgcgctggtgtgtggtgcacggccgcctgctgtctgctgacaccaagggctgggtgcggctgcagttccacgccggccaggcctgggtgcccaccacccacaggaggatgatcagcctcttcctgctgcctgcctgcatcttccccagccctggcatcgaggacaacatgctgtgcccagactgtgccaagaggaacaagaagatgatgaagaggctgatgacagtggagaagtag

SEQ ID NO: 149867 - DNA, 480 bp, Artificial Sequence
  Description of Artificial Sequence: Synthetic coding sequence
atggaccccagccagttcaaccccacctacatccctggcagcccccagatgctgacagaggagaacagcagagatgattctggggccagccagatcagcagcgagaccctcatcaagaacctgagcaacctgaccatcaatgccagcagcgagagcgtgagccccctgtctgaggccctgctgcggcgggagagcgtgggcgctgctgtgctgcgggagattgaagatgagtggctgtacagccggcggggcgtgaggaccctgctgtctgtgcagcgggagaagatggcccggctgcgctacatgctgctgggcggcgtgaggacccatgagcggcggcccaccaacaaggagcccaagggcgtgaagaaggagagccggcccttcaagtgcccctgcagcttctgtgtgtccaatggctgggaccccagtgaaaatgccagaattggcaaccaggacaccaagcccctgcagccctag

SEQ ID NO: 149868 - DNA, 915 bp, Artificial Sequence
  Description of Artificial Sequence: Synthetic coding sequence
atgctgcggggcagcgccagcagcacctccatggagaaggccaagggcaaggagtggaccagcacagagaagagccgggaggaggaccagcaggccagcaaccagcccaacagcatcgccctgcccggcaccagcgccaagaggaccaaggagaagatgagcatcaagggcagcaaggtgctgtgccccaagaagaaggccgagcacacagacaacccccggccccagaagaagatccccatcccccccctgcccagcaagctgccccctgtgaacctgatccaccgggacatcctgcgggcctggtgccagcagctgaagctgagcagcaagggccagaagctggatgcctacaagaggctgtgtgcctttgcctaccccaaccagaaggacttccccagcacagccaaggaggccaagatcaggaagagcctgcagaagaagctgaaggtggagaagggggagaccagcctgcagagcagcgagacccaccccccagaggtggccctgccccctgtgggggagcccccagccctggagaacagcacagccctgctggagggcgtgaacacagtggtggtgaccaccagcgcccctgaggccctgctggcctcctgggcccgcatcagcgcccgggcccggaccccagaggccgtggagagcccccaggaggccagcggcgtgcgctggtgtgtggtgcacggcaagagcctgcctgctgacacagatggctgggtgcacctgcagttccacgccggccaggcctgggtgcctgagaagcaggagggccgggtgtctgccctcttcctgctgcctgccagcaacttccccccaccccacctggaggacaacatgctgtgccccaagtgtgtgcacaggaacaaggtgctgatcaagagcctgcagtgggagtag

SEQ ID NO: 149869 - DNA, 351 bp, Artificial Sequence
  Description of Artificial Sequence: Synthetic coding sequence
atgggcaccctgcctgcccggcggcacatccccccctgggtgaaggtgcctgaggacctgaaggaccctgaggtgttccaggtgcagacccggctgctgaaggccatctttggaccagatggcagccgcatcccctacatcgagcaggtgtccaaggccatgctggagctgaaggccctggagagcagtgacctgacagaggtggtggtgtatggcagctacctgtacaagctgcggaccaagtggatgctgcagagcatggccgagtggcaccggcagaggcaggagcggggcatgctgaagctggccgaggccatgaatgccctggagctgggcccctggatgaagtag

SEQ ID NO: 149870 - DNA, 1104 bp, Artificial Sequence
  Description of Artificial Sequence: Synthetic coding sequence
atgagcagcaccctggccaagattgctgagattgaagctgagatggcccggacccagaagaacaaggccacagcccaccacctgggcctgctgaaggcccggctggccaagctgcggcgggagctgatcacccccaagggcggcggcggcggcggccctggagagggctttgatgtggccaagacaggagatgccagaattggatttgtgggcttccccagcgtgggcaagagcaccctgctgagcaacctggccggcgtgtacagcgaggtggccgcctatgagttcaccaccctgaccaccgtgcctggggtcatccgctacaagggggccaagatccagctgctggacctgcccggcatcatcgagggcgccaaggatggcaagggccggggccggcaggtgattgctgtggcccggacctgcaacctgatcctgattgtgctggatgtgctgaagcccctgggccacaagaagatcattgaaaatgagctggagggcttcggcatccggctgaacagcaagccacccaacatcggcttcaagaagaaggacaagggcggcatcaacctgacagccacctgcccccagagcgagctggatgctgagaccgtgaagagcatcctggccgagtacaagatccacaatgctgatgtgaccctgcggagtgatgccacagcagatgacctgattgatgtggtggagggcaacagagtgtacatcccctgcatctacgtgctgaacaagattgaccagatcagcattgaggagctggacatcatctacaaggtgccccactgtgtgcccatcagcgcccaccaccgctggaactttgatgacctgctggagaagatctgggactacctgaagctggtgcgcatctacaccaagcccaagggccagctgcctgactacaccagccctgtggtgctgccctacagcaggaccaccgtggaggacttctgcatgaagatccacaagaacctgatcaaggagttcaagtatgccctggtgtggggcctgtctgtgaagcacaacccccagaaggtgggcaaggaccacaccctggaggatgaagatgtgatccagatcgtgaagaagtag

SEQ ID NO: 149871 - DNA, 396 bp, Artificial Sequence
  Description of Artificial Sequence: Synthetic coding sequence
atggctgctgctgtggccatggagacagatgatgctggcaaccggctgcgcttccagctggagctggagtttgtgcagtgcctggccaaccccaactacctgaacttcctggcccagaggggctacttcaaggacaaggcctttgtgaactacctgaagtacctgctgtactggaaggaccctgaatatgccaagtacctgaagtacccccagtgcctgcacatgctggagctgctgcagtatgagcacttcaggaaggagctggtgaatgcccagtgtgccaagttcattgatgagcagcagatcctgcactggcagcactacagcaggaagaggatgaggctgcagcaggccctggccgagcagcagcagcagaacaacaccagcggcaagtag

SEQ ID NO: 149872 - DNA, 1032 bp, Artificial Sequence
  Description of Artificial Sequence: Synthetic coding sequence
atgggcatcctggagaagatcagcgagattgagaaggagatcgcccggacccagaagaacaaggccacagagtaccacctgggcctgctgaaggccaagctggccaagtaccgggcccagctgctggagcccagcaagagcgccagcagcaaaggagagggctttgatgtgatgaagtctggagatgcccgggtggccctgattggcttccccagcgtgggcaagagcaccttcctgagcctgatgaccagcacagccagcgaggccgccagctatgagttcaccaccctgacctgcatccctggggtcatcgagtacaagggggccaacatccagctgctggacctgcccggcatcatcgagggcgccgcccagggcaagggccggggccggcaggtgattgctgtggccaggacagcagatgtgatcatcatgatgctggatgccaccaagggggaggtgcagaggagcctgctggagaaggagctggagagcgtgggcatccggctgaacaagcacaagcccaacatctacttcaagcccaagaagggcggcggcatctccttcaacagcacagtgaccctgacccagtgcagcgagaagctggtgcagctgatcctgcacgagtacaagatcttcaatgctgaggtgctcttccgggaggactgcagcccagatgagttcattgatgtgattgtgggcaacagagtgtacatgccctgcctgtatgtgtacaacaagattgaccagatctccatggaggaggtggaccggctggccaggaagcccaacagcgtggtgatcagctgtggcatgaagctgaacctggactacctgctggagatgctgtgggagtacctggccctgacctgcatctacaccaagaagaggggccagaggccagacttcacagatgccatcatcctgaggaaaggagcctctgtggagcacgtgtgccaccgcatccacaggagcctggccagccagttcaaggccccagcccccagcacagtgcgcagcggctgggcctag

SEQ ID NO: 149873 - DNA, 2037 bp, Artificial Sequence
  Description of Artificial Sequence: Synthetic coding sequence
atggagctgcggagctaccagtgggaggtgatcatgcctgccctggagggcaagaacatcatcatctggctgcccaccggggccggcaagaccagggctgctgcctacgtggccaagaggcacctggagaccgtggatggagccaaggtggtggtgctggtgaacagagtgcacctggtgacccagcacggggaggagttccggaggatgctggatggccgctggacagtgaccaccctgagcggggacatgggcccccgggccggcttcggccacctggcccgctgccacgacctgctgatctgcacagctgagctgctgcagatggccctgaccagccctgaggaggaggagcacgtggagctgactgtgttcagcctcatcgtggtggatgagtgccaccacacccacaaggacacagtgtacaacgtcatcatgagccagtacctggagctgaagctgcagagggcccagcccctgccccaggtgctgggcctgacagccagccctggcaccggcggggccagcaagctggatggagccatcaaccacgtgctgcagctgtgtgccaacctggacacctggtgcatcatgagcccccagaactgctgcccccagctgcaggagcacagccagcagccctgcaagcagtacaacctgtgccacagaagaagccaggacccctttggagacctgctgaagaagctgatggaccagatccatgaccacctggagatgcctgagctgagcaggaagtttggcacccagatgtatgagcagcaggtggtgaagctgtctgaggccgccgccctggccggcctgcaggagcagagggtgtatgccctgcacctgcggcgctacaatgatgccctgctgattcatgacacagtgcgggctgtggatgccctggccgccctgcaggacttctaccaccgggagcacgtgaccaagacccagatcctgtgtgccgagcggcggctgctggccctgtttgatgacaggaagaatgagctggcccacctggccacccacggccctgagaaccccaagctggagatgctggagaagatcctgcagaggcagttcagcagcagcaacagcccccggggcatcatcttcaccaggacccggcagagcgcccacagcctgctgctgtggctgcagcagcagcagggcctgcagacagtggacatccgggcccagctgctgattggagctggcaacagcagccagagcacccacatgacccagagggaccagcaggaggtgatccagaagttccaggacggcaccctgaacctgctggtggccacctctgtggccgaggagggcctggacatcccccactgcaatgtggtggtgcgctatggcctgctgaccaatgagatctccatggtgcaggcccggggccgggcccgggctgaccagagcgtgtatgcctttgtggccacagagggcagccgggagctgaagcgggagctgatcaatgaggccctggagaccctgatggagcaggccgtggccgctgtgcagaagatggaccaggccgagtaccaggccaagatccgggacctgcagcaggccgccctgaccaagagagctgcccaggccgcccagcgggagaaccagaggcagcagtttcctgtggagcacgtgcagctgctgtgcatcaactgcatggtggccgtgggccacggcagtgacctgaggaaggtggagggcacccaccacgtgaatgtgaaccccaacttcagcaactactacaacgtgtcccgggaccctgtggtgatcaacaaggtgttcaaggactggaagccaggcggcgtcatcagctgcaggaactgtggggaggtgtggggcctgcagatgatctacaagtctgtgaagctgcctgtgctgaaggtgcgctccatgctgctggagaccccccagggccgcatccaggccaagaagtggagccgggtgcccttctctgtgcctgactttgacttcctgcagcactgtgccgagaacctgagtgacctgagcctggactag

SEQ ID NO: 149874 - DNA, 909 bp, Artificial Sequence
  Description of Artificial Sequence: Synthetic coding sequence
atggagctgcggagctaccagtgggaggtgatcatgcctgccctggagggcaagaacatcatcatctggctgcccaccggggccggcaagaccagggctgctgcctacgtggccaagaggcacctggagaccgtggatggagccaaggtggtggtgctggtgaacagagtgcacctggtgacccagcacggggaggagttccggaggatgctggatggccgctggacagtgaccaccctgagcggggacatgggcccccgggccggcttcggccacctggcccgctgccacgacctgctgatctgcacagctgagctgctgcagatggccctgaccagccctgaggaggaggagcacgtggagctgactgtgttcagcctcatcgtggtggatgagtgccaccacacccacaaggacacagtgtacaacgtcatcatgagccagtacctggagctgaagctgcagagggcccagcccctgccccaggtgctgggcctgacagccagccctggcaccggcggggccagcaagctggatggagccatcaaccacgtgctgcagctgtgtgccaacctggacacctggtgcatcatgagcccccagaactgctgcccccagctgcaggagcacagccagcagccctgcaagcagtacaacctgtgccacagaagaagccaggacccctttggagacctgctgaagaagctgatggaccagatccatgaccacctggagatgcctgagctgagcaggaagtttggcacccagatgtatgagcagcaggtggtgaagctgtctgaggccgccgccctggccggcctgcaggagcagagggtgtatgccctgcacctgcggcgctacaatgatgccctgctgattcatgacacagtgcgggctgtggatgcctag

SEQ ID NO: 149875 - DNA, 1464 bp, Artificial Sequence
  Description of Artificial Sequence: Synthetic coding sequence
atggagctgcggagctaccagtgggaggtgatcatgcctgccctggagggcaagaacatcatcatctggctgcccaccggggccggcaagaccagggctgctgcctacgtggccaagaggcacctggagaccgtggatggagccaaggtggtggtgctggtgaacagagtgcacctggtgacccagcacggggaggagttccggaggatgctggatggccgctggacagtgaccaccctgagcggggacatgggcccccgggccggcttcggccacctggcccgctgccaccacacccacaaggacacagtgtacaacgtcatcatgagccagtacctggagctgaagctgcagagggcccagcccctgccccaggtgctgggcctgacagccagccctggcactggaggagccagcaagctggatggagccatcaaccacgtgctgcagctgtgtgccaacctggacacctggtgcatcatgagcccccagaactgctgcccccagctgcaggagcacagccagcagccctgcaagcagtacaacctgtgccaccggcgcagccaggacccctttggagacctgctgaagaagctgatggaccagatccatgaccacctggagatgcctgagctgagcaggaagtttggcacccagatgtatgagcagcaggtggtgaagctgtctgaggccgccgccctggccggcctgcaggagcagagggtgtatgccctgcacctgcggcgctacaatgatgccctgctgattcatgacacagtgcgggctgtggatgccctggccgccctgcaggacttctaccaccgggagcacgtgaccaagacccagatcctgtgtgccgagcggcggctgctggccctgtttgatgacaggaagaatgagctggcccacctggccacccacggccctgagaaccccaagctggagatgctggagaagatcctgcagaggcagttcagcagcagcaacagcccccggggcatcatcttcaccaggacccggcagagcgcccacagcctgctgctgtggctgcagcagcagcagggcctgcagacagtggacatccgggcccagctgctgattggagctggcaacagcagccagagcacccacatgacccagagggaccagcaggaggtgatccagaagttccaggacggcaccctgaacctgctggtggccacctctgtggccgaggagggcctggacatcccccactgcaatgtggtggtgcgctatggcctgctgaccaatgagatctccatggtgcaggcccggggccgggcccgggctgaccagagcgtgtatgcctttgtggccacagagggcagccgggagctgaagcgggagctgatcaatgaggccctggagaccctgatggagcaggccgtggccgctgtgcagaagatggaccaggccgagtaccaggccaaggagctgctgtag

SEQ ID NO: 149876 - DNA, 471 bp, Artificial Sequence
  Description of Artificial Sequence: Synthetic coding sequence
atggagctgcggagctaccagtgggaggtgatcatgcctgccctggagggcaagaacatcatcatctggctgcccaccggggccggcaagaccagggctgctgcctacgtggccaagaggcacctggagaccgtggatggagccaaggtggtggtgctggtgaacagagtgcacctggtgacccagcacggggaggagttccggaggatgctggatggccgctggacagtgaccaccctgagcggggacatgggcccccgggccggcttcggccacctggcccgctgccacgacctgctgatctgcacagctgagctgctgcagatggccctgaccagccctgaggaggaggagcacgtggagctgactgtgttcagcctcatcgtggtggatgagtgccaccacacccacaaggacacagtgtacaacgtcatcatgagccagtacctggagctgaagctgcagaggtag

SEQ ID NO: 149877 - DNA, 2208 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagggcggccggcctgaggacaagctggagttcaccttcaagctgtatgacacagacagaaatggcatcctggacagcagcgaggtggacaagatcatcctgcagatgatgagggtggccgagtacctggactgggatgtgtctgagctgcggcccatcctgcaggagatgatgaaggagattgattatgatggcagcggctctgtgtcccaggccgagtgggtgcgggccggggccaccaccgtgcccctgctggtgctgctgggcctggagatgaccctgaaggatgatggccagcacatgtggaggcccaagcgcttccccaggcctgtgtactgcaacctgtgtgagagcagcatcggcctgggcaagcagggcctgagctgcaacctgtgcaagtacacagtgcatgaccagtgtgccatgaaggccctgccctgtgaggtgtccacctacgccaagagcaggaaggacattggagtgcagagccacgtgtgggtgcggggcggctgtgagagcggccgctgtgaccgctgccagaagaagatccgcatctaccacagcctgaccggcctgcactgtgtgtggtgccacctggagatccatgatgactgcctgcaggccgtgggccatgaatgtgactgtggcctgctgcgggaccacatcctgccccccagcagcatctaccccagcgtgctggccagcggccctgacaggaagaacagcaagaccagccagaagaccatggatgacctgaacctgagcaccagcgaggccctgagaattgatcctgtgcccaacacccaccccctgctggtgtttgtgaaccccaagagcggcggcaagcagggccagagggtgctgtggaagttccagtacatcctgaacccccggcaggtgttcaacctgctgaaggatggccctgagatcggcctgcggctcttcaaggatgtgcctgacagccgcatcctggtgtgtggaggagatggcaccgtgggctggatcctggagaccatcgacaaggccaacctgcctgtgctgccccctgtggccgtgctgcccctgggcactggaaatgacctggcccgctgcctgcgctggggcggcggctatgagggccagaacctggccaagatcctgaaggacctggagatgagcaaggtggtgcacatggaccgctggagcgtggaggtgatcccccagcagacagaggagaagagtgaccctgtgcccttccagatcatcaacaactacttcagcattggagtggatgccagcatcgcccaccgcttccacatcatgagggagaagtacccagagaagttcaacagcaggatgaagaacaagctgtggtactttgaatttgccaccagcgagagcatcttcagcacctgcaagaagctggaggagagcctgactgtggagatctgtgggaagcccctggacctgagcaacctgagcctggagggcattgctgtgctgaacatccccagcatgcacggcggcagcaacctgtggggagacacccggcggccccatggagacatctacggcatcaaccaggccctgggcgccacagccaaggtgatcacagatcctgacatcctgaagacctgtgtgcctgacctgagtgacaagaggctggaggtggtgggcctggagggcgccatcgagatgggccagatctacaccaagctgaagaatgccggccgccgcctggccaagtgcagcgagatcaccttccacaccaccaagaccctgcccatgcagattgatggagagccctggatgcagaccccctgcaccatcaagatcacccacaagaaccagatgcccatgctgatgggccccccacccaggagcaccaacttcttcggcttcctgtcctag

SEQ ID NO: 149878 - DNA, 2208 bp, Artificial Sequence; identical to SEQ ID NO: 149877
  Description of Artificial Sequence: Synthetic coding sequence

SEQ ID NO: 149879 - DNA, 744 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagggcggccggcctgaggacaagctggagttcaccttcaagctgtatgacacagacagaaatggcatcctggacagcagcgaggtggacaagatcatcctgcagatgatgagggtggccgagtacctggactgggatgtgtctgagctgcggcccatcctgcaggagatgatgaaggagattgattatgatggcagcggctctgtgtcccaggccgagtgggtgcgggccggggccaccaccgtgcccctgctggtgctgctgggcctggagatgaccctgaaggatgatggccagcacatgtggaggcccaagcgcttccccaggcctgtgtactgcaacctgtgtgagagcagcatcggcctgggcaagcagggcctgagctgcaaccggcccatcacctgtgtgggcgcccggcggctgtag

SEQ ID NO: 149880 - DNA, 351 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagggcggccggcctgaggacaagctggagtag

SEQ ID NO: 149881 - DNA, 177 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagtag

SEQ ID NO: 149882 - DNA, 66 bp, Artificial Sequence
  Description of Artificial Sequence: Synthetic coding sequence
atggccaaggagcggggcctcatcagccccagcgactttgcccagctgcagaagtacatggagtag

SEQ ID NO: 149883 - DNA, 444 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagggcggccggcctgaggacaagctggagttcaccttcaagctgtatgacacagacagaaatggcatcctggacagcagcgaggtggacaagatcatcctgcagatgatgagggtggccgagtag

SEQ ID NO: 149884 - DNA, 2208 bp, Artificial Sequence; identical to SEQ ID NO: 149877
  Description of Artificial Sequence: Synthetic coding sequence

SEQ ID NO: 149885 - DNA, 402 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagggcggccggcctgaggacaagctggagttcaccttcaagctgtatgacacagacagaaatggcatcctggacagcagctag

SEQ ID NO: 149886 - DNA, 324 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagggagatgccatcggctatgagggcttccagcagttcctgaagatctacctggaggtggacaacgtgcccaggcacctgagcctggccctcttccagagctttgagaccggccactgcctgaatgagaccaacgtgaccaaggatgtggtgtgcctgaatgatgtgtcctgctacttcagcctgctggagtag

SEQ ID NO: 149887 - DNA, 135 bp, Artificial Sequence
  Description of Artificial Sequence: Synthetic coding sequence
atggccaaggagcggggcctcatcagccccagcgactttgcccagctgcagaagtacatggagtacagcaccaagaaggtgtctgatgtgctgaagctgtttgaagatggagagatggccaagtatgtgcagtag

SEQ ID NO: 149888 - DNA, 135 bp, Artificial Sequence; identical to SEQ ID NO: 149887
  Description of Artificial Sequence: Synthetic coding sequence

SEQ ID NO: 149889 - DNA, 402 bp, Artificial Sequence; identical to SEQ ID NO: 149885
  Description of Artificial Sequence: Synthetic coding sequence

SEQ ID NO: 149890 - DNA, 135 bp, Artificial Sequence; identical to SEQ ID NO: 149887
  Description of Artificial Sequence: Synthetic coding sequence

SEQ ID NO: 149891 - DNA, 2415 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaagctggtggtgctgggcaacaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctgcagaccctgcccaccagcggcgtgtctgtgcctgaggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaggtgatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcatgaatctgtggagattgaatgtgatggagtgcagattgacctgatcaacatcagcctggagggcatcgccatcctgaacatccccagcatgcacggcggcagcaacctgtggggcgagagcaagaagaggaggagccaccggcgcatcgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggccggcggctggcccagtgcagctgtgtggtgatccgcaccagcaagagcctgcccatgcagattgatggagagccctggatgcagaccccctgcaccatcaagatcacccacaagaaccaggcccccatgctgatgggccccccacccaagacaggcctcttctgcagcctggtgaagaggaccaggaacagaagcaaggagtag

SEQ ID NO: 149892 - DNA, 2415 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaagcaggacatcctgaaccagaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctgcagaccctgcccaccagcggcgtgtctgtgcctgaggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaggtgatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcatgaatctgtggagattgaatgtgatggagtgcagattgacctgatcaacatcagcctggagggcatcgccatcctgaacatccccagcatgcacggcggcagcaacctgtggggcgagagcaagaagaggaggagccaccggcgcatcgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggccggcggctggcccagtgcagctgtgtggtgatccgcaccagcaagagcctgcccatgcagattgatggagagccctggatgcagaccccctgcaccatcaagatcacccacaagaaccaggcccccatgctgatgggccccccacccaagacaggcctcttctgcagcctggtgaagaggaccaggaacagaagcaaggagtag

SEQ ID NO: 149893 - DNA, 2412 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaagcaggacatcctgaaccagaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctgaccctgcccaccagcggcgtgtctgtgcctgaggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaagtcatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcacgagagcgtggagattgaatgtgatggagtgcagattgacctgatcaacatcagcctggagggcatcgccatcctgaacatccccagcatgcatggaggcagcaacctgtggggcgagagcaagaagagaagaagccacagaagaattgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggaagaaggctggcccagtgcagctgtgtggtgatccgcaccagcaagagcctgcccatgcagattgatggagagccctggatgcagaccccctgcaccatcaagatcacccacaagaaccaggcccccatgctgatgggccccccacccaagacaggcctcttctgcagcctggtgaagaggaccaggaacagaagcaaggagtag

SEQ ID NO: 149894 - DNA, 2415 bp, Artificial Sequence; identical to SEQ ID NO: 149892
  Description of Artificial Sequence: Synthetic coding sequence

SEQ ID NO: 149895 - DNA, 2322 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaagcaggacatcctgaaccagaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctgcagaccctgcccaccagcggcgtgtctgtgcctgaggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaggtgatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcatgaatctgtggagattgaatgtgatggagtgcagattgacctgatcaacatcagcctggagggcatcgccatcctgaacatccccagcatgcacggcggcagcaacctgtggggcgagagcaagaagaggaggagccaccggcgcatcgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggccggcggctggcccagtgcagctgtgtggtgatccgcaccagcaagagcctgcccatgcagattgatggagagccctggatgcagaccccctgcaccgtgtccacagaatag

SEQ ID NO: 149896 - DNA, 2391 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctgaccctgcccaccagcggcgtgtctgtgcctgaggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaggtgatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcatgaatctgtggagattgaatgtgatggagtgcagattgacctgatcaacatcagcctggagggcatcgccatcctgaacatccccagcatgcacggcggcagcaacctgtggggcgagagcaagaagaggaggagccaccggcgcatcgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggccggcggctggcccagtgcagctgtgtggtgatccgcaccagcaagagcctgcccatgcagattgatggagagccctggatgcagaccccctgcaccatcaagatcacccacaagaaccaggcccccatgctgatgggccccccacccaagacaggcctcttctgcagcctggtgaagaggaccaggaacagaagcaaggagtag

SEQ ID NO: 149897 - DNA, 228 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaagcaggacatcctgaaccagaccatcgactttgagggcttcaagctgttcatgaagaccttcctggaggccgagctgtag

SEQ ID NO: 149898 - DNA, 2358 bp, Artificial Sequence
  Description of Artificial Sequence: Synthetic coding sequence
atgaccaaccaggagaagtgggcccacctgagccccagcgagttcagccagctgcagaagtatgcagagtacagcaccaagaagctgaaggatgtgctggaggagttccatggaaatggagtgctggccaagtacaaccctgagggcaccatcgactttgagggcttcaagctgttcatgaagaccttcctggaggccgagctgcctgatgacttcaccgcccacctgttcatgtccttcagcaacaagttcccccacagcagccccatggtgaagagcaagccagccctgctgagcggcggcctgaggatgaacaagggggccatcaccccacccaggaccaccagccctgccaacacctgcagccctgaggtgatccacctgaaggacatcgtgtgctacctgagcctgctggagcggggccggcctgaggacaagctggagttcatgttccggctgtatgacacagatggaaatggcttcctggacagcagcgagctggagaacatcatcagccagatgatgcacgtggccgagtacctggagtgggatgtgacagagctgaaccccatcctgcacgagatgatggaggagattgattatgaccatgatggcaccgtgtccctggaggagtggatccagggcggcatgaccaccatccccctgctggtgctgctgggcctggagaacaacgtgaaggatgatggccagcacgtgtggaggctgaagcacttcaacaagccagcctactgcaacctgtgcctgaacatgctgattggagtgggcaagcagggcctgtgctgcagcttctgcaagtacacagtgcatgagcgctgtgtggcccgggccccacccagctgcatcaagacctacgtgaagagcaagaggaacacagatgtgatgcaccactactgggtggagggcaactgccccaccaagtgtgacaagtgccacaagacagtgaagtgctaccagggcctgaccggcctgcactgtgtgtggtgccagatcaccctgcacaacaagtgtgccagccacctgaagccagaatgtgactgtggccccctgaaggaccacatcctgccccccaccaccatctgccctgtggtgctggagcggcagagcacagtgaagaaggagaagagcggcagccagcagcccaacaaggtgattgacaagaacaagatgcagagggccaacagcgtgacagtggatggccagggcctgcaggtgacccctgtgcccggcacccaccccctgctggtgtttgtgaaccccaagagcggcggcaagcagggcgagcgcatctacaggaagttccagtacctgctgaacccccggcaggtgtacagcctgtctggaaatggccccatgcctggcctgaacttcttcagagatgtgcctgacttccgggtgctggcctgtggaggagatggcaccgtgggctgggtgctggactgcatcgagaaggccaacgtgggcaagcacccccctgtggccatcctgcccctgggcactggaaatgacctggcccgctgcctgcgctggggcggcggctatgaaggagagaacctgatgaagatcctgaaggacatcgagaacagcacagagatcatgctggaccgctggaagtttgaagtcatccccaatgacaaggatgagaagggggaccctgtgccctacagcatcatcaacaactacttcagcattggagtggatgccagcatcgcccaccgcttccacatcatgagggagaagcaccctgagaagttcaacagcaggatgaagaacaagttctggtactttgaatttggcaccagcgagaccttcagcgccacctgcaagaagctgcacgagagcgtggagattgaatgtgatggagtgcagattgacctgatcaacatcagcctggagggcatcgccatcctgaacatccccagcatgcatggaggcagcaacctgtggggcgagagcaagaagagaagaagccacagaagaattgagaagaagggcagtgacaagaggaccaccgtgacagatgccaaggagctgaagtttgccagccaggacctgagtgaccagctgctggaggtggtgggcctggagggcgccatggagatgggccagatctacacaggcctgaagtctgctggaagaaggctggcccagtgcagctgtgtggtgatccgcaccagcaagagcctgcccatgcagattgatggagagccctggatgcagaccccctgcaccatcaagatcacccacaagaaccaggcccccatgctgatgggccccccacccaagacaggcctcttctgcagcctggtgaagaggaccaggaacagaagcaaggagtag

SEQ ID NO: 149899 - DNA, 3645 bp, Artificial Sequence
  Description of Artificial Sequence: Synthetic coding sequence
atggctgctgctgctggggcccctcctcctggccccccccagcccccacctcctcctcctcctgaggagagcagtgacagcgagcctgaggccgagcccggcagcccccagaagctgatcaggaaggtgtccaccagcggccagatccggcagaagaccatcatcaaggagggcatgctgaccaagcagaacaacagcttccagaggagcaagaggcgctacttcaagctgcggggccgcaccctgtactatgccaagacagccaagagcatcatctttgatgaggtggacctgacagatgcctctgtggccgagagcagcaccaagaatgtgaacaacagcttcaccgtcatcaccccctgcaggaagctgatcctgtgtgccgacaacaggaaggagatggaggactggattgctgccctgaagacagtgcagaaccgggagcactttgagcccacccagtacagcatggaccacttcagcggcatgcacaactggtacgcctgcagccacgcccggcccacctactgcaatgtgtgccgggaggccctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgctgatggcatcgccatgccccaccagtggctggagggcaacctgcctgtgtctgccaagtgcaccgtgtgtgacaagacctgtggctctgtgctgcggctgcaggactggcgctgcctgtggtgcaaggccatggtgcacaccagctgcaaggagagcctgctgaccaagtgccccctgggcctgtgcaaggtgtctgtcatccccccaacagccctgaacagcattgacagtgatggcttctggaaggccagctgcccccccagctgcaccagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaccttccgcatcctggtgtgtggaggagatggctctgtgggctgggtgctgtctgaaattgacagcctgaacctgcacaagcagtgccagctgggcgtgctgcccctgggcactggaaatgacctggcccgggtgctgggctggggcagcgcctgtgatgatgacacccagctgccccagatcctggagaagctggagcgggccagcaccaagatgctggaccgctggagcgtgatggcctatgaggccaagctgccccggcaggccagcagcagcacagtgacagaggacttcagcgaggacagcgaggtgcagcagatcctcttctatgaagattctgtggccgcccacctgagcaagatcctgaccagtgaccagcacagcgtggtgatcagcagcgccaaggtgctgtgtgagaccgtgaaggactttgtggcccgggtgggcaaggcctatgagaagaccacagagagcagcgaggagagcgaggtgatggccaagaagtgcagcgtgctgaaggagaagctggacagcctgctgaagaccctggatgatgagagccaggccagcagcagcctgcccaaccccccacccaccatcgccgaggaggctgaagatggagatggcagcggcagcatctgtggcagcactggagaccggctggtggccagcgcctgcccagcccggccccagatcttccggccccgggagcagctgatgctgcgggccaacagcctgaagaaggccatccggcagatcatcgagcacacagagaaggctgtggatgagcagaatgcccagacccaggagcaggagggctttgtgctgggcctgtctgagagcgaggagaagatggaccaccgggtgtgcccccccctgagccacagcgagagctttggagtgcccaagggccgcagccagaggaaggtgtccaagagcccctgtgagaagctgatcagcaagggcagcctgagcctgggcagcagcgccagcctgcccccccagcccggcagcagagatggcctgcctgccctgaacaccaagatcctgtacccaaatgtgcgggccggcatgagcggcagcctgcccggcggcagcgtcatcagccggctgctgatcaatgctgaccccttcaacagcgagcctgagaccctggagtactacacagagaagtgtgtgatgaacaactacttcggcatcggcctggatgccaagatcagcctggacttcaacaacaagagagatgagcaccctgagaagtgccgcagcaggaccaagaacatgatgtggtatggagtgctgggcaccaaggagctgctgcacaggacctacaagaacctggagcagaaggtgctgctggagtgtgatggccggcccatccccctgcccagcctgcagggcattgctgtgctgaacatccccagctatgccggcggcaccaacttctggggcggcaccaaggaggatgacacctttgctgcccccagctttgatgacaagatcctggaggtggtggccgtgtttggctccatgcagatggctgtgtccagggtcatccggctgcagcaccaccgcatcgcccagtgcaggacagtgaagatcagcatcctgggagatgaaggagtgcctgtgcaggtggatggagaggcctgggtgcagcccccaggctacatccgcatcgtgcacaagaacagagcccagaccctgacccgggaccgggcctttgagagcaccctgaagtcctgggaggacaagcagaagtgtgagctgcccaggcctcccagctgcagcctgcaccctgagatgctgtctgaggaggaggccacccagatggaccagtttggccaggccgccggcgtgctgatccacagcatccgggagatcgcccagagccaccgggacatggagcaggagctggcccatgctgtgaatgccagcagcaagtccatggacagagtgtatggcaagcccaggaccacagagggcctgaactgcagctttgtgctggagatggtgaacaacttccgggccctgcggagtgaaacagagctgctgctgagcggcaagatggccctgcagctggaccccccccagaaggagcagctgggcagcgccctggccgagatggaccggcagctgcggcggctggccgacaccccctggctgtgccagagcgctgagcctggagatgaggagagcgtgatgctggacctggccaagaggagccgcagcggcaagttccggctggtgaccaagttcaagaaggagaagaacaacaagaacaaggaggcccacagcagcctgggcgcccctgtgcacctgtggggcacagaggaggtggccgcctggctggagcacctgagcctgtgtgagtacaaggacatcttcaccaggcatgacatccggggcagcgagctgctgcacctggagcggcgggacctgaaggacctgggcgtgaccaaggtgggccacatgaagaggatcctgtgtggcatcaaggagctgagccgcagcgccccagctgtggaggcctag

SEQ ID NO: 149900 - DNA, 3513 bp, Artificial Sequence
  Description of Artificial Sequence: Synthetic coding sequence
atgaacatgttcctgtacttccagaccatcatcaaggagggcatgctgaccaagcagaacaacagcttccagaggagcaagaggcgctacttcaagctgcggggccgcaccctgtactatgccaagacagccaagagcatcatctttgatgaggtggacctgacagatgcctctgtggccgagagcagcaccaagaatgtgaacaacagcttcaccgtcatcaccccctgcaggaagctgatcctgtgtgccgacaacaggaaggagatggaggactggattgctgccctgaagacagtgcagaaccgggagcactttgagcccacccagtacagcatggaccacttcagcggcatgcacaactggtacgcctgcagccacgcccggcccacctactgcaatgtgtgccgggaggccctgtctggagtgaccagccacggcctgagctgtgaggtgtgcaagttcaaggcccacaagagatgtgctgtgcgggccaccaacaactgcaagtggaccaccctggccagcatcggcaaggacatcattgaagatgctgatggcatcgccatgccccaccagtggctggagggcaacctgcctgtgtctgccaagtgcaccgtgtgtgacaagacctgtggctctgtgctgcggctgcaggactggcgctgcctgtggtgcaaggccatggtgcacaccagctgcaaggagagcctgctgaccaagtgccccctgggcctgtgcaaggtgtctgtcatccccccaacagccctgaacagcattgacagtgatggcttctggaaggccagctgcccccccagctgcaccagccccctgctggtgtttgtgaacagcaagagcggggacaaccagggcgtgaagttcctgcggcgcttcaagcagctgctgaacccagcccaggtgtttgacctgatgaatggaggcccccacctgggcctgcggctcttccagaagtttgacaccttccgcatcctggtgtgtggaggagatggctctgtgggctgggtgctgtctgaaattgacagcctgaacctgcacaagcagtgccagctgggcgtgctgcccctgggcactggaaatgacctggcccgggtgctgggctggggcagcgcctgtgatgatgacacccagctgccccagatcctggagaagctggagcgggccagcaccaagatgctggaccgctggagcgtgatggcctatgaggccaagctgccccggcaggccagcagcagcacagtgacagaggacttcagcgaggacagcgaggtgcagcagatcctcttctatgaagattctgtggccgcccacctgagcaagatcctgaccagtgaccagcacagcgtggtgatcagcagcgccaaggtgctgtgtgagaccgtgaaggactttgtggcccgggtgggcaaggcctatgagaagaccacagagagcagcgaggagagcgaggtgatggccaagaagtgcagcgtgctgaaggagaagctggacagcctgctgaagaccctggatgatgagagccaggccagcagcagcctgcccaaccccccacccaccatcgccgaggaggctgaagatggagatggcagcggcagcatctgtggcagcactggagaccggctggtggccagcgcctgcccagcccggccccagatcttccggccccgggagcagctgatgctgcgggccaacagcctgaagaaggccatccggcagatcatcgagcacacagagaaggctgtggatgagcagaatgcccagacccaggagcaggagggctttgtgctgggcctgtctgagagcgaggagaagatggaccaccgggtgtgcccccccctgagccacagcgagagctttggagtgcccaagggccgcagccagaggaaggtgtccaagagcccctgtgagaagctgatcagcaagggcagcctgagcctgggcagcagcgccagcctgcccccccagcccggcagcagagatggcctgcctgccctgaacaccaagatcctgtacccaaatgtgcgggccggcatgagcggcagcctgcccggcggcagcgtcatcagccggctgctgatcaatgctgaccccttcaacagcgagcctgagaccctggagtactacacagagaagtgtgtgatgaacaactacttcggcatcggcctggatgccaagatcagcctggacttcaacaacaagagagatgagcaccctgagaagtgccgcagcaggaccaagaacatgatgtggtatggagtgctgggcaccaaggagctgctgcacaggacctacaagaacctggagcagaaggtgctgctggagtgtgatggccggcccatccccctgcccagcctgcagggcattgctgtgctgaacatccccagctatgccggcggcaccaacttctggggcggcaccaaggaggatgacacctttgctgcccccagctttgatgacaagatcctggaggtggtggccgtgtttggctccatgcagatggctgtgtccagggtcatccggctgcagcaccaccgcatcgcccagtgcaggacagtgaagatcagcatcctgggagatgaaggagtgcctgtgcaggtggatggagaggcctgggtgcagcccccaggctacatccgcatcgtgcacaagaacagagcccagaccctgacccgggaccgggcctttgagagcaccctgaagtcctgggaggacaagcagaagtgtgagctgcccaggcctcccagctgcagcctgcaccctgagatgctgtctgaggaggaggccacccagatggaccagtttggccaggccgccggcgtgctgatccacagcatccgggagatcgcccagagccaccgggacatggagcaggagctggcccatgctgtgaatgccagcagcaagtccatggacagagtgtatggcaagcccaggaccacagagggcctgaactgcagctttgtgctggagatggtgaacaacttccgggccctgcggagtgaaacagagctgctgctgagcggcaagatggccctgcagctggaccccccccagaaggagcagctgggcagcgccctggccgagatggaccggcagctgcggcggctggccgacaccccctggctgtgccagagcgctgagcctggagatgaggagagcgtgatgctggacctggccaagaggagccgcagcggcaagttccggctggtgaccaagttcaagaaggagaagaacaacaagaacaaggaggcccacagcagcctgggcgcccctgtgcacctgtggggcacagaggaggtggccgcctggctggagcacctgagcctgtgtgagtacaaggacatcttcaccaggcatgacatccggggcagcgagctgctgcacctggagcggcgggacctgaaggacctgggcgtgaccaaggtgggccacatgaagaggatcctgtgtggcatcaaggagctgagccgcagcgccccagctgtggaggcctag

SEQ ID NO: 149901 - DNA, 1704 bp, Artificial Sequence
  Description of Artificial Sequence: Synthetic coding sequence
atggaggccgagaggaggcctgcccctggcagccccagcgagggcctgtttgctgatggccacctgatcctgtggaccctgtgcagcgtgctgctgcctgtgttcatcaccttctggtgcagcctgcagaggagccggcggcagctgcacagaagagacatcttcaggaagagcaagcacggctggagggacacagacctcttcagccagcccacctactgctgcgtgtgtgcccagcacatcctgcagggcgccttctgtgactgctgcggcctgcgggtggatgagggctgcctgaggaaggctgacaagcgcttccagtgcaaggagatcatgctgaagaatgacaccaaggtgctggatgccatgccccaccactggatcagaggaaatgtgcccctgtgcagctactgcatggtgtgcaagcagcagtgtggctgccagcccaagctgtgtgactaccgctgcatctggtgccagaagacagtgcatgatgagtgcatgaagaacagcctgaagaatgagaagtgtgactttggagagttcaagaacctgatcatcccccccagctacctgaccagcatcaaccagatgaggaaggacaagaagacagattatgaggtgctggccagcaagctgggcaagcagtggacccccctcatcatcctggccaacagccgcagcggcaccaacatgggagagggcctgctgggggagttccgcatcctgctgaaccctgtgcaggtgtttgatgtgaccaagaccccacccatcaaggccctgcagctgtgcaccctgctgccctactacagcgcccgggtgctggtgtgtggaggagatggcaccgtgggctgggtgctggatgctgtggatgacatgaagatcaagggccaggagaagtacatcccccaggtggccgtgctgcccctgggcactggaaatgacctgagcaacaccctgggctggggcaccggctacgccggggagatccctgtggcccaggtgctgagaaatgtgatggaggctgatggcatcaagctggaccgctggaaggtgcaggtgaccaacaagggctactacaacctgaggaagcccaaggagttcaccatgaacaactacttctctgtgggcccagatgccctgatggccctgaacttccacgcccaccgggagaaggcccccagcctcttcagcagccgcatcctgaacaaggctgtgtacctgttctacggcaccaaggactgcctggtgcaggagtgcaaggacctgaacaagaaggtggagctggagctggatggagagcgggtggccctgcccagcctggagggcatcatcgtgctgaacatcggctactggggcggcggctgccgcctgtgggagggcatgggagatgagacctaccccctggcccggcatgatgatggcctgctggaggtggtgggcgtgtatggcagcttccactgtgcccagatccaggtgaagctggccaaccccttcagaattggccaggcccacacagtgcggctcatcctgaagtgcagcatgatgcccatgcaggtggatggagagccctgggcccagggcccctgcaccgtgaccatcacccacaagacccacgccatgatgctgtacttcagcggggagcagacagatgatgacatcagcagcaccagtgaccaggaggacatcaaggccacagaatag

SEQ ID NO: 149902 - DNA, 2376 bp, Artificial Sequence
  Description of Artificial Sequence: Synthetic coding sequence
atgggagaggagcgctgggtgtccctgaccccagaggagtttgaccagctgcagaagtacagcgagtacagcagcaagaagatcaaggatgccctgacagagttcaatgaaggaggcagcctgaagcagtatgacccccatgagcccatctcctatgatgtgttcaagctgttcatgagggcctacctggaggtggacctgccccagcccctgagcacccacctgttcctggccttcagccagaagcccaggcatgagaccagtgaccaccccacagagggcgccagcaacagcgaggccaacagcgctgacaccaacatccagaatgctgacaatgccaccaaggcagatgaggcctgtgccccagacacagagagcaacatggccgagaagcaggccccagctgaggaccaggtggccgccacccccctggagccccctgtgcccaggagcagcagcagcgagagccctgtggtgtacctgaaggatgtggtgtgctacctgagcctgctggagaccggccggccccaggacaagctggagttcatgttccggctgtatgacagtgatgaaaatggcctgctggaccaggccgagatggactgcatcgtgaaccagatgctgcacatcgcccagtacctggagtgggaccccacagagctgcggcccatcctgaaggagatgctgcagggcatggactatgacagagatggctttgtgtccctgcaggagtgggtgcatggaggcatgaccaccatccccctgctggtgctgctgggcatggatgacagcggcagcaaaggagatggaagacatgcctggaccatgaagcacttcaagaagcccacctactgcaacttctgccacatcatgctgatgggcgtgaggaagcagggcctgtgctgcacctactgcaagtacacagtgcatgagcgctgtgtgtccaggaacatccctggctgtgtgaagacctacagcaaggccaagaggtctggagaggtgatgcagcacgcctgggtggagggcaacagctctgtgaagtgtgaccgctgccacaagagcatcaagtgctaccagagcgtgacagcccggcactgtgtgtggtgcaggatgaccttccacaggaaatgtgagctgagcaccctgtgtgatggaggagagctgcgggaccacatcctgctgcccaccagcatctgccccatcacccgggacaggcctggagagaagagtgatggctgtgtgtctgccaagggggagctggtgatgcagtacaagatcatccccaccccaggcacccaccccctgctggtgctggtgaaccccaagagcggcggccggcagggcgagcgcatcctgaggaagttccactacctgctgaaccccaagcaggtgttcaacctggacaatggaggccccaccccaggcctgaacttcttccgggacaccccagacttccgggtgctggcctgtggaggagatggcaccgtgggctggatcctggactgcatcgacaaggccaactttgccaagcacccccctgtggccgtgctgcccctgggcactggaaatgacctggcccgctgcctgcgctggggcggcggctatgaaggaggcagcctgaccaagatcctgaaggacatcgagcagagccccctggtgatgctggaccgctggcacctggaggtgatcccccgggaggaggtggagaatggagaccaggtgccctacagcatcatgaacaactacttcagcattggagtggatgccagcatcgcccaccgcttccacgtgatgagggagaagcaccctgagaagttcaacagcaggatgaagaacaagctgtggtactttgaatttggcaccagcgagacctttgctgccacctgcaagaagctgcatgaccacatcgagctggagtgtgatggagtgggcgtggacctgagcaacatcttcctggagggcatcgccatcctgaacatccccagcatgtatggaggcaccaacctgtggggcgagaacaagaagaacagagctgtgatccgggagagcaggaaaggagtgacagaccccaaggagctgaagttctgtgtgcaggacctgagtgaccagctgctggaggtggtgggcctggagggcgccatggagatgggccagatctacacaggcctgaagtctgctggccggcggctggcccagtgtgcctctgtgaccatccgcaccaacaagctgctgcccatgcaggtggatggagagccctggatgcagccctgctgcaccatcaagatcacccacaagaaccaggcccccatgatgatgggccccccccagaagagcagcttcttcagcctgcggaggaagagccgcagcaaggactag

SEQ ID NO: 149903 - DNA, 2301 bp, Artificial Sequence
  Description of Artificial Sequence: Synthetic coding sequence
atgggagaggagcgctgggtgtccctgaccccagaggagtttgaccagctgcagaagtacagcgagtacagcagcaagaagatcaaggatgccctgacagagttcaatgaaggaggcagcctgaagcagtatgacccccatgagcccatctcctatgatgtgttcaagctgttcatgagggcctacctggaggtggacctgccccagcccctgagcacccacctgttcctggccttcagccagaagcccaggcatgagaccagtgaccaccccacagagggcgccagcaacagcgaggccaacagcgctgacaccaacatccagaatgctgacaatgccaccaaggcagatgaggcctgtgccccagacacagagagcaacatggccgagaagcaggccccagctgaggaccaggtggccgccacccccctggagccccctgtgcccaggagcagcagcagcgagagccctgtggtgtacctgaaggatgtggtgtgctacctgagcctgctggagaccggccggccccaggacaagctggagttcatgttccggctgtatgacagtgatgaaaatggcctgctggaccaggccgagatggactgcatcgtgaaccagatgctgcacatcgcccagtacctggagtgggaccccacagagctgcggcccatcctgaaggagatgctgcagggcatggactatgacagagatggctttgtgtccctgcaggagtgggtgcatggaggcatgaccaccatccccctgctggtgctgctgggcatggatgacagcggcagcaaaggagatggaagacatgcctggaccatgaagcacttcaagaagcccacctactgcaacttctgccacatcatgctgatgggcgtgaggaagcagggcctgtgctgcacctactgcaagtacacagtgcatgagcgctgtgtgtccaggaacatccctggctgtgtgaagacctacagcaaggccaagaggtctggagaggtgatgcagcacgcctgggtggagggcaacagctctgtgaagtgtgaccgctgccacaagagcatcaagtgctaccagagcgtgacagcccggcactgtgtgtggtgcaggatgaccttccacaggaaatgtgagctgagcaccctgtgtgatggaggagagctgcgggaccacatcctgctgcccaccagcatctgccccatcacccgggacaggcctggagagaagagtgatggctgtgtgtctgccaagggggagctggtgatgcagtacaagatcatccccaccccaggcacccaccccctgctggtgctggtgaaccccaagagcggcggccggcagggcgagcggctgaacttcttccgggacaccccagacttccgggtgctggcctgtggaggagatggcaccgtgggctggatcctggactgcatcgacaaggccaactttgccaagcacccccctgtggccgtgctgcccctgggcactggaaatgacctggcccgctgcctgcgctggggcggcggctatgagggcggcagcctgaccaagatcctgaaggacatcgagcagagccccctggtgatgctggaccgctggcacctggaggtgatcccccgggaggaggtggagaatggagaccaggtgccctacagcatcatgaacaactacttcagcattggagtggatgccagcatcgcccaccgcttccacgtgatgagggagaagcaccctgagaagttcaacagcaggatgaagaacaagctgtggtactttgaatttggcaccagcgagacctttgctgccacctgcaagaagctgcatgaccacatcgagctggagtgtgatggagtgggcgtggacctgagcaacatcttcctggagggcatcgccatcctgaacatccccagcatgtatggaggcaccaacctgtggggcgagaacaagaagaacagagctgtgatccgggagagcaggaagggcgtgacagaccccaaggagctgaagttctgtgtgcaggacctgagtgaccagctgctggaggtggtgggcctggagggcgccatggagatgggccagatctacacaggcctgaagtctgctggaagaaggctggcccagtgtgcctctgtgaccatccgcaccaacaagctgctgcccatgcaggtggatggagagccctggatgcagccctgctgcaccatcaagatcacccacaagaaccaggcccccatgatgatgggccccccccagaagagcagcttcttcagcctgcggaggaagagccgcagcaaggactag

SEQ ID NO: 149904 - DNA, 2259 bp, Artificial Sequence
  Description of Artificial Sequence: Synthetic coding sequence
atgggagaggagcgctgggtgtccctgaccccagaggagtttgaccagctgcagaagtacagcgagtacagcagcaagaagatcaaggatgccctgacagagttcaatgaaggaggcagcctgaagcagtatgacccccatgagcccatctcctatgatgtgttcaagctgttcatgagggcctacctggaggtggacctgccccagcccctgagcacccacctgttcctggccttcagccagaagcccaggcatgagaccagtgaccaccccacagagggcgccagcaacagcgaggccaacagcgctgacaccaacatccagaatgctgacaatgccaccaaggcagatgaggcctgtgccccagacacagagagcaacatggccgagaagcaggccccagctgaggaccaggtggccgccacccccctggagccccctgtgcccaggagcagcagcagcgagagccctgtggtgtacctgaaggatgtggtgtgctacctgagcctgctggagaccggccggccccaggacaagctggagttcatgttccggctgtatgacagtgatgaaaatggcctgctggaccaggccgagatggactgcatcgtgaaccagatgctgcacatcgcccagtacctggagtgggaccccacagagctgcggcccatcctgaaggagatgctgcagggcatggactatgacagagatggctttgtgtccctgcaggagtgggtgcatggaggcatgaccaccatccccctgctggtgctgctgggcatggatgacagcggcagcaaaggagatggaagacatgcctggaccatgaagcacttcaagaagcccacctactgcaacttctgccacatcatgctgatgggcgtgaggaagcagggcctgtgctgcacctactgcaagtacacagtgcatgagcgctgtgtgtccaggaacatccctggctgtgtgaagacctacagcaaggccaagaggtctggagagttccacaggaaatgtgagctgagcaccctgtgtgatggaggagagctgcgggaccacatcctgctgcccaccagcatctgccccatcacccgggacaggcctggagagaagagtgatggctgtgtgtctgccaagggggagctggtgatgcagtacaagatcatccccaccccaggcacccaccccctgctggtgctggtgaaccccaagagcggcggccggcagggcgagcgcatcctgaggaagttccactacctgctgaaccccaagcaggtgttcaacctggacaatggaggccccaccccaggcctgaacttcttccgggacaccccagacttccgggtgctggcctgtggaggagatggcaccgtgggctggatcctggactgcatcgacaaggccaactttgccaagcacccccctgtggccgtgctgcccctgggcactggaaatgacctggcccgctgcctgcgctggggcggcggctatgagggcggcagcctgaccaagatcctgaaggacatcgagcagagccccctggtgatgctggaccgctggcacctggaggtgatcccccgggaggaggtggagaatggagaccaggtgccctacagcatcatgaacaactacttcagcattggagtggatgccagcatcgcccaccgcttccacgtgatgagggagaagcaccctgagaagttcaacagcaggatgaagaacaagctgtggtactttgaatttggcaccagcgagacctttgctgccacctgcaagaagctgcatgaccacatcgagctggagtgtgatggagtgggcgtggacctgagcaacatcttcctggagggcatcgccatcctgaacatccccagcatgtatggaggcaccaacctgtggggcgagaacaagaagaacagagctgtgatccgggagagcaggaagggcgtgacagaccccaaggagctgaagttctgtgtgcaggacctgagtgaccagctgctggaggtggtgggcctggagggcgccatggagatgggccagatctacacaggcctgaagtctgctggaagaaggctggcccagtgtgcctctgtgaccatccgcaccaacaagctgctgcccatgcaggtggatggagagccctggatgcagccctgctgcaccatcaagatcacccacaagaaccaggcccccatgatgatgggccccccccagaagagcagcttcttcagcctgcggaggaagagccgcagcaaggactag

SEQ ID NO: 149905 - DNA, 1818 bp, Artificial Sequence
  Description of Artificial Sequence: Synthetic coding sequence
agcctgaagatgggagaggagcgctgggtgtccctgaccccagaggagtttgaccagctgcagaagtacagcgagtacagcagcaagaagatcaaggatgccctgacagagttcaatgaaggaggcagcctgaagcagtatgacccccatgagcccatctcctatgatgtgttcaagctgttcatgagggcctacctggaggtggacctgccccagcccctgagcacccacctgttcctggccttcagccagaagcccaggcatgagaccagtgaccaccccacagaaggagccagcaacagcgaggccaacagcgctgacaccaacatccagaatgctgacaatgccaccaaggcagatgaggcctgtgccccagacacagagagcaacatggccgagaagcaggccccagctgaggaccaggtggccgccacccccctggagccccctgtgcccaggagcagcagcagcgagagccctgtggtgtacctgaaggatgtggtgtgctacctgagcctgctggagaccggccggccccaggacaagctggagttcatgttccggctgtatgacagtgatgaaaatggcctgctggaccaggccgagatggactgcatcgtgaaccagatgctgcacatcgcccagtacctggagtgggaccccacagagctgcggcccatcctgaaggagatgctgcagggcatggactatgacagagatggctttgtgtccctgcaggagtgggtgcacggcggcatgaccaccatccccctgctggtgctgctgggcatggatgattctggcagcaaaggagatggaagacatgcctggaccatgaagcacttcaagaagcccacctactgcaacttctgccacatcatgctgatgggcgtgaggaagcagggcctgtgctgcacctactgcaagtacacagtgcatgagcgctgtgtgtccaggaacatccctggctgtgtgaagacctacagcaaggccaagaggtctggagagttccacaggaaatgtgagctgagcaccctgtgtgatggaggagagctgcgggaccacatcctgctgcccaccagcatctgccccatcacccgggacaggcctggagagaagagtgatggctgtgtgtctgccaagggggagctggtgatgcagtacaagatcatccccaccccaggcacccaccccctgctggtgctggtgaaccccaagagcggcggccggcagggcgagcgcatcctgaggaagttccactacctgctgaaccccaagcaggtgttcaacctggacaatggaggccccaccccaggcctgaacttcttccgggacaccccagacttccgggtgctggcctgtggaggagatggcaccgtgggctggatcctggactgcatcgacaaggccaactttgccaagcacccccctgtggccgtgctgcccctgggcactggaaatgacctggcccgctgcctgcgctggggcggcggctatgaaggaggcagcctgaccaagatcctgaaggacatcgagcagagccccctggtgatgctggaccgctggcacctggaggtgatcccccgggaggaggtggagaatggagaccaggtgccctacagcatcatgaacaactacttcagcattggagtggatgccagcatcgcccaccgcttccacgtgatgagggagaagcaccctgagaagttcaacagcaggatgaagaacaagctgtggtactttgaatttggcaccagcgagacctttgctgccacctgcaagaagctgcatgaccacatcgagctggagtggtgctag

SEQ ID NO: 149906 - DNA, 2199 bp, Artificial Sequence
  Description of Artificial Sequence: Synthetic coding sequence
atgggagaggagcgctgggtgtccctgaccccagaggagtttgaccagctgcagaagtacagcgagtacagcagcaagaagatcaaggatgccctgacagagttcaatgaaggaggcagcctgaagcagtatgacccccatgagcccatctcctatgatgtgttcaagctgttcatgagggcctacctggaggtggacctgccccagcccctgagcacccacctgttcctggccttcagccagaagcccaggcatgagaccagtgaccaccccacagagggcgccagcaacagcgaggccaacagcgctgacaccaacatccagaatgctgacaatgccaccaaggcagatgaggcctgtgccccagacacagagagcaacatggccgagaagcaggccccagctgaggaccaggtggccgccacccccctggagccccctgtgcccaggagcagcagcagcgagagccctgtggtgtacctgaaggatgtggtgtgctacctgagcctgctggagaccggccggccccaggacaagctggagttcatgttccggctgtatgacagtgatgaaaatggcctgctggaccaggccgagatggactgcatcgtgaaccagatgctgcacatcgcccagtacctggagtgggaccccacagagctgcggcccatcctgaaggagatgctgcagggcatggactatgacagagatggctttgtgtccctgcaggagtgggtgcatggaggcatgaccaccatccccctgctggtgctgctgggcatggatgacagcggcagcaaaggagatggaagacatgcctggaccatgaagcacttcaagaagcccacctactgcaacttctgccacatcatgctgatgggcgtgaggaagcagggcctgtgctgcacctactgcaagtacacagtgcatgagcgctgtgtgtccaggaacatccctggctgtgtgaagacctacagcaaggccaagaggtctggagagttccacaggaaatgtgagctgagcaccctgtgtgatggaggagagctgcgggaccacatcctgctgcccaccagcatctgccccatcacccgctacaagatcatccccaccccaggcacccaccccctgctggtgctggtgaaccccaagagcggcggccggcagggcgagcgcatcctgaggaagttccactacctgctgaaccccaagcaggtgttcaacctggacaatggaggccccaccccaggcctgaacttcttccgggacaccccagacttccgggtgctggcctgtggaggagatggcaccgtgggctggatcctggactgcatcgacaaggccaactttgccaagcacccccctgtggccgtgctgcccctgggcactggaaatgacctggcccgctgcctgcgctggggcggcggctatgagggcggcagcctgaccaagatcctgaaggacatcgagcagagccccctggtgatgctggaccgctggcacctggaggtgatcccccgggaggaggtggagaatggagaccaggtgccctacagcatcatgaacaactacttcagcattggagtggatgccagcatcgcccaccgcttccacgtgatgagggagaagcaccctgagaagttcaacagcaggatgaagaacaagctgtggtactttgaatttggcaccagcgagacctttgctgccacctgcaagaagctgcatgaccacatcgagctggagtgtgatggagtgggcgtggacctgagcaacatcttcctggagggcatcgccatcctgaacatccccagcatgtatggaggcaccaacctgtggggcgagaacaagaagaacagagctgtgatccgggagagcaggaagggcgtgacagaccccaaggagctgaagttctgtgtgcaggacctgagtgaccagctgctggaggtggtgggcctggagggcgccatggagatgggccagatctacacaggcctgaagtctgctggaagaaggctggcccagtgtgcctctgtgaccatccgcaccaacaagctgctgcccatgcaggtggatggagagccctggatgcagccctgctgcaccatcaagatcacccacaagaaccaggcccccatgatgatgggccccccccagaagagcagcttcttcagcctgcggaggaagagccgcagcaaggactag

SEQ ID NO: 149907 - DNA, 3198 bp, Artificial Sequence
  Description of Artificial Sequence: Synthetic coding sequence
atggatgctgctggccggggctgccacctgctgcccctgcctgctgcccggggccctgcccgggccccagctgctgctgctgctgctgctgccagccccccaggcccctgcagcggggccgcctgtgcccccagcgctgctgctggggccggggccatgaaccccagcagcagcgctggggaggagaagggggccaccggcggcagcagcagcagcggcagcggggccggcagctgctgcctgggcgctgagggcggcgctgaccccaggggggccggcagcgctgctgctgctggagctgctgccctggatgagcctgctgctgctggccagaaggagaaggatgaggccctggaggagaagctgaggaacctgaccttcaggaagcaggtgtcctacaggaaggccatcagccgggccggcctgcagcacctggccccagcccaccccctgagcctgcctgtggccaatggacctgccaaggagccccgggccaccctggactggagcgaaaatgctgtgaatggagagcacctgtggctggagaccaacgtgtctggggacctgtgctacctgggggaggagaactgccaggtgcgctttgccaagagcgccctgcggaggaaatgtgctgtgtgcaagatcgtggtgcacacagcctgcatcgagcagctggagaagatcaacttccgctgcaagcccaccttccgggagggcggcagccgcagcccccgggagaactttgtgcgccaccactgggtgcacagaagacggcaggagggcaagtgcaagcagtgtgggaagggcttccagcagaagttctccttccacagcaaggagatcgtggccatcagctgctcctggtgcaagcaggccttccacaacaaggtgacctgcttcatgctgcaccacatcgaggagccctgcagcctgggcgcccatgctgctgtgattgtgccccccacctggatcatcaaggtgaagaagccccagaacagcctgaaggccagcaacaggaagaagaagaggaccagcttcaagaggaaggccagcaagaggggcatggagcaggagaacaagggccggcccttcgtcatcaagcccatcagcagccccctgatgaagcccctgctggtgtttgtgaaccccaagagcggcggcaaccagggcaccaaggtgctgcagatgttcatgtggtacctgaacccccggcaggtgtttgacctgagccaggagggccccaaggatgccctggagctgtacaggaaggtgcccaacctgcgcatcctggcctgtggaggagatggcaccgtgggctggatcctgagcatcctggatgagctgcagctgagcccccagccccctgtgggcgtgctgcccctgggcactggaaatgacctggcccggaccctgaactggggcggcggctacacagatgagcctgtgtccaagatcctgtgccaggtggaggatggcaccgtggtgcagctggaccgctggaacctgcacgtggagaggaacccagacctgcccccagaggagctggaggatggagtgtgcaagctgcccctgaatgtgttcaacaactacttcagcctgggctttgatgcccacgtgaccctggagttccacgagagccgggaggccaaccctgagaagttcaacagccgcttcaggaacaagatgttttatgctggggccgccttcagtgacttcctgcagaggagcagccgggacctgagcaagcacgtgaaggtggtgtgtgatggaacagacctgacccccaagatccaggagctgaagttccagtgcatcgtgttcctgaacatcccccgctactgtgccggcaccatgccctggggcaaccctggggaccaccacgactttgagccccagagacatgatgatggctacattgaagtcatcggcttcaccatggccagcctggccgccctgcaggtgggcggccatggagagcggctgcaccagtgccgggaggtgatgctgctgacctacaagagcatccccatgcaggtggatggagagccctgccgcctggccccagccatgatccgcatcagcctgaggaaccaggccaacatggtgcagaagagcaagaggaggacctccatgcccctgctgaatgacccccagagcgtgcctgaccggctgcgcatccgggtgaacaagatcagcctgcaggactatgagggcttccactatgacaaggagaagctgcgggaggccagcatcagtgactggctgcggaccatcgccggggagctggtgcagagctttggagccatccccctgggcatcctggtggtgcggggggactgtgacctggagacctgcaggatgtacatcgaccggctgcaggaggacctgcagagcgtgagcagcggcagccagagggtgcactaccaggaccacgagaccagcttcccccgggccctgagcgcccagaggctgagcccccgctggtgcttcctggatgacaggagccaggagcacctgcactttgtgatggagatcagccaggatgagatcttcatcctggaccctgacatggtggtgtcccagcctgctggcaccccacctggcatgccagacctggtggtggagcaggccagcggcatcagtgactggtggaacccagccctgaggaagaggatgctgagtgacagcggcctgggcatgattgccccctactatgaggacagcgacctgaaggacctgagccacagccgggtgctgcagagccctgtgtcctctgaggaccacgccatcctgcaggccgtgattgctggggacctgatgaagctgattgagagctacaagaatggaggcagcctgctgatccagggccctgaccactgcagcctgctgcactacgccgccaagacaggaaatggagagatcgtgaagtacatcctggaccacggccccagcgagctgctggacatggctgacagcgagaccggggagacagccctgcacaaggccgcctgccagaggaacagagctgtgtgccagctgctggtggatgctggggccagcctgaggaagacagacagcaagggcaagaccccccaggagcgggcccagcaggccggggaccctgacctggccgcctacctggagagccggcagaactacaaggtgattggacatgaggacctggagacagctgtgtag

SEQ ID NO: 149908 - DNA, 3207 bp, Artificial Sequence
  Description of Artificial Sequence: Synthetic coding sequence
atggatgctgctggccggggctgccacctgctgcccctgcctgctgcccggggccctgcccgggccccagctgctgctgctgctgctgctgccagccccccaggcccctgcagcggggccgcctgtgcccccagcgctgctgctggggccggggccatgaaccccagcagcagcgctggggaggagaagggggccaccggcggcagcagcagcagcggcagcggggccggcagctgctgcctgggcgctgagggcggcgctgaccccaggggggccggcagcgctgctgctgctggagctgctgccctggatgagcctgctgctgctggccagaaggagaaggatgaggccctggaggagaagctgaggaacctgaccttcaggaagcaggtgtcctacaggaaggccatcagccgggccggcctgcagcacctggccccagcccaccccctgagcctgcctgtggccaatggacctgccaaggagccccgggccaccctggactggagcgaaaatgctgtgaatggagagcacctgtggctggagaccaacgtgtctggggacctgtgctacctgggggaggagaactgccaggtgcgctttgccaagagcgccctgcggaggaaatgtgctgtgtgcaagatcgtggtgcacacagcctgcatcgagcagctggagaagatcaacttccgctgcaagcccaccttccgggagggcggcagccgcagcccccgggagaactttgtgcgccaccactgggtgcacagaagacggcaggagggcaagtgcaagcagtgtgggaagggcttccagcagaagttctccttccacagcaaggagatcgtggccatcagctgctcctggtgcaagcaggccttccacaacaaggtgacctgcttcatgctgcaccacatcgaggagccctgcagcctgggcgcccatgctgctgtgattgtgccccccacctggatcatcaaggtgaagaagccccagaacagcctgaaggccagcaacaggaagaagaagaggaccagcttcaagaggaaggccagcaagaggggcatggagcaggagaacaagggccggcccttcgtcatcaagcccatcagcagccccctgatgaagcccctgctggtgtttgtgaaccccaagagcggcggcaaccagggcaccaaggtgctgcagatgttcatgtggtacctgaacccccggcaggtgtttgacctgagccaggagggccccaaggatgccctggagctgtacaggaaggtgcccaacctgcgcatcctggcctgtggaggagatggcaccgtgggctggatcctgagcatcctggatgagctgcagctgagcccccagccccctgtgggcgtgctgcccctgggcactggaaatgacctggcccggaccctgaactggggcggcggctacacagatgagcctgtgtccaagatcctgtgccaggtggaggatggcaccgtggtgcagctggaccgctggaacctgcacgtggagaggaacccagacctgcccccagaggagctggaggatggagtgtgcaagctgcccctgaatgtgttcaacaactacttcagcctgggctttgatgcccacgtgaccctggagttccacgagagccgggaggccaaccctgagaagttcaacagccgcttcaggaacaagatgttttatgctggggccgccttcagtgacttcctgcagaggagcagccgggacctgagcaagcacgtgaaggtggtgtgtgatggaacagacctgacccccaagatccaggagctgaagttccagtgcatcgtgttcctgaacatcccccgctactgtgccggcaccatgccctggggcaaccctggggaccaccacgactttgagccccagagacatgatgatggctacattgaagtcatcggcttcaccatggccagcctggccgccctgcaggtgggcggccatggagagcggctgcaccagtgccgggaggtgatgctgctgacctacaagagcatccccatgcaggtggatggagagccctgccgcctggccccagccatgatccgcatcagcctgaggaaccaggccaacatggtgcagaagagcaagaggaggacctccatgcccctgctgaatgacatccaccaggtgcagacagctgacctgcggcgggtgtctgcccctcctggcagcttcaccatcccccagagcgtgcctgaccggctgcgcatccgggtgaacaagatcagcctgcaggactatgagggcttccactatgacaaggagaagctgcgggaggccagcatccccctgggcatcctggtggtgcggggggactgtgacctggagacctgcaggatgtacatcgaccggctgcaggaggacctgcagagcgtgagcagcggcagccagagggtgcactaccaggaccacgagaccagcttcccccgggccctgagcgcccagaggctgagcccccgctggtgcttcctggatgacaggagccaggagcacctgcactttgtgatggagatcagccaggatgagatcttcatcctggaccctgacatggtggtgtcccagcctgctggcaccccacctggcatgccagacctggtggtggagcaggccagcggcatcagtgactggtggaacccagccctgaggaagaggatgctgagtgacagcggcctgggcatgattgccccctactatgaagattctgacctgaaggacctgagccacagccgggtgctgcagagccctgtgtccagtgaagatcatgccatcctgcaggccgtgattgctggggacctgatgaagctgattgagagctacaagaatggaggcagcctgctgatccagggccctgaccactgcagcctgctgcactatgctgccaagacaggaaatggagaaattgtgaagtacatcctggaccacggccccagcgagctgctggacatggctgacagcgagactggagaaacagccctgcacaaggccgcctgccagaggaacagagctgtgtgccagctgctggtggatgctggggccagcctgaggaagacagacagcaagggcaagaccccccaggagcgggcccagcaggccggggaccctgacctggccgcctacctggagagccggcagaactacaaggtgattggacatgaggacctggagacagctgtgtag

SEQ ID NO: 149909 - DNA, 2949 bp, Artificial Sequence
  Description of Artificial Sequence: Synthetic coding sequence
atgaaccccagcagcagcgctggggaggagaagggggccaccggcggcagcagcagcagcggcagcggggccggcagctgctgcctgggcgctgagggcggcgctgaccccaggggggccggcagcgctgctgctgctggagctgctgccctggatgagcctgctgctgctggccagaaggagaaggatgaggccctggaggagaagctgaggaacctgaccttcaggaagcaggtgtcctacaggaaggccatcagccgggccggcctgcagcacctggccccagcccaccccctgagcctgcctgtggccaatggacctgccaaggagccccgggccaccctggactggagcgaaaatgctgtgaatggagagcacctgtggctggagaccaacgtgtctggggacctgtgctacctgggggaggagaactgccaggtgcgctttgccaagagcgccctgcggaggaaatgtgctgtgtgcaagatcgtggtgcacacagcctgcatcgagcagctggagaagatcaacttccgctgcaagcccaccttccgggagggcggcagccgcagcccccgggagaactttgtgcgccaccactgggtgcacagaagacggcaggagggcaagtgcaagcagtgtgggaagggcttccagcagaagttctccttccacagcaaggagatcgtggccatcagctgctcctggtgcaagcaggccttccacaacaaggtgacctgcttcatgctgcaccacatcgaggagccctgcagcctgggcgcccatgctgctgtgattgtgccccccacctggatcatcaaggtgaagaagccccagaacagcctgaaggccagcaacaggaagaagaagaggaccagcttcaagaggaaggccagcaagaggggcatggagcaggagaacaagggccggcccttcgtcatcaagcccatcagcagccccctgatgaagcccctgctggtgtttgtgaaccccaagagcggcggcaaccagggcaccaaggtgctgcagatgttcatgtggtacctgaacccccggcaggtgtttgacctgagccaggagggccccaaggatgccctggagctgtacaggaaggtgcccaacctgcgcatcctggcctgtggaggagatggcaccgtgggctggatcctgagcatcctggatgagctgcagctgagcccccagccccctgtgggcgtgctgcccctgggcactggaaatgacctggcccggaccctgaactggggcggcggctacacagatgagcctgtgtccaagatcctgtgccaggtggaggatggcaccgtggtgcagctggaccgctggaacctgcacgtggagaggaacccagacctgcccccagaggagctggaggatggagtgtgcaagctgcccctgaatgtgttcaacaactacttcagcctgggctttgatgcccacgtgaccctggagttccacgagagccgggaggccaaccctgagaagttcaacagccgcttcaggaacaagatgttttatgctggggccgccttcagtgacttcctgcagaggagcagccgggacctgagcaagcacgtgaaggtggtgtgtgatggaacagacctgacccccaagatccaggagctgaagttccagtgcatcgtgttcctgaacatcccccgctactgtgccggcaccatgccctggggcaaccctggggaccaccacgactttgagccccagagacatgatgatggctacattgaagtcatcggcttcaccatggccagcctggccgccctgcaggtgggcggccatggagagcggctgcaccagtgccgggaggtgatgctgctgacctacaagagcatccccatgcaggtggatggagagccctgccgcctggccccagccatgatccgcatcagcctgaggaaccaggccaacatggtgcagaagagcaagaggaggacctccatgcccctgctgaatgacccccagagcgtgcctgaccggctgcgcatccgggtgaacaagatcagcctgcaggactatgagggcttccactatgacaaggagaagctgcgggaggccagcatcagtgactggctgcggaccatcgccggggagctggtgcagagctttggagccatccccctgggcatcctggtggtgcggggggactgtgacctggagacctgcaggatgtacatcgaccggctgcaggaggacctgcagagcgtgagcagcggcagccagagggtgcactaccaggaccacgagaccagcttcccccgggccctgagcgcccagaggctgagcccccgctggtgcttcctggatgccaccagcgctgaccgcttctacagaattgacaggagccaggagcacctgcactttgtgatggagatcagccaggatgagatcttcatcctggaccctgacatggtggtgtcccagcctgctggcaccccacctggcatgccagacctggtggtggagcaggccagcggcagccctgtgtccagtgaagatcatgccatcctgcaggccgtgattgctggggacctgatgaagctgattgagagctacaagaatggaggcagcctgctgatccagggccctgaccactgcagcctgctgcactatgctgccaagacaggaaatggagaaattgtgaagtacatcctggaccacggccccagcgagctgctggacatggctgacagcgagactggagaaacagccctgcacaaggccgcctgccagaggaacagagctgtgtgccagctgctggtggatgctggggccagcctgaggaagacagacagcaagggcaagaccccccaggagcgggcccagcaggccggggaccctgacctggccgcctacctggagagccggcagaactacaaggtgattggacatgaggacctggagacagctgtgtag

SEQ ID NO: 149910 - DNA, 2829 bp, Artificial Sequence
  Description of Artificial Sequence: Synthetic coding sequence
atggctgctgctgctgagcccggggcccgggcctggctgggcggcggcagcccccggcccggcagccctgcctgcagccctgtgctgggcagcggcggccgggcccggcccggccctggccctggccctggccctgagcgggccggcgtgcgggcccctggccctgctgctgcccctggccacagcttcaggaaggtgaccctgaccaagcccaccttctgccacctgtgcagcgacttcatctggggcctggccggcttcctgtgtgatgtgtgcaacttcatgagccatgagaagtgcctgaagcacgtgcgcatcccctgcacctctgtggcccccagcctggtgcgggtgcctgtggcccactgcttcggcccccggggcctgcacaagaggaagttctgtgctgtgtgcaggaaggtgctggaggccccagccctgcactgtgaggtgtgtgagctgcacctgcacccagactgtgtgccctttgcctgcagcgactgccggcagtgccaccaggacggccaccaggaccatgacacccaccaccaccactggagggagggcaacctgcccagcggggcccgctgtgaggtgtgcaggaagacctgtggcagcagtgatgtgctggccggcgtgcgctgtgagtggtgtggggtgcaggcccacagcctgtgcagcgctgccctggccccagaatgtggcttcggccgcctgcggagcctggtgctgcccccagcctgtgtgcggctgctgcccggcggcttcagcaagacccagagcttccgcatcgtggaggccgctgagcccggggagggcggagatggagcagatggcagcgctgctgtgggccctggccgggagacccaggccaccccagagagcggcaagcagaccctgaagatctttgatggagatgatgctgtgcggcgcagccagttccggctggtgacagtgtcccggctggccggggctgaggaggtgctggaggccgccctgcgggcccaccacatccctgaggaccccggccacctggagctgtgccgcctgccccccagcagccaggcctgtgatgcctgggccggcggcaaggccggcagcgctgtgatcagcgaggagggccgcagccctggcagcggggaggccaccccagaggcctgggtgatccgggccctgccccgggcccaggaggtgctgaagatctacccaggctggctgaaggtgggcgtggcctacgtgtctgtgcgggtgacccccaagagcacagcccggtctgtggtgctggaggtgctgcccctgctgggccggcaggccgagagccctgagagcttccagctggtggaggtggccatgggctgcagacatgtgcagaggaccatgctgatggatgagcagcccctgctggaccggctgcaggacatccggcagatgtctgtgcggcaggtgtcccagacccgcttctacgtggccgagagcagagatgtggccccccacgtgtccctgtttgtgggcggcctgcccccaggcctgagccctgaggagtacagcagcctgctgcacgaggccggggccaccaaggccaccgtggtgtctgtgagccacatctacagcagccagggcgctgtggtgctggatgtggcctgctttgctgaggccgagcggctgtacatgctgctgaaggacatggctgtgcggggccgcctgctgacagccctggtgctgcctgacctgctgcacgccaagctgcccccagacagctgccccctgctggtgtttgtgaaccccaagagcggcggcctgaagggccgggacctgctgtgcagcttcaggaagctgctgaacccccaccaggtgtttgacctgaccaatggaggccccctgcccggcctgcacctgttcagccaggtgccctgcttccgggtgctggtgtgtggaggagatggcaccgtgggctgggtgctgggcgccctggaggagacccgctaccgcctggcctgcccagagcccagcgtggccatcctgcccctgggcactggaaatgacctgggccgggtgctgcgctggggcgccggctacagcggggaggaccccttctctgtgctgctgtctgtggatgaagcagatgctgtgctgatggaccgctggaccatcctgctggatgcccacgaggccggcagcgcagaaaatgacacagcagatgctgagccccccaagatcgtgcagatgagcaactactgcggcatcggcattgatgctgagctgagcctggacttccaccaggcccgggaggaggagcccgggaagttcaccagccggctgcacaacaagggcgtgtatgtgcgggtgggcctgcagaagatcagccacagccgcagcctgcacaagcagatccggctgcaggtggagcggcaggaggtggagctgcccagcattgagggcctcatcttcatcaacatccccagctggggcagcggggctgacctgtggggcagtgacagcgacaccaggtttgagaagcccaggatggatgatggcctgctggaggtggtgggcgtgactggagtggtgcacatgggccaggtgcagggcggcctgcggagcggcatcagaattgcccagggcagctacttccgggtgaccctgctgaaggccacccctgtgcaggtggatggagagccctgggtgcaggcccctggccacatgatcatctctgctgctggccccaaggtgcacatgctgaggaaggccaagcagaagcccaggagagctggcaccaccagagatgcccgggcagatgctgccccagcccctgagagtgaccccaggtag

SEQ ID NO: 149911 - DNA, 1632 bp, Artificial Sequence
  Description of Artificial Sequence: Synthetic coding sequence
atgcctggcatggtgctgtttggaagacgctgggccatcgccagtgatgacctggtgtttcctggcttctttgagctggtggtgcgggtgctgtggtggattggcatcctgaccctgtacctgatgcaccggggcaagctggactgtgccggcggggccctgctgagcagctacctgattgtgctgatgatcctgctggccgtggtgatctgcaccgtgtctgccatcatgtgtgtgtccatgaggggcaccatctgcaaccctggccccaggaagtccatgagcaagctgctgtacatccggctggccctcttcttccctgagatggtgtgggccagcctgggcgccgcctgggtggctgatggagtgcagtgtgacagaacagtggtgaatggcatcatcgccaccgtggtggtgaggacccagatctggtgcccagccaccctgcggcgggccagcccctgcttcatcagcaacagaaccatcagcggcaccaccaagagcctgccccgctggagcgccatgccccagggcgcccccagctgccgcagcaggaccacagattatgacctggtgggcggggaccagctgaactgccacttcggcagcatcctgcacaccaccggcctgcagtacagagacttcatccacgtgtccttccatgacaaggtgtatgagctgcccttcctggtggccctggaccacaggaaggagagcgtggtggtggccgtgcggggcaccatgagcctgcaggatgtgctgacagacctgtctgctgagagcgaggtgctggatgtggagtgtgaggtgcaggaccggctggcccacaagggcatcagccaggccgcccgctacgtgtaccagaggctcatcaatgatggcatcctgagccaggccttcagcatcgcccctgagtaccgcctggtgattgtgggccacagcctgggcggcggggccgccgccctgctggccaccatgctgcgggccgcctacccccaggtgcgctgctacgccttcagccccccccggggcctgtggagcaaggccctgcaggagtacagccagagcttcatcgtgtccctggtgctgggcaaggatgtgatcccccggctgtctgtgaccaacctggaggacctgaagaggcgcatcctgcgggtggtggcccactgcaacaagcccaagtacaagatcctgctgcacggcctgtggtatgagctgtttggaggcaaccccaacaacctgcccacagagctggatggaggagaccaggaggtgctgacccagcccctgctgggggagcagagcctgctgacccgctggagccctgcctacagcttcagcagtgacagccccctggacagcagccccaagtacccacccctgtacccacctggccgcatcatccacctgcaggaggagggcgccagcggccgcttcggctgctgcagcgctgcccactacagcgccaagtggagccatgaagctgagttcagcaagatcctgattggccccaagatgctgacagaccacatgccagacatcctgatgagggccctggacagcgtggtgtctgacagagctgcctgtgtgtcctgcccagcccagggcgtgtcctctgtggatgtggcctag

SEQ ID NO: 149912 - DNA, 3129 bp, Artificial Sequence
  Description of Artificial Sequence: Synthetic coding sequence
atgcctggcatcgtggtgttcagaagacgctggagcgtgggcagtgatgacctggtgctgcctgccatcttcctgttcctgctgcacaccacctggtttgtgatcctgtctgtggtgctgtttggcctggtgtacaacccccatgaggcctgcagcctgaacctggtggaccacggccggggctacctgggcatcctgctgagctgcatgattgctgagatggccatcatctggctgtccatgagaggaggcatcctgtacacagagccccgggacagcatgcagtatgtgctgtatgtgcggctggccatcctggtgattgagttcatctatgccatcgtgggcatcgtgtggctgacccagtactacaccagctgcaatgacctgacagccaagaatgtgaccctgggcatggtggtgtgcaactgggtggtgatcctgtctgtgtgcatcaccgtgctgtgtgtgtttgaccccaccggccgcacctttgtgaagctgcgggccaccaagaggcggcagaggaacctgcggacctacaacctgcggcaccggctggaggagggccaggccacctcctggagccggcggctgaaggtgttcctgtgctgcaccaggaccaaggacagccagagtgatgcctacagcgagatcgcctacctgtttgctgagttcttccgggacctggacatcgtgcccagcgacatcatcgccggcctggtgctgctgcggcagaggcagagggccaagagaaatgctgtgctggatgaggccaacaatgacatcctggccttcctgagcggcatgcctgtgaccaggaacaccaagtacctggacctgaagaacagccaggagatgctgcgctacaaggaggtgtgctactacatgctgtttgccctggccgcctacggctggcccatgtacctgatgaggaagccagcctgtggcctgtgccagctggcccggagctgcagctgctgcctgtgcccagcccggcccaggtttgcccctggggtgaccatcgaggaggacaactgctgcggctgcaatgccatcgccatcagaagacacttcctggatgagaacatgacagctgtggacatcgtgtacaccagctgccatgatgctgtgtatgagacccccttctacgtggccgtggaccatgacaagaagaaggtggtgatcagcatccggggcaccctgagccccaaggatgccctgacagacctgactggagatgctgagcggctgcctgtggagggccaccacggcacctggctgggccacaagggcatggtgctgtctgctgagtacatcaagaagaagctggagcaggagatggtgctgagccaggccttcggccgggacctgggccggggcaccaagcactacggcctgattgtggtgggccacagcctgggcgccggcacagctgccatcctgtccttcctgctgcggccccagtaccccaccctgaagtgctttgcctacagccccccaggcggcctgctgtctgaagatgccatggagtacagcaaggagtttgtgacagctgtggtgctgggcaaggacctggtgcccagaattggcctgagccagctggagggcttccggcggcagctgctggatgtgctgcagaggagcaccaagcccaagtggaggatcatcgtgggcgccaccaagtgcatccccaagtctgagctgcctgaggaggtggaggtgaccaccctggccagcacccggctgtggacccaccccagcgacctgaccatcgccctgagcgccagcacccccctgtacccacctggccgcatcatccacgtggtgcacaaccaccctgctgagcagtgctgctgctgtgagcaggaggagcccacctactttgccatctggggagacaacaaggccttcaatgaggtgatcatcagccctgccatgctgcacgagcacctgccctacgtggtgatggagggcctgaacaaggtgctggagaactacaacaagggcaagacagccctgctgtctgctgccaaggtgatggtgagccccacagaggtggacctgaccccagagctgatcttccagcagcagcccctgcccactggaccacccatgcccaccggcctggccctggagctgcccacagctgaccacaggaacagctctgtgcgcagcaagagccagagcgagatgagcctggagggcttcagcgagggccgcctgctgagccctgtggtggccgctgctgcccggcaggaccctgtggagctgctgctgctgagcacccaggagcggctggccgctgagctgcaggcccggcgggcccccctggccaccatggagagcctgagtgacacagagagcctgtacagctttgacagcagaagaagcagcggcttccgcagcatccggggcagccccagcctgcatgctgtgctggagagagatgagggccacctgttctacattgatcctgccatccctgaggagaaccccagcctgagcagcaggacagagctgctggccgctgacagcctgagcaagcacagccaggacacccagcccctggaggccgccctgggcagcggcggcgtgaccccagagcggccccccagcgctgctgccaatgatgaggaggaggaggtgggcggcggcggcggcggccctgccagcagaggagagctggccctgcacaacggccgcctgggggacagccccagcccccaggtgctggagtttgctgagttcatcgacagcctcttcaacctggacagcaagagcagcagcttccaggacctgtactgcatggtggtgcctgagagccccaccagtgactatgcagagggccccaagagccccagccagcaggagatcctgctgcgggcccagtttgagcccaacctggtgcccaagccaccccggctgtttgctggcagcgctgaccccagcagcggcatcagcctgagccccagcttccccctgagcagcagtggagagctgatggacctgacccccaccggcctgagcagccaggagtgcctggccgctgacaagatccgcaccagcacccccactggacatggagccagccctgccaagcaggatgagctggtgatcagcgccaggtag

SEQ ID NO: 149913 - DNA, 2019 bp, Artificial Sequence
  Description of Artificial Sequence: Synthetic coding sequence
atgcctggcatggtgctgtttggaagacgctgggccatcgccagtgatgacctggtgtttcctggcttctttgagctggtggtgcgggtgctgtggtggattggcatcctgaccctgtacctgatgcaccggggcaagctggactgtgccggcggggccctgctgagcagctacctgattgtgctgatgatcctgctggccgtggtgatctgcaccgtgtctgccatcatgtgtgtgtccatgaggggcaccatctgcaaccctggccccaggaagtccatgagcaagctgctgtacatccggctggccctcttcttccctgagatggtgtgggccagcctgggcgccgcctgggtggctgatggagtgcagtgtgacagaacagtggtgaatggcatcatcgccaccgtggtggtgtcctggatcatcatcgccgccaccgtggtgtccatcatcatcgtgtttgaccccctgggcggcaagatggccccctacagcagcgctggccccagccacctggacagccatgacagcagccagctgctgaatggcctgaagacagctgccacctctgtgtgggagacccgcatcaagctgctgtgctgctgcatcggcaaggatgaccacaccagggtggccttcagcagcacagctgagctgttcagcacctacttcagtgacacagacctggtgcccagcgacattgctgctggcctggccctgctgcaccagcagcaggacaacatccggaacaaccaggagcccgcccaggtggtgtgccacgcccctggcagcagccaggaggccgacctggatgctgagctggagaactgccaccactacatgcagtttgctgctgctgcctacggctggcccctgtacatctacagaaaccccctgaccggcctgtgccgcatcggcggggactgctgccgcagcaggaccacagattatgacctggtgggcggggaccagctgaactgccacttcggcagcatcctgcacaccaccggcctgcagtacagagacttcatccacgtgtccttccatgacaaggtgtatgagctgcccttcctggtggccctggaccacaggaaggagagcgtggtggtggccgtgcggggcaccatgagcctgcaggatgtgctgacagacctgtctgctgagagcgaggtgctggatgtggagtgtgaggtgcaggaccggctggcccacaagggcatcagccaggccgcccgctacgtgtaccagaggctcatcaatgatggcatcctgagccaggccttcagcatcgcccctgagtaccgcctggtgattgtgggccacagcctgggcggcggcgctgctgccctgctggccaccatgctgcgggccgcctacccccaggtgcgctgctacgccttcagccccccccggggcctgtggagcaaggccctgcaggagtacagccagagcttcatcgtgtccctggtgctgggcaaggatgtgatcccccggctgtctgtgaccaacctggaggacctgaagaggcgcatcctgcgggtggtggcccactgcaacaagcccaagtacaagatcctgctgcacggcctgtggtatgagctgtttggaggcaaccccaacaacctgcccacagagctggatggaggagaccaggaggtgctgacccagcccctgctgggggagcagagcctgctgacccgctggagccctgcctacagcttcagcagtgacagccccctggacagcagccccaagtacccacccctgtacccacctggccgcatcatccacctgcaggaggagggcgccagcggccgcttcggctgctgcagcgctgcccactacagcgccaagtggagccatgaggccgagttcagcaagatcctgattggccccaagatgctgacagaccacatgccagacatcctgatgagggccctggacagcgtggtgtctgaccgggccgcctgtgtgtcctgcccagcccagggcgtgtcctctgtggatgtggcctag

SEQ ID NO: 149914 - DNA, 663 bp, Artificial Sequence
  Description of Artificial Sequence: Synthetic coding sequence
atgtactgtgtgagccaccacgtgtgccagcacgagaggacccagatctggtgcccagccaccctgcggcgggccagcccctgcttcatcagcaacagaaccatcagcggcaccaccaagagcctgccccgctggagcgccatgccccagggcgcccccagctgccgcagcaggaccacagattatgacctggtgggcggggaccagctgaactgccacttcggcagcatcctgcacaccaccggcctgcagtacagagacttcatccacgtgtccttccatgacaaggtgtatgagctgcccttcctggtggccctggaccacaggaaggagagcgtggtggtggccgtgcggggcaccatgagcctgcaggatgtgctgacagacctgtctgctgagagcgaggtgctggatgtggagtgtgaggtgcaggaccggctggcccacaagggcatcagccaggccgcccgctacgtgtaccagaggctcatcaatgatggcatcctgagccaggccttcagcatcgcccctgagtaccgcctggtgattgtgggccacagcctgggcggcggcgctgctgccctgctggccaccatgctgcgggccgcctacccccaggtgcgctgctacgccttcagccccccccggggcctgtggaggtag

SEQ ID NO: 149915 - DNA, 1140 bp, Artificial Sequence
  Description of Artificial Sequence: Synthetic coding sequence
atgtactgtgtgagccaccacgtgtgccagcacgagagctggatcatcatcgccgccaccgtggtgtccatcatcatcgtgtttgaccccctgggcggcaagatggccccctacagcagcgctggccccagccacctggacagccatgacagcagccagctgctgaatggcctgaagacagctgccacctctgtgtgggagacccgcatcaagctgctgtgctgctgcatcggcaaggatgaccacaccagggtggccttcagcagcacagctgagctgttcagcacctacttcagtgacacagacctggtgcccagcgacattgctgctggcctggccctgctgcaccagcagcaggacaacatccggaacaaccaggagcccgcccaggtggtgtgccacgcccctggcagcagccaggaggccgacctggatgctgagctggagaactgccaccactacatgcagtttgctgctgctgcctacggctggcccctgtacatctacagaaaccccctgaccggcctgtgcagaattggaggagactgctgccgcagcaggaccacagattatgacctggtgggcggggaccagctgaactgccacttcggcagcatcctgcacaccaccggcctgcagtacagagacttcatccacgtgtccttccatgacaaggtgtatgagctgcccttcctggtggccctggaccacaggaaggagagcgtggtggtggccgtgcggggcaccatgagcctgcaggatgtgctgacagacctgtctgctgagagcgaggtgctggatgtggagtgtgaggtgcaggaccggctggcccacaagggcatcagccaggccgcccgctacgtgtaccagaggctcatcaatgatggcatcctgagccaggccttcagcatcgcccctgagtaccgcctggtgattgtgggccacagcctgggcggcggggccgccgccctgctggccaccatgctgcgggccgcctacccccagcagagcagcgctggcatcttcagcgagctgcaccgggtgaccaggcctggagagggctgtgacagccaggcccagtgtgaccagctgggccgctctgaggagaagaacctggccagcggccgggccctgcagtag

SEQ ID NO: 149916 - DNA, 804 bp, Artificial Sequence
  Description of Artificial Sequence: Synthetic coding sequence
atgcctggcatggtgctgtttggaagacgctgggccatcgccagtgatgacctggtgtttcctggcttctttgagctggtggtgcgggtgctgtggtggattggcatcctgaccctgtacctgatgcaccggggcaagctggactgtgccggcggggccctgctgagcagctacctgattgtgctgatgatcctgctggccgtggtgatctgcaccgtgtctgccatcatgtgtgtgtccatgaggggcaccatctgcaaccctggccccaggaagtccatgagcaagctgctgtacatccggctggccctcttcttccctgagatggtgtgggccagcctgggcgccgcctgggtggctgatggagtgcagtgtgacagaacagtggtgaatggcatcatcgccaccgtggtggtgtcctggatcatcatcgccgccaccgtggtgtccatcatcatcgtgtttgaccccctgggcggcaagatggccccctacagcagcgctggccccagccacctggacagccatgacagcagccagctgctgaatggcctgaagacagctgccacctctgtgtgggagacccgcatcaagctgctgtgctgctgcatcggcaaggatgaccacaccagggtggccttcagcagcacagctgagctgttcagcacctacttcagtgacacagacctggtgcccagcgacattgctgctggcctggccctgctgcaccagcagcaggacaacacccgggccaccggcaactgccccagaaatgatggcctgaccctgctgagcctgaactag

SEQ ID NO: 149917 - DNA, 1467 bp, Artificial Sequence
  Description of Artificial Sequence: Synthetic coding sequence
atgggagaccggggcagcagcagaagaagaagaacaggcagccggcccagcagccatggaggcggcggccctgctgctgctgaggaggaggtgagagatgctgctgctggcccagatgtgggcgctgctggagatgccccagccccagcccccaacaaggatggagatgctggggtgggcagcggccactgggagctgcgctgccaccggctgcaggacagcctcttcagcagtgacagcggcttcagcaactaccggggcatcctgaactggtgtgtggtgatgctgatcctgagcaatgcccggctcttcctggagaacctgatcaagtatggcatcctggtggaccccatccaggtggtgtccctcttcctgaaggacccctacagctggccagccccctgcctggtgattgctgccaacgtgtttgctgtggccgccttccaggtggagaagaggctggccgtgggcgccctgacagagcaggccggcctgctgctgcacgtggccaacctggccaccatcctgtgcttccctgctgctgtggtgctgctggtggagagcatcacccctgtgggcagcctgctggccctgatggcccacaccatcctcttcctgaagctgttctcctacagagatgtgaacagctggtgcagaagagcccgggccaaggccgccagcgctgggaagaaggccagcagcgctgctgccccccacacagtgtcctacccagacaacctgacctacagagacctgtactacttcctgtttgcccccaccctgtgctatgagctgaacttccccaggagcccccgcatcaggaagcgcttcctgctgcggcgcatcctggagatgctgttcttcacccagctgcaggtgggcctcatccagcagtggatggtgcccaccatccagaacagcatgaagcccttcaaggacatggactacagccgcatcatcgagcggctgctgaagctggccgtgcccaaccacctgatctggctgatcttcttctactggctgttccacagctgcctgaatgctgtggccgagctgatgcagtttggagaccgggagttctacagagactggtggaacagcgagagcgtgacctacttctggcagaactggaacatccctgtgcacaagtggtgcatccgccacttctacaagcccatgctgcggcggggcagcagcaagtggatggccaggactggagtcttcctggccagcgccttcttccacgagtacctggtgtctgtgcccctgaggatgttccggctgtgggccttcaccggcatgatggcccagatccccctggcctggtttgtgggccgcttcttccagggcaactatggaaatgctgctgtgtggctgagcctcatcatcggccagcccatcgctgtgctgatgtatgtgcatgactactacgtgctgaactatgaggccccagctgctgaggcctag

SEQ ID NO: 149918 - DNA, 282 bp, Artificial Sequence
  Description of Artificial Sequence: Synthetic coding sequence
atgaagctgctgatggtgctgatgctggccgccctgagccagcactgctacgccggcagcggctgccccctgctggagaatgtcatcagcaagaccatcaacccccaggtgtccaagacagagtacaaggagctgctgcaggagttcattgatgacaatgccaccaccaatgccattgatgagctgaaggagtgcttcctgaaccagacagatgagaccctgagcaatgtggaggtgttcatgcagctgatctatgacagcagcctgtgtgacctcttctag

SEQ ID NO: 149919 - DNA, 1038 bp, Artificial Sequence
  Description of Artificial Sequence: Synthetic coding sequence
atgaagaccctgattgctgcctacagcggcgtgctgcggggggagcggcaggccgaggccgacaggagccagaggagccatggaggccctgccctgagccgggagggcagcggccgctggggcgtggcctgcagcgccatcctgatgtacatcttctgcacagactgctggctgattgctgtgctgtacttcacctggctggtgtttgactggaacacccccaagaagggcggcagaagaagccagtgggtgaggaactgggccgtgtggagatacttccgggactacttccccatccagctggtgaagacccacaacctgctgaccaccaggaactacatcttcggctaccacccccacggcatcatgggcctgggcgccttctgcaacttcagcacagaggccacagaggtgtccaagaagtttcctggcatccggccctacctggccaccctggccggcaacttcaggatgcctgtgctgcgggagtacctgatgtctgggggcatctgccctgtgtcccgggacaccatcgactacctgctgagcaagaatggaagtggaaatgccatcatcatcgtggtgggcggcgctgctgagagcctgagctccatgcctgggaagaatgctgtgaccctgaggaacagaaaaggatttgtgaagctggccctgcggcacggggctgacctggtgcccatctacagctttggagaaaatgaggtgtacaagcaggtgatctttgaggagggctcctggggccgctgggtgcagaagaagttccagaagtacatcggctttgccccctgcatcttccacggccggggcctcttcagcagtgacacctggggcctggtgccctacagcaagcccatcaccaccgtggtgggggagcccatcaccatccccaagctggagcaccccacccagcaggacatcgacctgtaccacaccatgtacatggaggccctggtgaagctgtttgacaagcacaagaccaagtttggcctgcctgagacagaggtgctggaggtgaactag

SEQ ID NO: 149920 - DNA, 3306 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgaacatccagatcaagaccctggctgatgatgtgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcggcggcctgaagaacagcaagcatgagtgcaccctgagcagccaggagtatgtgcatgagctgcggagcggcatcagtgatgagaagctgctgaactgcctggagagcctgcgggtgtccctgaccagcaaccctgtgtcctgggtgaacaactttggacatgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagaaattgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcattgaagaatgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcccggcggggcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgagaacccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccagcttcaccaagacagcccgggagcagtatgagaagctgagcaccatgcacaacaacatgatgaagctgtatgagaacctgggggagtacttcatctttgacagcaagacagtgtccattgaggagttcttcggggacctgaacaacttccgcaccctcttcctggaggccgtgcgggagaacaacaagaggcgggagatggaggagaagacccggcgggccaagctggccaaggagaaggccgagcaggagaagctggagcggcagaagaagaagaagcagctgattgacatcaacaaggagggagatgaaacaggagtgatggacaacctgctggaggccctgcagagcggggccgccttccgggacaggaggaagaggatccccaggaacccagacaacagaagagtgcccctggagaggagccgcagccgccacaatggagccatcagcagcaagtag

SEQ ID NO: 149921 - DNA, 3291 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgaacatccagatcaagaccctggctgatgatgtgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcggcggcctgaagaacagcaagcatgagtgcaccctgagcagccaggagtatgtgcatgagctgcggagcggcatcagtgatgagaagctgctgaactgcctggagagcctgcgggtgtccctgaccagcaaccctgtgtcctgggtgaacaactttggacatgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagaaattgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcattgaagaatgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcccggcggggcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgagaacccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccatcttcaccaagacagcccgggagcagtatgagaagctgagcaccatgcacaacaacatgatgaagctgtatgagaacctgggggagtacttcatctttgacagcaagacagtgtccattgaggagttcttcggggacctgaacaacttccgcaccctcttcctggaggccgtgcgggagaacaacaagaggcgggagatggaggagaagacccggcgggccaagctggccaaggagaaggccgagcaggagaagctggagcggcagaagaagaagaagcagctgattgacatcaacaaggagggagatgaaacaggagtgatggacaacctgctggaggccctgcagagcggggccgccttccgggacaggaggaagaggatccccaggaaccctgtggtgaaccacccctgtgccacccgggccaaccccaggtctgccacctag

SEQ ID NO: 149922 - DNA, 3291 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgaacatccagatcaagaccctggctgatgatgtgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcggcggcctgaagaacagcaagcatgagtgcaccctgagcagccaggagtatgtgcatgagctgcggagcggcatcagtgatgagaagctgctgaactgcctggagagcctgcgggtgtccctgaccagcaaccctgtgtcctgggtgaacaactttggacatgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagaaattgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcattgaagaatgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcccggcggggcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgagaacccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccagcttcaccaagacagcccgggagcagtatgagaagctgagcaccatgcacaacaacatgatgaagctgtatgagaacctgggggagtacttcatctttgacagcaagacagtgtccattgaggagttcttcggggacctgaacaacttccgcaccctcttcctggaggccgtgcgggagaacaacaagaggcgggagatggaggagaagacccggcgggccaagctggccaaggagaaggccgagcaggagaagctggagcggcagaagaagaagaagcagctgattgacatcaacaaggagggagatgaaacaggagtgatggacaacctgctggaggccctgcagagcggggccgccttccgggacaggaggaagaggatccccaggaaccctgtggtgaaccacccctgtgccacccgggccaaccccaggtctgccacctag

SEQ ID NO: 149923 - DNA, 3294 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcgtcatcagcagccacatcaagggcggcctgaagaacagcaagcatgagtgcaccctgagcagccaggagtatgtgcatgagctgcggagcggcatcagtgatgagaagctgctgaactgcctggagagcctgcgggtgtccctgaccagcaaccctgtgtcctgggtgaacaactttggacatgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagaaattgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcattgaagaatgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcccggcggggcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgagaacccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccatcttcaccaagacagcccgggagcagtatgagaagctgagcaccatgcacaacaacatgatgaagctgtatgagaacctgggggagtacttcatctttgacagcaagacagtgtccattgaggagttcttcggggacctgaacaacttccgcaccctcttcctggaggccgtgcgggagaacaacaagaggcgggagatggaggagaagacccggcgggccaagctggccaaggagaaggccgagcaggagaagctggagcggcagaagaagaagaagcagctgattgacatcaacaaggagggagatgaaacaggagtgatggacaacctgctggaggccctgcagagcggggccgccttccgggacaggaggaagaggatccccaggaacccagacaacagaagagtgcccctggagaggagccgcagccgccacaatggagccatcagcagcaagtag

SEQ ID NO: 149924 - DNA, 3306 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgaacatccagatcaagaccctggctgatgatgtgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcggcggcctgaagaacagcaagcatgagtgcaccctgagcagccaggagtatgtgcatgagctgcggagcggcatcagtgatgagaagctgctgaactgcctggagagcctgcgggtgtccctgaccagcaaccctgtgtcctgggtgaacaactttggacatgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagaaattgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcattgaagaatgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcccggcggggcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgagaacccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccatcttcaccaagacagcccgggagcagtatgagaagctgagcaccatgcacaacaacatgatgaagctgtatgagaacctgggggagtacttcatctttgacagcaagacagtgtccattgaggagttcttcggggacctgaacaacttccgcaccctcttcctggaggccgtgcgggagaacaacaagaggcgggagatggaggagaagacccggcgggccaagctggccaaggagaaggccgagcaggagaagctggagcggcagaagaagaagaagcagctgattgacatcaacaaggagggagatgaaacaggagtgatggacaacctgctggaggccctgcagagcggggccgccttccgggacaggaggaagaggatccccaggaacccagacaacagaagagtgcccctggagaggagccgcagccgccacaatggagccatcagcagcaagtag

SEQ ID NO: 149925 - DNA, 3312 bp, Artificial Sequence
  Description of Artificial Sequence: Synthetic coding sequence
atggagcagcccggggctgctgccagcggggccggcggcggcagcgaggagcccggcggcggccgcagcaacaagaggtctgctggcaacagagctgccaatgaggaggagaccaagaacaagcccaagctgaacatccagatcaagaccctggctgatgatgtgcgggaccgcatcaccagcttcaggaagagcacagtgaagaaggagaagcccctcatccagcaccccatcgacagccaggtggccatgtctgagttccctgctgcccagcccctgtatgatgagaggagcctgaacctgtctgagaaggaggtgctggacctgtttgagaagatgatggaggacatgaacctgaatgaggagaagaaggcccccctgaggaacaaggacttcaccaccaagcgggagatggtggtgcagtacatcagcgccacagccaagagcatcgtgggcagcaaggtgactggaggcctgaagaacagcaagcatgaatgtaccctgagcagccaggagtatgtgcatgagctgcggagcggcatcagtgatgagaagctgctgaactgcctggagagcctgcgggtgtccctgaccagcaaccctgtgtcctgggtgaacaactttggccacgagggcctgggcctgctgctggatgagctggagaagctgctggacaagaagcagcaggagaacatcgacaagaagaaccagtacaagctgatccagtgcctgaaggccttcatgaacaacaagtttggcctgcagaggatcctgggagatgagaggagcctgctgctgctggcccgggccatcgaccccaagcagcccaacatgatgacagagatcgtgaagatcctgagcgccatctgcatcgtgggggaggagaacatcctggacaagctgctgggcgccatcaccacagctgctgagaggaacaaccgggagcgcttcagccccatcgtggagggcctggagaaccaggaggccctgcagctgcaggtggcctgcatgcagttcatcaatgccctggtgaccagcccctatgagctggacttccgcatccacctgagaaatgagttcctgcggagcggcctgaagaccatgctgcctgacctgaaggagaaggaaaatgatgagctggacatccagctgaaggtgtttgatgagaacaaggaggatgacctgacagagctgagccaccggctgaatgacatccgggcagagatggatgacatgaatgaggtgtaccacctgctgtacaacatgctgaaggacacagctgctgagaactacttcctgagcatcctgcagcacttcctgctgatcagaaatgactactacatccggccccagtactacaagatcatcgaggagtgtgtgtcccagatcgtgctgcactgcagcggcatggaccctgacttcaagtaccggcagaggctggacatcgacctgacccacctgattgacagctgtgtgaacaaggccaaggtggaggagagcgagcagaaggctgctgagttcagcaagaagtttgatgaggagttcaccgcccggcaggaggcccaggccgagctgcagaagagagatgagaagatcaaggagctggaggccgagatccagcagctgcggacccaggcccaggtgctgagcagcagcagcggcatccctggccccccagctgccccacccctgcccggggtgggccccccacctcctcctccagccccacccctgcctggaggagcccccctgcccccacctcctccacccctgcccggcatgatgggcatccccccacctcctcctccacccctgctgtttggaggccccccacctcctccacccctgggcggcgtgcccccacctcctggcatcagcctgaacctgccctacggcatgaagcagaagaagatgtacaagccagaggtgtccatgaagaggatcaactggagcaagattgagcccacagagctgtctgagaactgcttctggctgcgggtgaaggaggacaagtttgaaaatccagacctgtttgccaagctggccctgaactttgccacccagatcaaggtgcagaagaatgctgaggccctggaggagaagaagacaggccccaccaagaagaaggtgaaggagctgcgcatcctggaccccaagacagcccagaacctgagcatcttcctgggcagctacaggatgccctatgaggacatcagaaatgtcatcctggaggtgaatgaagacatgctgtctgaggccctgatccagaacctggtgaagcacctgcctgagcagaagatcctgaatgagctggccgagctgaagaatgaatatgatgacctgtgtgagcctgagcagtttggagtggtgatgagctctgtgaagatgctgcagccccggctgagcagcatcctcttcaagctgacctttgaggagcacatcaacaacatcaagcccagcatcatcgctgtgaccctggcctgtgaggagctgaagaagtctgagagcttcaaccggctgctggagctggtgctgctggtgggcaactacatgaacagcggcagcagaaatgcccagagcctgggcttcaagatcaacttcctgtgcaagatccgggacaccaagtctgctgaccagaagaccaccctgctgcacttcatcgctgacatctgtgaggagaagtacagagacatcctgaagtttcctgaggagctggagcacgtggagagcgccagcaaggtgtctgcccagatcctgaagagcaacctggcctccatggagcagcagatcgtgcacctggagcgggacatcaagaagttcccccaggccgagaaccagcacgacaagtttgtggagaagatgaccatcttcaccaagacagcccgggagcagtatgagaagctgagcaccatgcacaacaacatgatgaagctgtatgagaacctgggggagtacttcatctttgacagcaagacagtgtccattgaggagttctttggagacctgaacaacttccgcaccctcttcctggaggccgtgcgggagaacaacaagagaagagagatggaggagaagacccggcgggccaagctggccaaggagaaggccgagcaggagaagctggagcggcagaagaagaagaagcagctgattgacatcaacaaggagggagatgagaccggggtgatggacaacctgctggaggccctgcagagcggggccgccttccgggacaggaggaagaggatccccagaaatcctgtggtgaaccacccctgtgccacccgggccaaccccaggtctgccacctag

SEQ ID NO: 149926 - DNA, 735 bp, Artificial Sequence
  Description of Artificial Sequence: Synthetic coding sequence
atggagctgttcctggccggccggcgggtgctggtgactggagctggaaaaggaattggccggggcaccgtgcaggccctgcacgccaccggggcccgggtggtggccgtgtccaggacccaggccgacctggacagcctggtgcgggagtgccccggcatcgagcctgtgtgtgtggacctgggggactgggaggccacagagcgggccctgggctctgtgggccctgtggacctgctggtgaacaatgctgctgtggccctgctgcagcccttcctggaggtgaccaaggaggcctttgacaggagctttgaggtgaacctgcgggccgtcatccaggtgtcccagatcgtggcccggggcctgattgcccggggcgtgcctggggccatcgtgaatgtgagcagccagtgcagccagagagctgtgaccaaccacagcgtgtactgcagcaccaagggggccctggacatgctgaccaaggtgatggccctggagctgggcccccacaagatccgggtgaatgctgtgaaccccaccgtggtgatgacctccatgggccaggccacctggagcgacccccacaaggccaagaccatgctgaaccgcatccccctgggcaagtttgctgaggtggagcacgtggtgaatgccatcctcttcctgctgagtgacagaagtggcatgaccaccggcagcaccctgcctgtggagggcggcttctgggcctgctag

SEQ ID NO: 149927 - DNA, 5769 bp, Artificial Sequence
  Description of Artificial Sequence: Synthetic coding sequence
atgaagagccctgccctgcagcccctgtccatggccggcctgcagctgatgaccccagccagcagccccatgggccccttcttcggcctgccctggcagcaggaggccatccatgacaacatctacacccccaggaagtaccaggtggagctgctggaggccgccctggaccacaacaccatcgtgtgcctgaacacaggcagcggcaagaccttcatcgctgtgctgctgaccaaggagctgagctaccagatccggggggacttcagcagaaatggcaagaggacagtgttcctggtgaacagcgccaaccaggtggcccagcaggtgtctgctgtgaggacccacagcgacctgaaggtgggggagtacagcaacctggaggtgaatgcctcctggaccaaggagcgctggaaccaggagttcaccaagcaccaggtgctgatcatgacctgctacgtggccctgaatgtgctgaagaatggctacctgagcctgagtgacatcaacctgctggtgtttgatgagtgccacctggccatcctggaccacccctaccgggagatcatgaagctgtgtgagaactgccccagctgcccccgcatcctgggcctgacagccagcatcctgaatggaaaatgtgaccctgaggagctggaggagaagatccagaagctggagaagatcctgaagagcaatgctgagacagccacagacctggtggtgctggaccgctacaccagccagccctgtgaaattgtggtggactgtggccccttcacagacaggagcggcctgtatgagcggctgctgatggagctggaggaggccctgaacttcatcaatgactgcaacatctctgtgcacagcaaggagcgggacagcaccctcatcagcaagcagatcctgagtgactgcagagctgtgctggtggtgctgggcccctggtgtgccgacaaggtggccggcatgatggtgcgggagctgcagaagtacatcaagcatgagcaggaggagctgcacaggaagttcctgctcttcacagacaccttcctgaggaagatccacgccctgtgtgaggagcacttctccccagccagcctggacctgaagtttgtgacccccaaggtgatcaagctgctggagatcctgaggaagtacaagccctatgaaaggcagcagtttgaatctgtggagtggtacaacaacagaaaccaggacaactacgtgtcctggagcgacagtgaagatgatgatgaagatgaggagattgaggagaaggagaagccagagaccaacttccccagccccttcaccaacatcctgtgtggcatcatctttgtggagcggcgctacacagctgtggtgctgaacagactcatcaaggaggccggcaagcaggaccctgagctggcctacatcagcagcaacttcatcaccggccacggcatcggcaagaaccagcccaggaacaagcagatggaggccgagttcaggaagcaggaggaggtgctgaggaagttccgggcccacgagaccaacctgctgattgccaccagcatcgtggaggagggcgtggacatccccaagtgcaacctggtggtgcgctttgacctgcccacagagtaccgctcctatgtgcagagcaagggccgggcccgggcccccatcagcaactacatcatgctggccgacacagacaagatcaagagctttgaggaggacctgaagacctacaaggccatcgagaagatcctgaggaacaagtgcagcaagtctgtggacaccggggagacagacattgatcctgtgatggatgatgatgatgtgttccccccctacgtgctgcggccagatgatggcggcccccgggtgaccatcaacacagccatcggccacatcaaccgctactgtgcccggctgcccagcgaccccttcacccacctggcccccaagtgcaggacccgggagctgcctgatggcaccttctacagcaccctgtacctgcccatcaacagccccctgcgggccagcatcgtgggcccccccatgagctgtgtgcggctggccgagcgggtggtggccctgatctgctgtgagaagctgcacaagattggagagctggatgaccacctgatgcctgtgggcaaggagaccgtgaagtatgaggaggagctggacctgcatgatgaggaggagacctctgtgcccggccggcccggcagcaccaagaggcggcagtgctaccccaaggccatcccagaatgtctgcgggacagctaccccaggccagaccagccctgctacctgtatgtgattggcatggtgctgaccacccccctgcctgatgagctgaacttcagaagaaggaagctgtacccacctgaggacaccacccgctgcttcggcatcctgacagccaagcccatcccccagatcccccacttccctgtgtacaccaggtctggagaggtgaccatcagcattgagctgaagaagagcggcttcatgctgagcctgcagatgctggagctgatcacccggctgcaccagtacatcttcagccacatcctgcggctggagaagccagccctggagttcaagcccacagatgctgacagcgcctactgtgtgctgcccctgaatgtggtgaatgacagcagcaccctggacatcgacttcaagttcatggaggacatcgagaagtctgaggccagaattggcatccccagcaccaagtacaccaaggagaccccatttgtgttcaagctggaggactaccaggatgctgtgatcatcccccgctacagaaactttgaccagccccaccgcttctacgtggctgatgtgtacacagacctgacccccctgagcaagttccccagcccagaatatgagacctttgctgagtactacaagaccaagtacaacctggacctgaccaacctgaaccagcccctgctggatgtggaccacaccagcagccggctgaacctgctgacccccaggcacctgaaccagaagggcaaggccctgcccctgagcagcgctgagaagaggaaggccaagtgggagagcctgcagaacaagcagatcctggtgcctgagctgtgtgccatccaccccatcccagccagcctgtggaggaaggctgtgtgcctgcccagcatcctgtaccgcctgcactgcctgctgacagctgaggagctgcgggcccagacagccagtgatgctggggtgggcgtgcgcagcctgcctgctgacttccgctaccccaacctggactttggctggaagaagagcattgacagcaagagcttcatcagcatcagcaacagcagcagcgcagaaaatgacaactactgcaagcacagcaccatcgtgcctgaaaatgctgcccaccagggcgccaacagaaccagcagcctggagaaccacgaccagatgtctgtgaactgcaggaccctgctgtctgagagccctgggaagctgcacgtggaggtgtctgctgacctgacagccatcaatggcctgagctacaaccagaacctggccaacggcagctatgacctggccaacagagacttctgccagggcaaccagctgaactactacaagcaggagatccctgtgcagcccaccaccagctacagcatccagaacctgtacagctatgagaaccagccccagcccagtgatgagtgcaccctgctgagcaacaagtacctggatggaaatgccaacaagagcaccagtgatggcagccctgtgatggctgtgatgcctggcaccacagacaccatccaggtgctgaagggccgcatggattctgagcagagccccagcatcggctacagcagcaggaccctgggccccaaccctggcctcatcctgcaggccctgaccctgagcaatgccagtgatggcttcaacctggagcggctggagatgctgggggacagcttcctgaagcacgccatcaccacctacctgttctgcacctacccagatgcccacgagggccgcctgagctacatgaggagcaagaaggtgagcaactgcaacctgtaccgcctgggcaagaagaagggcctgcccagcaggatggtggtgtccatctttgacccccctgtgaactggctgcccccaggctacgtggtgaaccaggacaagagcaacacagacaagtgggagaaggatgagatgaccaaggactgcatgctggccaacgggaagctggatgaagattatgaggaggaggatgaggaggaggagagcctgatgtggagggcccccaaggaggaggccgactatgaagatgacttcctggagtatgaccaggagcacatccgcttcatcgacaacatgctgatgggcagcggggcctttgtgaagaagatcagcctgagccccttcagcaccacagattctgcctatgagtggaagatgcccaagaagagcagcctgggctccatgcccttcagcagtgactttgaagattttgactacagctcctgggatgccatgtgctacctggaccccagcaaggctgtggaggaggatgactttgtggtgggcttctggaaccccagcgaggagaactgtggggtggacaccgggaagcagagcatctcctatgacctgcacacagagcagtgcatcgctgacaagagcattgctgactgtgtggaggccctgctgggctgctacctgaccagctgtggggagcgggccgcccagctgttcctgtgcagcctgggcctgaaggtgctgcccgtcatcaagaggacagaccgggagaaggccctgtgccccacccgggagaacttcaacagccagcagaagaacctgtctgtgtcctgtgccgccgcctctgtggccagcagccgcagctctgtgctgaaggacagtgaatatggctgcctgaagatccccccacgctgcatgtttgaccacccagatgctgacaagaccctgaaccacctgatcagcggctttgaaaattttgagaagaagatcaactaccgcttcaagaacaaggcctacctgctgcaggccttcacccacgccagctaccactacaacaccatcacagactgctaccagaggctggagttcctgggagatgccatcctggactacctgatcaccaagcacctgtatgaggacccccggcagcacagccctggggtgctgacagacctgcggagcgccctggtgaacaacaccatctttgccagcctggccgtgaagtatgactaccacaagtacttcaaggctgtgtccccagagctgttccacgtgattgatgactttgtgcagttccagctggagaagaatgagatgcagggcatggattctgagctgcggcgctctgaggaggatgaggagaaggaggaggacatcgaggtgcccaaggccatgggagacatctttgagagcctggccggggccatctacatggattctggcatgagcctggagaccgtgtggcaggtgtactaccccatgatgaggcccctcatcgagaagttcagcgccaacgtgcccaggagccctgtgcgggagctgctggagatggagcctgagacagccaagttctccccagctgagaggacctatgatggcaaggtgcgggtgacagtggaggtggtgggcaagggcaagttcaagggcgtgggccgcagctacagaattgccaagtctgctgctgcccggcgggccctgcggagcctgaaggccaaccagccccaggtgcccaacagctag

SEQ ID NO: 149928 - DNA, 5769 bp, Artificial Sequence; identical to SEQ ID NO: 149927
  Description of Artificial Sequence: Synthetic coding sequence

SEQ ID NO: 149929 - DNA, 5769 bp, Artificial Sequence; identical to SEQ ID NO: 149927
  Description of Artificial Sequence: Synthetic coding sequence

SEQ ID NO: 149930 - DNA, 5769 bp, Artificial Sequence; identical to SEQ ID NO: 149927
  Description of Artificial Sequence: Synthetic coding sequence

SEQ ID NO: 149931 - DNA, 213 bp, Artificial Sequence
  Description of Artificial Sequence: Synthetic coding sequence
atgaagagccctgccctgcagcccctgtccatggccggcctgcagctgatgaccccagccagcagccccatgggccccttcttcggcctgccctggcagcaggaggccatccatgacaacatctacacccccaggaagtaccaggtggagctgctggaggccgccctggaccacaacaccatcgtgtgcctgaacacaggcagcggcaagtag

SEQ ID NO: 149932 - DNA, 213 bp, Artificial Sequence; identical to SEQ ID NO: 149931
  Description of Artificial Sequence: Synthetic coding sequence

SEQ ID NO: 149933 - DNA, 5490 bp, Artificial Sequence
  Description of Artificial Sequence: Synthetic coding sequence
atgaagagccctgccctgcagcccctgtccatggccggcctgcagctgatgaccccagccagcagccccatgggccccttcttcggcctgccctggcagcaggaggccatccatgacaacatctacacccccaggaagtaccaggtggagctgctggaggccgccctggaccacaacaccatcgtgtgcctgaacacaggcagcggcaagaccttcatcgctgtgctgctgaccaaggagctgagctaccagatccggggggacttcagcagaaatggcaagaggacagtgttcctggtgaacagcgccaaccaggtggcccagcaggtgtctgctgtgaggacccacagcgacctgaaggtgggggagtacagcaacctggaggtgaatgcctcctggaccaaggagcgctggaaccaggagttcaccaagcaccaggtgctgatcatgacctgctacgtggccctgaatgtgctgaagaatggctacctgagcctgagtgacatcaacctgctggtgtttgatgagtgccacctggccatcctggaccacccctaccgggagatcatgaagctgtgtgagaactgccccagctgcccccgcatcctgggcctgacagccagcatcctgaatggaaaatgtgaccctgaggagctggaggagaagatccagaagctggagaagatcctgaagagcaatgctgagacagccacagacctggtggtgctggaccgctacaccagccagccctgtgaaattgtggtggactgtggccccttcacagacaggagcggcctgtatgagcggctgctgatggagctggaggaggccctgaacttcatcaatgactgcaacatctctgtgcacagcaaggagcgggacagcaccctcatcagcaagcagatcctgagtgactgcagagctgtgctggtggtgctgggcccctggtgtgccgacaaggtggccggcatgatggtgcgggagctgcagaagtacatcaagcatgagcaggaggagctgcacaggaagttcctgctcttcacagacaccttcctgaggaagatccacgccctgtgtgaggagcacttctccccagccagcctggacctgaagtttgtgacccccaaggtgatcaagctgctggagatcctgaggaagtacaagccctatgaaaggcagcagtttgaatctgtggagtggtacaacaacagaaaccaggacaactacgtgtcctggagcgacagtgaagatgatgatgaagatgaggagattgaggagaaggagaagccagagaccaacttccccagccccttcaccaacatcctgtgtggcatcatctttgtggagcggcgctacacagctgtggtgctgaacagactcatcaaggaggccggcaagcaggaccctgagctggcctacatcagcagcaacttcatcaccggccacggcatcggcaagaaccagcccaggaacaagcagatggaggccgagttcaggaagcaggaggaggtgctgaggaagttccgggcccacgagaccaacctgctgattgccaccagcatcgtggaggagggcgtggacatccccaagtgcaacctggtggtgcgctttgacctgcccacagagtaccgctcctatgtgcagagcaagggccgggcccgggcccccatcagcaactacatcatgctggccgacacagacaagatcaagagctttgaggaggacctgaagacctacaaggccatcgagaagatcctgaggaacaagtgcagcaagtctgtggacaccggggagacagacattgatcctgtgatggatgatgatgatgtgttccccccctacgtgctgcggccagatgatggcggcccccgggtgaccatcaacacagccatcggccacatcaaccgctactgtgcccggctgcccagcgaccccttcacccacctggcccccaagtgcaggacccgggagctgcctgatggcaccttctacagcaccctgtacctgcccatcaacagccccctgcgggccagcatcgtgggcccccccatgagctgtgtgcggctggccgagcgggtggtggccctgatctgctgtgagaagctgcacaagattggagagctggatgaccacctgatgcctgtgggcaaggagaccgtgaagtatgaggaggagctggacctgcatgatgaggaggagacctctgtgcccggccggcccggcagcaccaagaggcggcagtgctaccccaaggccatcccagaatgtctgcgggacagctaccccaggccagaccagccctgctacctgtatgtgattggcatggtgctgaccacccccctgcctgatgagctgaacttcagaagaaggaagctgtacccacctgaggacaccacccgctgcttcggcatcctgacagccaagcccatcccccagatcccccacttccctgtgtacaccaggtctggagaggtgaccatcagcattgagctgaagaagagcggcttcatgctgagcctgcagatgctggagctgatcacccggctgcaccagtacatcttcagccacatcctgcggctggagaagccagccctggagttcaagcccacagatgctgacagcgcctactgtgtgctgcccctgaatgtggtgaatgacagcagcaccctggacatcgacttcaagttcatggaggacatcgagaagtctgaggccagaattggcatccccagcaccaagtacaccaaggagaccccatttgtgttcaagctggaggactaccaggatgctgtgatcatcccccgctacagaaactttgaccagccccaccgcttctacgtggctgatgtgtacacagacctgacccccctgagcaagttccccagcccagaatatgagacctttgctgagtactacaagaccaagtacaacctggacctgaccaacctgaaccagcccctgctggatgtggaccacaccagcagccggctgaacctgctgacccccaggcacctgaaccagaagggcaaggccctgcccctgagcagcgctgagaagaggaaggccaagtgggagagcctgcagaacaagcagatcctggtgcctgagctgtgtgccatccaccccatcccagccagcctgtggaggaaggctgtgtgcctgcccagcatcctgtaccgcctgcactgcctgctgacagctgaggagctgcgggcccagacagccagtgatgctggggtgggcgtgcgcagcctgcctgctgacttccgctaccccaacctggactttggctggaagaagagcattgacagcaagagcttcatcagcatcagcaacagcagcagcgcagaaaatgacaactactgcaagcacagcaccatcgtgcctgaaaatgctgcccaccagggcgccaacagaaccagcagcctggagaaccacgaccagatgtctgtgaactgcaggaccctgctgtctgagagccctgggaagctgcacgtggaggtgtctgctgacctgacagccatcaatggcctgagctacaaccagaacctggccaacggcagctatgacctggccaacagagacttctgccagggcaaccagctgaactactacaagcaggagatccctgtgcagcccaccaccagctacagcatccagaacctgtacagctatgagaaccagccccagcccagtgatgagtgcaccctgctgagcaacaagtacctggatggaaatgccaacaagagcaccagtgatggcagccctgtgatggctgtgatgcctggcaccacagacaccatccaggtgctgaagggccgcatggattctgagcagagccccagcatcggctacagcagcaggaccctgggccccaaccctggcctcatcctgcaggccctgaccctgagcaatgccagtgatggcttcaacctggagcggctggagatgctgggggacagcttcctgaagcacgccatcaccacctacctgttctgcacctacccagatgcccacgagggccgcctgagctacatgaggagcaagaaggtgagcaactgcaacctgtaccgcctgggcaagaagaagggcctgcccagcaggatggtggtgtccatctttgacccccctgtgaactggctgcccccaggctacgtggtgaaccaggacaagagcaacacagacaagtgggagaaggatgagatgaccaaggactgcatgctggccaacgggaagctggatgaagattatgaggaggaggatgaggaggaggagagcctgatgtggagggcccccaaggaggaggccgactatgaagatgacttcctggagtatgaccaggagcacatccgcttcatcgacaacatgctgatgggcagcggggcctttgtgaagaagatcagcctgagccccttcagcaccacagattctgcctatgagtggaagatgcccaagaagagcagcctgggctccatgcccttcagcagtgactttgaagattttgactacagctcctgggatgccatgtgctacctggaccccagcaaggctgtggaggaggatgactttgtggtgggcttctggaaccccagcgaggagaactgtggggtggacaccgggaagcagagcatctcctatgacctgcacacagagcagtgcatcgctgacaagagcattgctgactgtgtggaggccctgctgggctgctacctgaccagctgtggggagcgggccgcccagctgttcctgtgcagcctgggcctgaaggtgctgcccgtcatcaagaggacagaccgggagaaggccctgtgccccacccgggagaacttcaacagccagcagaagaacctgtctgtgtcctgtgccgccgcctctgtggccagcagccgcagctctgtgctgaaggacagtgaatatggctgcctgaagatccccccacgctgcatgtttgaccacccagatgctgacaagaccctgaaccacctgatcagcggctttgaaaattttgagaagaagatcaactaccgcttcaagaacaaggcctacctgctgcaggccttcacccacgccagctaccactacaacaccatcacagactgctaccagaggctggagttcctgggagatgccatcctggactacctgatcaccaagcacctgtatgaggacccccggcagcacagccctggggtgctgacagacctgcggagcgccctggtgaacaacaccatctttgccagcctggccgtgaagtatgactaccacaagtacttcaaggctgtgtccccagagctgttccacgtgattgatgactttgtgcagttccagctggagaagaatgagatgcagggcatggattctgagaagagcttcctgcagatgtaccctgtgcccctgtgtgagaactgcctgaagtggaaccagaagctgcccaacctggcccggctgcgggagctgaccaccggccgctctgagagcctgtggaagtag

SEQ ID NO: 149934 - DNA, 2463 bp, Artificial Sequence
  Description of Artificial Sequence: Synthetic coding sequence
atgctggcctgggagagtgaccacttcctgcgcatcctggctgaaaatgacaactactgcaagcacagcaccatcgtgcctgaaaatgctgcccaccagggcgccaacagaaccagcagcctggagaaccacgaccagatgtctgtgaactgcaggaccctgctgtctgagagccctgggaagctgcacgtggaggtgtctgctgacctgacagccatcaatggcctgagctacaaccagaacctggccaacggcagctatgacctggccaacagagacttctgccagggcaaccagctgaactactacaagcaggagatccctgtgcagcccaccaccagctacagcatccagaacctgtacagctatgagaaccagccccagcccagtgatgagtgcaccctgctgagcaacaagtacctggatggaaatgccaacaagagcaccagtgatggcagccctgtgatggctgtgatgcctggcaccacagacaccatccaggtgctgaagggccgcatggattctgagcagagccccagcatcggctacagcagcaggaccctgggccccaaccctggcctcatcctgcaggccctgaccctgagcaatgccagtgatggcttcaacctggagcggctggagatgctgggggacagcttcctgaagcacgccatcaccacctacctgttctgcacctacccagatgcccacgagggccgcctgagctacatgaggagcaagaaggtgagcaactgcaacctgtaccgcctgggcaagaagaagggcctgcccagcaggatggtggtgtccatctttgacccccctgtgaactggctgcccccaggctacgtggtgaaccaggacaagagcaacacagacaagtgggagaaggatgagatgaccaaggactgcatgctggccaacgggaagctggatgaagattatgaggaggaggatgaggaggaggagagcctgatgtggagggcccccaaggaggaggccgactatgaagatgacttcctggagtatgaccaggagcacatccgcttcatcgacaacatgctgatgggcagcggggcctttgtgaagaagatcagcctgagccccttcagcaccacagattctgcctatgagtggaagatgcccaagaagagcagcctgggctccatgcccttcagcagtgactttgaagattttgactacagctcctgggatgccatgtgctacctggaccccagcaaggctgtggaggaggatgactttgtggtgggcttctggaaccccagcgaggagaactgtggggtggacaccgggaagcagagcatctcctatgacctgcacacagagcagtgcatcgctgacaagagcattgctgactgtgtggaggccctgctgggctgctacctgaccagctgtggggagcgggccgcccagctgttcctgtgcagcctgggcctgaaggtgctgcccgtcatcaagaggacagaccgggagaaggccctgtgccccacccgggagaacttcaacagccagcagaagaacctgtctgtgtcctgtgccgccgcctctgtggccagcagccgcagctctgtgctgaaggacagtgaatatggctgcctgaagatccccccacgctgcatgtttgaccacccagatgctgacaagaccctgaaccacctgatcagcggctttgaaaattttgagaagaagatcaactaccgcttcaagaacaaggcctacctgctgcaggccttcacccacgccagctaccactacaacaccatcacagactgctaccagaggctggagttcctgggagatgccatcctggactacctgatcaccaagcacctgtatgaggacccccggcagcacagccctggggtgctgacagacctgcggagcgccctggtgaacaacaccatctttgccagcctggccgtgaagtatgactaccacaagtacttcaaggctgtgtccccagagctgttccacgtgattgatgactttgtgcagttccagctggagaagaatgagatgcagggcatggattctgagctgcggcgctctgaggaggatgaggagaaggaggaggacatcgaggtgcccaaggccatgggagacatctttgagagcctggccggggccatctacatggattctggcatgagcctggagaccgtgtggcaggtgtactaccccatgatgaggcccctcatcgagaagttcagcgccaacgtgcccaggagccctgtgcgggagctgctggagatggagcctgagacagccaagttctccccagctgagaggacctatgatggcaaggtgcgggtgacagtggaggtggtgggcaagggcaagttcaagggcgtgggccgcagctacagaattgccaagtctgctgctgcccggcgggccctgcggagcctgaaggccaaccagccccaggtgcccaacagctag

SEQ ID NO: 149935 - DNA, 801 bp, Artificial Sequence
  Description of Artificial Sequence: Synthetic coding sequence
atgatggccctgggcgctgctggggccaccagggtgtttgtggccatggtggccgccgccctgggcggccaccccctgctgggcgtgtctgccaccctgaacagcgtgctgaacagcaatgccatcaagaacctgcccccacccctgggcggcgctgctggccaccctggcagcgctgtgtctgctgcccctggcatcctgtacccaggcggcaacaagtaccagaccatcgacaactaccagccctacccctgtgctgaagatgaggagtgtggcacagatgagtactgtgccagccccaccagaggaggagatgctggggtgcagatctgcctggcctgcaggaagaggaggaagcgctgcatgagacatgccatgtgctgccccggcaactactgcaagaatggcatctgtgtgtccagtgaccagaaccacttccggggggagattgaggagaccatcacagagagctttggaaatgaccacagcaccctggatggctacagcaggaggaccaccctgagcagcaagatgtaccacaccaagggccaggagggctctgtgtgcctgcggagcagtgactgtgccagcggcctgtgctgtgcccggcacttctggagcaagatctgcaagcctgtgctgaaggagggccaggtgtgcaccaagcacaggaggaagggcagccacggcctggagatcttccagcgctgctactgtggggagggcctgagctgccgcatccagaaggaccaccaccaggccagcaacagcagccggctgcacacctgccagaggcactag

SEQ ID NO: 149936 - DNA, 1689 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcccagaagccctacagcggccggcggccagatgccatccggctgggcctgggcaaccacaactactgcaggaacccagaccgggacagcaagccctggtgctacgtgttcaaggccggcaagtacagcagcgagttctgcagcaccccagcctgcagcgagggcaacagcgactgctactttggaaatggaagtgcctaccggggcacccacagcctgacagagagcggggccagctgcctgccctggaacagcatgatcctgattggcaaggtgtacacagcccagaaccccagcgcccaggccctgggcctgggcaagcacaactactgcaggaacccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcacagaagaagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 149937 - DNA, 420 bp, Artificial Sequence
  Description of Artificial Sequence: Synthetic coding sequence
atggtggccgctgtgctgctgggcctgtcctggctgtgcagccccctgggcgccctggtgctggacttcaacaacatccgcagcagcgctgacctgcatggagccaggaagggcagccagtgcctgagtgacacagactgcaacaccaggaagttctgcctgcagcccagagatgagaagcccttctgtgccacctgccggggcctgcggcggcgctgccagagagatgccatgtgctgccccggcaccctgtgtgtgaatgatgtgtgcaccaccatggaggatgccacccccatcctggagcggcagctggatgagcaggacggcacccacgccgagggcaccaccggccaccctgtgcaggagaaccagcccaagaggaagcccagcatcaagaagagcagctccatgctggactag

SEQ ID NO: 149938 - DNA, 1683 bp, Artificial Sequence
  Description of Artificial Sequence: Synthetic coding sequence
atgagggacctgcccctgaccagcctggccctggtgctgagcgccctgggcgccctgctgggcacagaggccctgcgggcagaggagcctgctgtgggcaccagcggcctcatcttccgggaggacctggactggcccccaggcagcccccaggagcccctgtgcctggtggccctgggcggggacagcaatggcagcagcagccccctgcgggtggtgggcgccctgagcgcctatgagcaggccttcctgggcgctgtgcagagggcccgctggggcccccgggacctggccaccttcggcgtgtgcaacacaggagaccggcaggccgccctgcccagcctgcggcggctgggcgcctggctgcgggaccccggcggccagaggctggtggtgctgcacctggaggaggtgacctgggagcccacccccagcctgcgcttccaggagcccccacctggaggagctggccccccagagctggccctgctggtgctgtacccaggccctggccctgaggtgacagtgaccagggctggcctgcccggggcccagagcctgtgccccagccgggacacccgctacctggtgctggccgtggacaggcctgctggggcctggaggggcagcggcctggccctgaccctgcagcccagaggagaggacagccggctgagcacagcccggctgcaggccctgctgtttggagatgaccaccgctgcttcaccaggatgaccccagccctgctgctgctgcccaggtctgagcccgcccccctgcctgcccacggccagctggacacagtgcccttccccccaccccggcccagcgctgagctggaggagagcccccccagcgctgaccccttcctggagaccctgacccggctggtgcgggccctgcgggtgcccccagcccgggccagcgccccccggctggccctggaccctgatgccctggccggcttcccccagggcctggtgaacctgagtgaccctgctgccctggagcggctgctggatggagaggagcccctgctgctgctgctgcggcccacagctgccaccactggagaccctgcccccctgcatgaccccaccagcgccccctgggccacagccctggccaggagagtggccgctgagctgcaggccgctgctgctgagctgcggagcctgcccggcctgcccccagccacagcccccctgctggcccggctgctggccctgtgccctgggggccctgggggcctgggggaccccctgcgggccctgctgctgctgaaggccctgcagggcctgcgggtggagtggaggggccgggacccccggggccctggccgggcccagaggtctgctggggccacagctgctgatggcccctgtgccctgcgggagctgtctgtggacctgcgggcagagaggtctgtgctgatccctgagacctaccaggccaacaactgccagggcgtgtgtggctggccccagagcgacaggaaccccaggtatggcaaccacgtggtgctgctgctgaagatgcaggtgcggggggccgccctggcccggcccccctgctgcgtgcccacagcctatgctgggaagctgctgatcagcctgtctgaggagcgcatcagcgcccaccacgtgcccaacatggtggccacagaatgtggctgcaggtag

SEQ ID NO: 149939 - DNA, 600 bp, Artificial Sequence
  Description of Artificial Sequence: Synthetic coding sequence
atgggagaggccagccccccagccccagcccggcggcacctgctggtgctgctgctgctgctgagcaccctggtgatccccagcgctgctgcccccatccatgatgctgatgcccaggagagcagcctgggcctgaccggcctgcagagcctgctgcagggcttcagccgcctcttcctgaagggcaacctgctgcggggcatcgacagcctcttcagcgcccccatggacttccggggcctgcccggcaactaccacaaggaggagaaccaggagcaccagctgggcaacaacaccctgagcagccacctgcagattgacaaggtgcccaggatggaggagaaggaggccctggtgcccatccagaaggccacagacagcttccacacagagctgcacccccgggtggccttctggatcatcaagctgccccggcggcgcagccaccaggatgccctggagggcggccactggctgtctgagaagaggcaccggctgcaggccatcagagatggcctgaggaagggcacccacaaggatgtgctggaggagggcacagagagcagcagccacagccggctgagccccaggaagacctag

SEQ ID NO: 149940 - DNA, 1896 bp, Artificial Sequence
  Description of Artificial Sequence: Synthetic coding sequence
atggccctgaggaaggagctgctgaagagcatctggtacgccttcaccgccctggatgtggagaagagcggcaaggtgtccaagagccagctgaaggtgctgagccacaacctgtacacagtgctgcacatcccccatgaccctgtggccctggaggagcacttcagagatgatgatgatggccctgtgagcagccagggctacatgccctacctgaacaagtacatcctggacaaggtggaggagggcgcctttgtgaaggagcactttgatgagctgtgctggaccctgacagccaagaagaactacagagctgacagcaatggaaacagcatgctgagcaaccaggatgccttccggctgtggtgcctcttcaacttcctgtctgaggacaagtaccccctcatcatggtgcctgatgaggtggagtacctgctgaagaaggtgctgagctccatgagcctggaggtgtccctgggggagctggaggagctgctggcccaggaggcccaggtggcccagaccaccggcggcctgtctgtgtggcagttcctggagctgttcaacagcggccgctgcctgcggggcgtgggccgggacaccctgtccatggccatccacgaggtgtaccaggagctgatccaggatgtgctgaagcagggctacctgtggaagaggggccacctgcggaggaactgggccgagcgctggttccagctgcagcccagctgcctgtgctacttcggcagcgaggagtgcaaggagaagaggggcatcatccccctggatgcccactgctgcgtggaggtgctgcctgacagagatggcaagcgctgcatgttctgtgtgaagacagccaacagaacctatgagatgtctgccagtgacacccggcagaggcaggagtggacagctgccatccagatggccatccggctgcaggccgagggcaagaccagcctgcacaaggacctgaagcagaagagaagagagcagcgggagcagcgggagaggagaagagctgccaaggaggaggagctgctgcggctgcagcagctgcaggaggagaaggagaggaagctgcaggagctggagctgctgcaggaggcccagaggcaggccgagcggctgctgcaggaggaggaggagaggagaagaagccagcaccgggagctgcagcaggccctggagggccagctgcgggaggccgagcaggcccgggcctccatgcaggccgagatggagctgaaggaggaggaggccgcccggcagaggcagaggatcaaggagctggaggagatgcagcagaggctgcaggaggccctgcagctggaggtgaaggccaggagagatgaggagagcgtgagaattgcccagacccggctgctggaggaggaggaggagaagctgaagcagctgatgcagctgaaggaggagcaggagcgctacatcgagcgggcccagcaggagaaggaggagctgcagcaggagatggcccagcagagccgcagcctgcagcaggcccagcagcagctggaggaggtgcggcagaaccggcagagagcagatgaagatgtggaggccgcccagaggaagctgcggcaggccagcaccaacgtgaagcactggaatgtgcagatgaaccggctgatgcaccccatcgagcccggggacaagaggcctgtgaccagcagcagcttcagcggcttccagccccccctgctggcccaccgggacagcagcctgaagaggctgacccgctggggcagccagggcaacagaacacccagccccaacagcaatgagcagcagaagagcctgaatggaggagatgaggccccagccccagccagcaccccccaggaggacaagctggaccctgcccctgagaactag

SEQ ID NO: 149941 - DNA, 555 bp, Artificial Sequence
  Description of Artificial Sequence: Synthetic coding sequence
atggccctgaggaaggagctgctgaagagcatctggtacgccttcaccgccctggatgtggagaagagcggcaaggtgtccaagagccagctgaaggtgctgagccacaacctgtacacagtgctgcacatcccccatgaccctgtggccctggaggagcacttcagagatgatgatgatggccctgtgagcagccagggctacatgccctacctgaacaagtacatcctggacaaggatgccttccggctgtggtgcctcttcaacttcctgtctgaggacaagtaccccctcatcatggtgcctgatgaggtggagtacctgctgaagaaggtgctgagctccatgagcctggaggtgtccctgggggagctggaggagctgctggcccaggaggcccaggtggcccagaccactggaggcctgtctgtgtggcagttcctggagctgttcaacagcggccgctgcctgcggggcgtgggccgggacaccctgtccatggccatccacgaggtgtaccaggagctgatccaggatgtgctgaagcagggctag

SEQ ID NO: 149942 - DNA, 393 bp, Artificial Sequence
  Description of Artificial Sequence: Synthetic coding sequence
tgaagagatgatgatgatggccctgtgagcagccagggctacatgccctacctgaacaagtacatcctggacaaggatgccttccggctgtggtgcctcttcaacttcctgtctgaggacaagtaccccctcatcatggtgcctgatgaggtggagtacctgctgaagaaggtgctgagctccatgagcctggaggtgtccctgggggagctggaggagctgctggcccaggaggcccaggtggcccagaccactggaggcctgtctgtgtggcagttcctggagctgttcaacagcggccgctgcctgcggggcgtgggccgggacaccctgtccatggccatccacgaggtgtaccaggagctgatccaggatgtgctgaagcagggctag

SEQ ID NO: 149943 - DNA, 1131 bp, Artificial Sequence
  Description of Artificial Sequence: Synthetic coding sequence
atgatctgcccccccaggcctcccaaggtgctgggcctgcaggtgctgcctgacagagatggcaagcgctgcatgttctgtgtgaagacagccaacagaacctatgagatgtctgccagtgacacccggcagaggcaggagtggacagctgccatccagatggccatccggctgcaggccgagggcaagaccagcctgcacaaggacctgaagcagaagaggcgggagcagcgggagcagcgggagcggcggcgggccgccaaggaggaggagctgctgcggctgcagcagctgcaggaggagaaggagaggaagctgcaggagctggagctgctgcaggaggcccagaggcaggccgagcggctgctgcaggaggaggaggagcggcggcgcagccagcaccgggagctgcagcaggccctggagggccagctgcgggaggccgagcaggcccgggcctccatgcaggccgagatggagctgaaggaggaggaggccgcccggcagaggcagaggatcaaggagctggaggagatgcagcagaggctgcaggaggccctgcagctggaggtgaaggccaggagagatgaggagagcgtgcgcatcgcccagacccggctgctggaggaggaggaggagaagctgaagcagctgatgcagctgaaggaggagcaggagcgctacatcgagcgggcccagcaggagaaggaggagctgcagcaggagatggcccagcagagccgcagcctgcagcaggcccagcagcagctggaggaggtgcggcagaaccggcagagagcagatgaagatgtggaggccgcccagaggaagctgcggcaggccagcaccaacgtgaagcactggaatgtgcagatgaaccggctgatgcaccccatcgagcccggggacaagaggcctgtgaccagcagcagcttcagcggcttccagccccccctgctggcccaccgggacagcagcctgaagaggctgacccgctggggcagccagggcaacagaacacccagccccaacagcaatgagcagcagaagagcctgaatggaggagatgaggccccagccccagccagcaccccccaggaggacaagctggaccctgccccagaaaattag

SEQ ID NO: 149944 - DNA, 708 bp, Artificial Sequence
  Description of Artificial Sequence: Synthetic coding sequence
atgacccaggtgacagagaagagcacagagcaccctgagaagaccaccagcaccacagagaagaccaccaggaccccagagaagcccaccctgtacagcgagaagaccatctgcaccaagggcaagaacacccctgtgcctgagaagcccacagagaacctgggcaacaccaccctgaccacagagaccatcaaggcccctgtgaagagcacagagaaccctgagaagacagctgctgtgaccaagaccatcaagcccagcgtgaaggtgactggagacaagagcctgaccaccaccagcagccacctgaacaagacagaggtgacccaccaggtgcccaccggcagcttcaccctcatcaccagcaggaccaagctgagcagcatcaccagcgaggccactggaaatgaaagccacccctacctgaacaaggatggcagccagaagggcatccatgctggccagatgggagaaaatgacagcttccctgcctgggccatcgtgattgtggtgctggtggccgtcatcctgctgctggtgttcctgggcctcatcttcctggtgtcctacatgatgaggaccaggaggaccctgacccagaacacccagtacaatgatgctgaagatgaaggaggccccaacagctaccctgtgtacctgatggagcagcagaacctgggcatgggccagatccccagccccaggtag

SEQ ID NO: 149945 - DNA, 1524 bp, Artificial Sequence
  Description of Artificial Sequence: Synthetic coding sequence
cccctggccaatgagaagaccaccctgagccctgctgagcccacagaaaatggagagaggacccccttcaccaatgagaagaccacccccagcagcgctgagcccacagagcacggggagaggacccccctggccaatgagatcaccacccccagcagagctgagcccacagaacatggagagagaattgccaatgagaaggccacccccagccctgccaagcccacagagcacggggagaccaccgtgaatgaagacaccacccccagcagcgctgagcccacagaaaatggagagaggacccccctggccaatgaaaacaccaccaccagccccacagagagcacagagcacggggagaggacagccaatgagaagaccacccccagccctgctgagcccacagaacatggagagaggaccccatctgccaatgagaagaccatccccagccctgccaagcccacagagcacgaggagatgacccccagcgccaatgaaaacaccacccccagccctgtgaagcccacagaacatggagagaagaccaccctggccaatgagaagatcaccctgagccctgagggccccacagagcacggggccaagaccaccagcgccaatgagaagatcacccccagcctggccaagcccacagaacatggagagaggaccaccagccccaatgacaagatcaccagcagcgctgctgagagcacagagcaccgggaccgggccaccagcgccaacgtcatcaccccagccccagctgagcccatcaagcacgccaagaggaccaccctggcccacgagaagatgacccaggtgacagagaagagcacagagcaccctgagaagaccaccagcaccacagagaagaccaccaggaccccagagaagcccaccctgtacagcgagaagaccatctgcaccaagggcaagaacacccctgtgcctgagaagcccacagagaacctgggcaacaccaccctgaccacagagaccatcaaggcccctgtgaagagcacagagaaccctgagaagacagctgctgtgaccaagaccatcaagcccagcgtgaaggtgactggagacaagagcctgaccaccaccagcagccacctgaacaagacagaggtgacccaccaggtgcccaccggcagcttcaccctcatcaccagcaggaccaagctgagcagcatcaccagcgaggccactggaaatgaaagccacccctacctgaacaaggatggcagccagaagggcatccatgctggccagatgggagaaaatgacagcttccctgcctgggccatcgtgattgtggtgctggtggccgtcatcctgctgctggtgttcctgggcctcatcttcctggtgtcctacatgatgaggaccaggaggaccctgacccagaacacccagtacaatgatgctgaagatgaaggaggccccaacagctaccctgtgtacctgatggagcagcagaacctgggcatgggccagatccccagccccaggtag

SEQ ID NO: 149946 - DNA, 1524 bp, Artificial Sequence
  Description of Artificial Sequence: Synthetic coding sequence
cccctggccaatgagaagaccaccctgagccctgctgagcccacagaaaatggagagaggacccccttcaccaatgagaagaccacccccagcagcgctgagcccacagagcacggggagaggacccccctggccaatgagatcaccacccccagcagagctgagcccacagaacatggagagagaattgccaatgagaaggccacccccagccctgccaagcccacagagcacggggagaccaccgtgaatgaagacaccacccccagcagcgctgagcccacagaaaatggagagaggacccccctggccaatgaaaacaccaccaccagccccacagagagcacagagcacggggagaggacagccaatgagaagaccacccccagccctgctgagcccacagaacatggagagaggaccccatctgccaatgagaagaccatccccagccctgccaagcccacagagcacgaggagatgacccccagcgccaatgaaaacaccacccccagccctgtgaagcccacagaacatggagagaagaccaccctggccaatgagaagatcaccctgagccctgagggccccacagagcacggggccaagaccaccagcgccaatgagaagatcacccccagcctggccaagcccacagaacatggagagaggaccaccagccccaatgacaagatcaccagcagcgctgctgagagcacagagcaccgggaccgggccaccagcgccaacgtcatcaccccagccccagctgagcccatcaagcacgccaagaggaccaccctggcccacgagaagatgacccaggtgacagagaagagcacagagcaccctgagaagaccaccagcaccacagagaagaccaccaggaccccagagaagcccaccctgtacagcgagaagaccatctgcaccaagggcaagaacacccctgtgcctgagaagcccacagagaacctgggcaacaccaccctgaccacagagaccatcaaggcccctgtgaagagcacagagaaccctgagaagacagctgctgtgaccaagaccatcaagcccagcgtgaaggtgactggagacaagagcctgaccaccaccagcagccacctgaacaagacagaggtgacccaccaggtgcccaccggcagcttcaccctcatcaccagcaggaccaagctgagcagcatcaccagcgaggccaccggcaacaagagccacccctacctgaacaaggatggcagccagaagggcatccatgctggccagatgggagaaaatgacagcttccctgcctgggccatcgtgattgtggtgctggtggccgtcatcctgctgctggtgttcctgggcctcatcttcctggtgtcctacatgatgaggaccaggaggaccctgacccagaacacccagtacaatgatgctgaagatgaaggaggccccaacagctaccctgtgtacctgatggagcagcagaacctgggcatgggccagatccccagccccaggtag

SEQ ID NO: 149947 - DNA, 1524 bp, Artificial Sequence; identical to SEQ ID NO: 149945
  Description of Artificial Sequence: Synthetic coding sequence

SEQ ID NO: 149948 - DNA, 1554 bp, Artificial Sequence
  Description of Artificial Sequence: Synthetic coding sequence
atggcccagcctgtgcacagcctgtgcagcgccttcggcctgcagtgctgcctgctcttcctgctggcctcctggggcgctggggccaccaccttccaggagtaccagaagacaggagagctgagcaccagtgaccacatcttccccctgaccccaggcctggtgtacagcatcccctttgaccacatcgtgctgcacagcggccagaggcctcctgagctgcccaagagcacagagatccacgagcagaagaggcactgcaacaccaccaggcacagcaagcccacagacaagcccaccggcaacagcaagaccatcgaccacaagagcagcacagacaaccacgaggccccacccaccagcgaggagaacagcagcaaccagggcaaggaccccatgatccggaaccagaggtctgtggaccctgctgacagcaccaccacccacaaggagagcgctgggaagaagcacatcaccccagcccccaagagcaagatcaactgcaggaagagcaccaccgggaagagcacagtgaccaggaagagtgacaagacaggccggcccctggagaagtccatgagcaccctggacaagaccagcaccagcagccacaagaccaccaccagcttccacaacagcggcaacagccagaccaagcagaagagcaccagcttccctgagaagatcacagctgccagcaagaccacctacaagaccaccggcaccccagaggagagcgagaagacagaggacagcaggaccaccgtggccagtgacaagctgctgaccaagaccaccaagaacatccaggagaccatcagcgccaatgagctgacccagagcctggccgagcccacagagcacggcggccgcacagccaatgaaaacaacacccccagccctgctgagcccacagagaaccgggagaggacagccaatgaaaacaagaagaccatctgcaccaagggcaagaacacccctgtgcctgagaagcccacagagaacctgggcaacaccaccctgaccacagagaccatcaaggcccctgtgaagagcacagagaaccctgagaagacagctgctgtgaccaagaccatcaagcccagcgtgaaggtgactggagacaagagcctgaccaccaccagcagccacctgaacaagacagaggtgacccaccaggtgcccaccggcagcttcaccctcatcaccagcaggaccaagctgagcagcatcaccagcgaggccactggaaatgaaagccacccctacctgaacaaggatggcagccagaagggcatccatgctggccagatgggagaaaatgacagcttccctgcctgggccatcgtgattgtggtgctggtggccgtcatcctgctgctggtgttcctgggcctcatcttcctggtgtcctacatgatgaggaccaggaggaccctgacccagaacacccagtacaatgatgctgaagatgaaggaggccccaacagctaccctgtgtacctgatggagcagcagaacctgggcatgggccagatccccagccccaggtag

SEQ ID NO: 149949 - DNA, 1554 bp, Artificial Sequence; identical to SEQ ID NO: 149948
  Description of Artificial Sequence: Synthetic coding sequence

SEQ ID NO: 149950 - DNA, 1554 bp, Artificial Sequence; identical to SEQ ID NO: 149948
  Description of Artificial Sequence: Synthetic coding sequence

SEQ ID NO: 149951 - DNA, 4182 bp, Artificial Sequence
  Description of Artificial Sequence: Synthetic coding sequence
atggcccagcctgtgcacagcctgtgcagcgccttcggcctgcagtgctgcctgctcttcctgctggcctcctggggcgctggggccaccaccttccaggagtaccagaagacaggagagctgagcaccagtgaccacatcttccccctgaccccaggcctggtgtacagcatcccctttgaccacatcgtgctgcacagcggccagaggcctcctgagctgcccaagagcacagagatccacgagcagaagaggcactgcaacaccaccaggcacagcaagcccacagacaagcccaccggcaacagcaagaccatcgaccacaagagcagcacagacaaccacgaggccccacccaccagcgaggagaacagcagcaaccagggcaaggaccccatgatccggaaccagaggtctgtggaccctgctgacagcaccaccacccacaaggagagcgctgggaagaagcacatcaccccagcccccaagagcaagatcaactgcaggaagagcaccaccgggaagagcacagtgaccaggaagagtgacaagacaggccggcccctggagaagtccatgagcaccctggacaagaccagcaccagcagccacaagaccaccaccagcttccacaacagcggcaacagccagaccaagcagaagagcaccagcttccctgagaagatcacagctgccagcaagaccacctacaagaccaccggcaccccagaggagagcgagaagacagaggacagcaggaccaccgtggccagtgacaagctgctgaccaagaccaccaagaacatccaggagaccatcagcgccaatgagctgacccagagcctggccgagcccacagagcacggcggccgcacagccaatgaaaacaacacccccagccctgctgagcccacagagaaccgggagaggacagccaatgaaaacaccaccctgagccctgctgagcccacagaaaatcgggagaggacagccaatgaaaatacagcccccttccctgctggccccacagagaaccgggagatgacagccaatgaaaacaccaccctcttccctgctgagcccacagagcacggggagaggacagccaatgaaaacaccacccccagccctgctgagcccacagaacatggagagaggacagccaatgaaaacaccacccccagccctgctgagcccacagagcacggggagaggaccccatttgccaatgacaagaccaccagcagcagcgctgagagcacagaacatggagagaggacccccctggccaatgaaaacaccacccccagccctgctgagcccacagaaaatcgggagaggacagccaatgaaaacaccacccccagccctgctggccccacagagaaccgggagaccacagccaatgagaagaccaccctgagccctgtggagcccacagaaaatcgggagaccacagccaatgagaagaccacccccagccctgctgagcccacagaaaatggccagaggaccccatttgccaatgagaagaccaccagcagcagcgctgagcccacagagcacggggagaggacccccctggccaatgaaaacaccacccccagccctgctgagcccacagagaaccgggagaggacagccaatgagaagaccacccccagccctgctgagcccacagaaaatggagacaggacccccctggccaatgagaagaccacccccagcctggccgagcccacagaaaatggccagaggaccccatttgccaatgagaagaccaccagcagcagcgctgagcccacagagcacgaggagaggacccccctggccaatgaaaacaccacccccagccctgctgagcccacagagaaccgggagaggacagccaatgaaaacaccacccccagccctgctggccccacagaaaatcgggagatgacagccaatgagaagaccaccctcttccctgctgagcccacagagaaccgggagaggacagccaatgagaagaccaccagcagccctgctgagcccacagaaaatggccagaggaccccatttgccaatgagaagaccaccagcagcagcgctgagcccacagaacatggagagaggacccccctggccaatgaaaacaccaccctgagccctgctgagcccacagaaaatcgggagaggacagccaatgagaagaccacccccttccctgctgagcccacagagaaccgggagaggacagccaatgaaaacaccacccccagccctgcccagcccacagaaaatggagacaggacccccctggccaatgagaagaccacccccagcctggccgagcccacagaaaatggcaagaggaccccatttgccaatgagaagaccaccagcagcagcgctgagcccacagagcacgccgagaggacccccctggccaatgaaaacaccaccagcagccctgctgagcccacagagaaccgggagaggacagccaatgagaagaccacccagtttcctgctgagcccacagaaaatcgggagagcacagccaatgagaagaccacccccttccctgctgagcccacagagaaccgggagtggacagccaatgaaaacaccaccctgagccctgctgagcccacagagcacgaggagatgacccccctggccaatgagaagaccaccctgagccctgctgagcccacagaaaatggagagaggacccccttcaccaatgagaagaccacccccagcagcgctgagcccacagagcacggggagaggacccccctggccaatgagatcaccacccccagcagagctgagcccacagaacatggagagagaattgccaatgagaaggccacccccagccctgccaagcccacagagcacggggagaccaccgtgaatgaagacaccacccccagcagcgctgagcccacagaaaatggagagaggacccccctggccaatgaaaacaccaccaccagccccacagagagcacagagcacggggagaggacagccaatgagaagaccacccccagccctgctgagcccacagaacatggagagaggaccccatctgccaatgagaagaccatccccagccctgccaagcccacagagcacgaggagatgacccccagcgccaatgaaaacaccacccccagccctgtgaagcccacagaacatggagagaagaccaccctggccaatgagaagatcaccctgagccctgagggccccacagagcacggggccaagaccaccagcgccaatgagaagatcacccccagcctggccaagcccacagaacatggagagaggaccaccagccccaatgacaagatcaccagcagcgctgctgagagcacagagcaccgggaccgggccaccagcgccaacgtcatcaccccagccccagctgagcccatcaagcacgccaagaggaccaccctggcccacgagaagatgacccaggtgacagagaagagcacagagcaccctgagaagaccaccagcaccacagagaagaccaccaggaccccagagaagcccaccctgtacagcgagaagaccatctgcaccaagggcaagaacacccctgtgcctgagaagcccacagagaacctgggcaacaccaccctgaccacagagaccatcaaggcccctgtgaagagcacagagaaccctgagaagacagctgctgtgaccaagaccatcaagcccagcgtgaaggtgactggagacaagagcctgaccaccaccagcagccacctgaacaagacagaggtgacccaccaggtgcccaccggcagcttcaccctcatcaccagcaggaccaagctgagcagcatcaccagcgaggccactggaaatgaaagccacccctacctgaacaaggatggcagccagaagggcatccatgctggccagatgggagaaaatgacagcttccctgcctgggccatcgtgattgtggtgctggtggccgtcatcctgctgctggtgttcctgggcctcatcttcctggtgtcctacatgatgaggaccaggaggaccctgacccagaacacccagtacaatgatgctgaagatgaaggaggccccaacagctaccctgtgtacctgatggagcagcagaacctgggcatgggccagatccccagccccaggtag

SEQ ID NO: 149952 - DNA, 2670 bp, Artificial Sequence
  Description of Artificial Sequence: Synthetic coding sequence
atggcccagcctgtgcacagcctgtgcagcgccttcggcctgcagtgctgcctgctcttcctgctggcctcctggggcgctggggccaccaccttccaggagtaccagaagacaggagagctgagcaccagtgaccacatcttccccctgaccccaggcctggtgtacagcatcccctttgaccacatcgtgctgcacagcggccagaggcctcctgagctgcccaagagcacagagatccacgagcagaagaggcactgcaacaccaccaggcacagcaagcccacagacaagcccaccggcaacagcaagaccatcgaccacaagagcagcacagacaaccacgaggccccacccaccagcgaggagaacagcagcaaccagggcaaggaccccatgatccggaaccagaggtctgtggaccctgctgacagcaccaccacccacaaggagagcgctgggaagaagcacatcaccccagcccccaagagcaagatcaactgcaggaagagcaccaccgggaagagcacagtgaccaggaagagtgacaagacaggccggcccctggagaagtccatgagcaccctggacaagaccagcaccagcagccacaagaccaccaccagcttccacaacagcggcaacagccagaccaagcagaagagcaccagcttccctgagaagatcacagctgccagcaagaccacctacaagaccaccggcaccccagaggagagcgagaagacagaggacagcaggaccaccgtggccagtgacaagctgctgaccaagaccaccaagaacatccaggagaccatcagcgccaatgagctgacccagagcctggccgagcccacagagcacggcggccgcacagccaatgaaaacaacacccccagccctgctgagcccacagagaaccgggagaggacagccaatgaaaacaccaccctgagccctgctgagcccacagaaaatcgggagaggacagccaatgaaaatacagcccccttccctgctggccccacagagaaccgggagatgacagccaatgaaaacaccaccctcttccctgctgagcccacagagcacggggagaggacagccaatgaaaacaccacccccagccctgctgagcccacagaacatggagagaggacagccaatgaaaacaccacccccagccctgctgagcccacagagcacggggagaggaccccatttgccaatgacaagaccaccagcagcagcgctgagagcacagaacatggagagaggacccccctggccaatgaaaacaccacccccagccctgctgagcccacagaaaatcgggagaggacagccaatgaaaacaccacccccagccctgctggccccacagagaaccgggagaccacagccaatgagaagaccaccctgagccctgtggagcccacagaaaatcgggagaccacagccaatgagaagaccacccccagccctgctgagcccacagaaaatggccagaggaccccatttgccaatgagaagaccaccagcagcagcgctgagcccacagagcacggggagaggacccccctggccaatgaaaacaccacccccagccctgctgagcccacagagaaccgggagaggacagccaatgagaagaccacccccagccctgctgagcccacagaaaatggagacaggacccccctggccaatgagaagaccacccccagcctggccgagcccacagaaaatggccagaggaccccatttgccaatgagaagaccaccagcagcagcgctgagcccacagagcacgaggagaggacccccctggccaatgaaaacaccacccccagccctgctgagcccacagagaaccgggagaggacagccaatgaaaacaccacccccagccctgctggccccacagaaaatcgggagatgacagccaatgagaagaccaccctcttccctgctgagcccacagagaaccgggagaggacagccaatgagaagaccaccagcagccctgctgagcccacagaaaatggccagaggaccccatttgccaatgagaagaccaccagcagcagcgctgagcccacagaacatggagagaggacccccctggccaatgaaaacaccaccctgagccctgctggccccacagaaaatcgggagaggacagccaatgagaagaccacccccttccctgctgagcccacagagaaccgggagaggacagccaatgaaaacaccacccccagccctgcccagcccacagaaaatggagacaggacccccctggccaatgagaagaccacccccagcctggccgagcccacagaaaatggcaagaggaccccatttgccaatgagaagaccaccagcagcagcgctgagcccacagagcacgccgagaggacccccctggccaatgaaaacaccaccagcagccctgctgagcccacagagaaccgggagaggacagccaatgagaagaccacccagtttcctgctgagcccacagaaaatcgggagagcacagccaatgagaagaccacccccttccctgctgagcccacagagaaccgggagtggacagccaatgaaaacaccaccctgagccctgctgagcccacagagcacgaggagatgacccccctggcctag

SEQ ID NO: 149953 - DNA, 1653 bp, Artificial Sequence
  Description of Artificial Sequence: Synthetic coding sequence
atggtgcccaaggctgacagcggggccttcctgctgctcttcctgctggtgctgactgtgacagagcccctgcggcctgagctgcgctgcaaccctggccagtttgcctgccgcagcggcaccatccagtgcatccccctgccctggcagtgtgatggctgggccacctgtgaagatgaaagtgatgaggccaactgcccagaggtgactggagaggtgcggccccaccacggcaaggaggccgtggacccccggcagggccgggcccggggcggggaccccagccacttccacgctgtgaatgtggcccagcctgtgcgcttcagcagcttcctgggcaagtgccccaccggctggcaccactatgagggcacagccagctgctacagagtgtacctgagcggggagaactactgggatgctgcccagacctgccagaggctgaatggcagcctggccaccttcagcacagaccaggagctgcgctttgtgctggcccaggagtgggaccagcctgagaggagctttggctggaaggaccagaggaagctgtgggtgggctaccagtatgtgatcactggaagaaacagaagcctggagggccgctgggaggtggccttcaagggcagcagcgaggtgttcctgcccccagaccccatctttgccagcgccatgtctgaaaatgacaacgtgttctgtgcccagctgcagtgcttccacttccccaccctgcggcaccacgacctgcacagctggcacgccgagagctgctatgagaagagcagcttcctgtgcaagaggagccagacctgtgtggacatcaaggacaacgtggtggatgagggcttctacttcacccccaagggagatgacccctgcctgagctgcacctgccacggcggggagcctgagatgtgtgtggccgccctgtgtgagcggccccagggctgccagcagtacaggaaggaccccaaggagtgctgcaagttcatgtgcctggaccctgatggcaacagcctgtttgacagcatggccagcggcatgaggctggtggtgtcctgcatcagcagcttcctgatcctgagcctgctgctcttcatggtgcaccggctgcggcagaggagaagagaaagaattgagagcctgattggagccaacctgcaccacttcaacctgggccgccgcatccctggctttgattatggcccagatggcttcggcaccggcctgacccccctgcacctgagtgatgatggagagggcggcaccttccacttccatgaccccccaccaccctacacagcctacaagtacccagacatcggccagccagatgatcctcctccaccctatgaggccagcatccacccagattctgtgttctatgaccctgcagatgatgatgcctttgagcctgtggaggtgtccctgcctgcccctggagatggcggcagcgagggcgccctgctgcggcggctggagcagcccctgcccacagctggggccagcctggccgacctggaggacagcgctgacagcagcagcgccctgctggtgcccccagaccctgcccagagcggcagcaccccagctgctgaggccctgcccggcggcggccgccacagccgcagcagcctgaacacagtggtgtag

SEQ ID NO: 149954 - DNA, 984 bp, Artificial Sequence
  Description of Artificial Sequence: Synthetic coding sequence
atggtgcccaaggctgacagcggggccttcctgctgctcttcctgctggtgctgactgtgacagagcccctgcggcctgagctgcgctgcaaccctggccagtttgcctgccgcagcggcaccatccagtgcatccccctgccctggcagtgtgatggctgggccacctgtgaagatgaaagtgatgaggccaactgcccagaggtgactggagaggtgcggccccaccacggcaaggaggccgtggacccccggcagggccgggcccggggcggggaccccagccacttccacgctgtgaatgtggcccagcctgtgcgcttcagcagcttcctgggcaagtgccccaccggctggcaccactatgagggcacagccagctgctacagagtgtacctgagcggggagaactactgggatgctgcccagacctgccagaggctgaatggcagcctggccaccttcagcacagaccaggagctgcgctttgtgctggcccaggagtgggaccagcctgagaggagctttggctggaaggaccagaggaagctgtgggtgggctaccagtatgtgatcactggaagaaacagaagcctggagggccgctgggaggtggccttcaagggcagcagcgaggtgttcctgcccccagaccccatctttgccagcgccatgtctgaaaatgacaacgtgttctgtgcccagctgcagtgcttccacttccccaccctgcggcaccacgacctgcacagctggcacgccgagagctgctatgagaagagcagcttcctgtgcaagaggagccagacctgtgtggacatcaaggacaacgtggtggatgagggcttctacttcacccccaagggagatgacccctgcctgagctgcacctgccacggcggggagcctgagatgtgtgtggccgccctgtgtgagcggccccagggctgcagccccctgagctgcacagcccgggccacctag

SEQ ID NO: 149955 - DNA, 1530 bp, Artificial Sequence
  Description of Artificial Sequence: Synthetic coding sequence
atggtgcccaaggctgacagcggggccttcctgctgctcttcctgctggtgctgactgtgacagagcccctgcggcctgaggtgactggagaggtgcggccccaccacggcaaggaggccgtggacccccggcagggccgggcccggggcggggaccccagccacttccacgctgtgaatgtggcccagcctgtgcgcttcagcagcttcctgggcaaatgtcccaccggctggcaccactatgagggcacagccagctgctacagagtgtacctgtctggagagaactactgggatgctgcccagacctgccagaggctgaatggcagcctggccaccttcagcacagaccaggagctgcgctttgtgctggcccaggagtgggaccagcctgagaggagctttggctggaaggaccagaggaagctgtgggtgggctaccagtatgtgatcaccggcaggaacagaagcctggagggccgctgggaggtggccttcaagggcagcagcgaggtgttcctgcccccagaccccatctttgccagcgccatgtctgaaaatgacaacgtgttctgtgcccagctgcagtgcttccacttccccaccctgcggcaccacgacctgcacagctggcatgctgagagctgctatgagaagagcagcttcctgtgcaagaggagccagacctgtgtggacatcaaggacaacgtggtggatgagggcttctacttcacccccaagggagatgacccctgcctgagctgcacctgccacggcggggagcctgagatgtgtgtggccgccctgtgtgagcggccccagggctgccagcagtacaggaaggaccccaaggagtgctgcaagttcatgtgcctggaccctgatggcaacagcctgtttgacagcatggccagcggcatgaggctggtggtgtcctgcatcagcagcttcctgatcctgagcctgctgctcttcatggtgcaccggctgcggcagaggcggcgggagcgcatcgagagcctcatcggggccaacctgcaccacttcaacctgggccgccgcatccctggctttgattatggcccagatggctttggaacaggcctgacccccctgcacctgagtgatgatggagagggcggcaccttccacttccatgaccccccaccaccctacacagcctacaagtacccagacatcggccagccagatgaccccccaccaccctatgaggccagcatccacccagacagcgtcttctatgaccctgcagatgatgatgcctttgagcctgtggaggtgtccctgcctgcccctggagatggcggcagcgagggcgccctgctgcggcggctggagcagcccctgcccacagctggggccagcctggccgacctggaggacagcgctgacagcagcagcgccctgctggtgcccccagaccctgcccagagcggcagcaccccagctgctgaggccctgcccggcggcggccgccacagccgcagcagcctgaacacagtggtgtag

SEQ ID NO: 149956 - DNA, 810 bp, Artificial Sequence
  Description of Artificial Sequence: Synthetic coding sequence
atggtgcccaaggctgacagcggggccttcctgctgctcttcctgctggtgctgactgtgacagagcccctgcggcctgagctgcgctgcaaccctggccagtttgcctgccgcagcggcaccatccagtgcatccccctgccctggcagtgtgatggctgggccacctgtgaagatgaaagtgatgaggccaactgcccagaggtgactggagaggtgcggccccaccacggcaaggaggccgtggacccccggcagggccgggcccggggcggggaccccagccacttccacgctgtgaatgtggcccagcctgtgcgcttcagcaggaaatgtcccaccggctggcaccactatgagggcacagccagctgctacagagtgtacctgtctggagagaactactgggatgctgcccagacctgccagaggctgaatggcagcctggccaccttcagcacagaccaggagctgcgctttgtgctggcccaggagtgggaccagcctgagaggagctttggctggaaggaccagaggaagctgtgggtgggctaccagtatgtgatcaccggcaggaacagaagcctggagggccgctgggaggtggccttcaaggactggggcgtgtctgacaccatggtgcaccggcggctgctgtgcccctgtgtgggcaccctgcacacccacctgaagctgggcgcccgcttcagaagagtgcctgtgcggctgggcggggccctgagcagaagaagcccccggcccaccccagcctgtgagccccggctgggcgccaagaccctgcaggtgtag

SEQ ID NO: 149957 - DNA, 663 bp, Artificial Sequence
  Description of Artificial Sequence: Synthetic coding sequence
atggagagatatgctggggccctggaggaggtggctgatggagcccggcagcaggagcggcactaccagctgctgagcgccctgcagagcctggtgaaggagctgcccagcagcttccagcagaggctgagctacaccaccctgagtgacctggccctggccctgctggatggcaccgtgtttgaaattgtgcagggcctgctggagatccagcacctgacagagaagagcctgtacaaccagaggctgcggctgcagaatgagcaccgggtgctgcggcaggccctgcggcagaagcaccaggaggcccagcaggcctgccggccccacaacctgcctgtgctgcaggccgcccagcagcgggagctggaggccgtggagcaccgcatccgggaggagcagagggccatggaccagaagatcgtgctggagctggacaggaaggtggccgaccagcagagcaccctggagaaggccggcgtggccggcttctacgtgaccaccaacccccaggagctgatgctgcagatgaacctgctggagctgatcaggaagctgcagcagaggggctgctgggccggcaaggccgccctgggcctgggcggcccctggcagctgcctgctgcccagtgtgaccagaagggcagccctgtgcccccatag

SEQ ID NO: 149958 - DNA, 663 bp, Artificial Sequence
  Description of Artificial Sequence: Synthetic coding sequence
atggagagatatgctgctgccctggaggaggtggctgatggagcccggcagcaggagcggcactaccagctgctgagcgccctgcagagcctggtgaaggagctgcccagcagcttccagcagaggctgagctacaccaccctgagtgacctggccctggccctgctggatggcaccgtgtttgaaattgtgcagggcctgctggagatccagcacctgacagagaagagcctgtacaaccagaggctgcggctgcagaatgagcaccgggtgctgcggcaggccctgcggcagaagcaccaggaggcccagcaggcctgccggccccacaacctgcctgtggtgcaggccgcccagcagcgggagctggaggccgtggagcaccgcatccgggaggagcagagggccatggaccagaagatcatcctggagctggacaggaaggtggccgaccagcagagcaccctggagaaggccggcgtggccggcttctacgtgaccaccaacccccaggagctgatgctgcagatgaacctgctggagctgatcaggaagctgcagcagaggggctgcagagctggaaatgctgccctgggcctgggcggcccctggcagagccctgctgcccagtgtgaccagaagggcagccctgtgcccccatag

SEQ ID NO: 149959 - DNA, 2322 bp, Artificial Sequence
  Description of Artificial Sequence: Synthetic coding sequence
atggagacagatgagagccccagccccctgccctgtggccctgctggggaggccgtgatggagagccgggcccggcccttccaggccctgccccgggagcagagccccccaccacccctgcagaccagcagcggggctgaggtgatggatgtgggcagcggaggagatggccagagcgagctgcctgctgaggaccccttcaacttctacggggccagcctgctgagcaagggcagcttcagcaagggccgcctgctgattgaccccaactgcagcggccacagccccaggacagcccggcatgccccagctgtgaggaagttctccccagacctgaagctgctgaaggatgtgaagatctctgtgtccttcacagagagctgccgcagcaaggacaggaaggtgctgtacaccggggctgagagagatgtgcgggcagaatgtggcctgctgctgagccctgtgtctggagatgtgcacgcctgcccctttggaggctctgtgggagatggagtgggcatcggcggggagagcgctgacaagaaggatgaagaaaatgagctggaccaggagaagagggtggagtatgctgtgctggatgagctggaggacttcacagacaacctggagctggatgaggagggcgctgggggcttcaccgccaaggccatcgtgcagagggacagagtggatgaggaggccctgaacttcccctatgaagatgactttgacaatgatgtggatgccctgctggaggagggcctgtgtgcccccaagaagagaagaacagaggagaagtatggaggagacagcgaccaccccagtgatggagagacctctgtgcagcccatgatgaccaagatcaagacagtgctgaagagccggggccggcccccaacagagcccctgcctgatggctggatcatgaccttccacaacagcggcgtgcctgtgtacctgcaccgggagagccgggtggtgacctggagccggccctacttcctgggcaccggcagcatcaggaagcatgacccccccctgagcagcatcccctgcctgcactacaagaagatgaaggacaatgaggagcgggagcagagcagtgacctgaccccatctggagatgtgtcccctgtgaagcccctgagccgctctgctgagctggagttccccctggatgagccagacagcatgggcgctgaccccggccccccagatgagaaggaccccctgggcgctgaggccgcccctggggccctgggccaggtgaaggccaaggtggaggtgtgcaaggatgagagcgtggacctggaggagttccgcagctacctggagaagagatttgattttgagcaggtgacagtgaagaagttccgcacctgggccgagcggcggcagttcaaccgggagatgaagaggaagcaggccgagagcgagcggcccatcctgcctgccaaccagaagctgatcaccctgtctgtgcaggatgcccccaccaagaaggagtttgtgatcaaccccaacgggaagtctgaggtgtgcatcctgcacgagtacatgcagagggtgctgaaggtgcggcctgtgtacaacttctttgaatgtgagaaccccagcgagccctttggagcctctgtgaccattgatggagtgacctacggcagcggcacagccagcagcaagaagctggccaagaacaaggccgcccgggccaccctggagatcctgatcccagactttgtgaagcagaccagcgaggagaagcccaaggacagcgaggagctggagtacttcaaccacatcagcattgaggacagccgggtgtatgagctgaccagcaaggccggcctgctgagcccctaccagatcctgcacgagtgcctgaagaggaaccacggcatgggagacaccagcatcaagtttgaggtggtgcctgggaagaaccagaagtcagaatatgtgatggcctgtgggaagcacacagtgcggggctggtgcaagaacaagagggtgggcaagcagctggccagccagaagatcctgcagctgctgcacccccacgtgaagaactggggcagcctgctgaggatgtatggccgggagagcagcaagatggtgaagcaggagaccagtgacaagagcgtcatcgagctgcagcagtatgccaagaagaacaagcccaacctgcacatcctgagcaagctgcaggaggagatgaagaggctggccgaggagcgggaggagaccaggaagaagcccaagatgagcatcgtggccagcgcccagcctggaggagagcccctgtgcaccgtggatgtgtag

SEQ ID NO: 149960 - DNA, 2223 bp, Artificial Sequence
  Description of Artificial Sequence: Synthetic coding sequence
atggagacagatgagagccccagccccctgccctgtggccctgctggggaggccgtgatggagagccgggcccggcccttccaggccctgccccgggagcagagccccccaccacccctgcagaccagcagcggggctgaggtgatggatgtgggcagcggaggagatggccagagcgagctgcctgctgaggaccccttcaacttctacggggccagcctgctgagcaagggcagcttcagcaagggccgcctgctgattgaccccaactgcagcggccacagccccaggacagcccggcatgccccagctgtgaggaagttctccccagacctgaagctgctgaaggatgtgaagatctctgtgtccttcacagagagctgccgcagcaaggacaggaaggtgctgtacaccggggctgagagagatgtgcgggcagaatgtggcctgctgctgagccctgtgtctggagatgtgcacgcctgcccctttggaggctctgtgggagatggagtgggcatcggcggggagagcgctgacaagaaggatgaagaaaatgagctggaccaggagaagagggtggagtatgctgtgctggatgagctggaggacttcacagacaacctggagctggatgaggagggcgctgggggcttcaccgccaaggccatcgtgcagagggacagagtggatgaggaggccctgaacttcccctatgaagatgactttgacaatgatgtggatgccctgctggaggagggcctgtgtgcccccaagaagagaagaacagaggagaagtatggaggagacagcgaccaccccagtgatggagagacctctgtgcagcccatgatgaccaagatcaagacagtgctgaagagccggggccggcccccaacagagcccctgcctgatggctggatcatgaccttccacaacagcggcgtgcctgtgtacctgcaccgggagagccgggtggtgacctggagccggccctacttcctgggcaccggcagcatcaggaagcatgacccccccctgagcagcatcccctgcctgcactacaagaagatgaaggacaatgaggagcgggagcagagcagtgacctgaccccatctggagatgtgtcccctgtgaagcccctgagccgctctgctgagctggagttccccctggatgagccagacagcatgggcgctgaccccggccccccagatgagaaggaccccctgggcgctgaggccgcccctggggccctgggccaggtgaaggccaaggtggaggtgtgcaaggatgagagcgtggacctggaggagttccgcagctacctggagaagagatttgattttgagcaggtgacagtgaagaagttccgcacctgggccgagcggcggcagttcaaccgggagatgaagaggaagcaggccgagagcgagcggcccatcctgcctgccaaccagaagctgatcaccctgtctgtgcaggatgcccccaccaagaaggagtttgtgatcaaccccaacgggaagtctgaggtgtgcatcctgcacgagtacatgcagagggtgctgaaggtgcggcctgtgtacaacttctttgaatgtgcccgggccaccctggagatcctgatcccagactttgtgaagcagaccagcgaggagaagcccaaggacagcgaggagctggagtacttcaaccacatcagcattgaggacagccgggtgtatgagctgaccagcaaggccggcctgctgagcccctaccagatcctgcatgaatgtctgaagagaaatcatggcatgggagacaccagcatcaagtttgaggtggtgcctgggaagaaccagaagtcagaatatgtgatggcctgtgggaagcacacagtgcggggctggtgcaagaacaagagggtgggcaagcagctggccagccagaagatcctgcagctgctgcacccccacgtgaagaactggggcagcctgctgaggatgtatggccgggagagcagcaagatggtgaagcaggagaccagtgacaagtctgtgattgagctgcagcagtatgccaagaagaacaagcccaacctgcacatcctgagcaagctgcaggaggagatgaagaggctggccgaggagcgggaggagaccaggaagaagcccaagatgagcatcgtggccagcgcccagcccggcggggagcccctgtgcaccgtggatgtgtag

SEQ ID NO: 149961 - DNA, 2223 bp, Artificial Sequence; identical to SEQ ID NO: 149960
  Description of Artificial Sequence: Synthetic coding sequence

SEQ ID NO: 149962 - DNA, 378 bp, Artificial Sequence
  Description of Artificial Sequence: Synthetic coding sequence
atggagacagatgagagccccagccccctgccctgtggccctgctggggaggccgtgatggagagccgggcccggcccttccaggccctgccccgggagcagagccccccaccacccctgcagaccagcagcggggctgaggtgatggatgtgggcagcggaggagatggccagagcgagctgcctgctgaggaccccttcaacttctacggggccagcctgctgagcaagggcagcttcagcaagggccgcctgctgattgaccccaactgcagcggccacagccccaggacagcccggcatgccccagctgtgaggaagttctccccagacctgaagctgctgaaggatgtgaagatctctgtgtccttcacctag

SEQ ID NO: 149963 - DNA, 564 bp, Artificial Sequence
  Description of Artificial Sequence: Synthetic coding sequence
atggtgggcagcctgaactgcatcgtggccgtgtcccagaacatgggcatcggcaagaatggagacctgccctggccacccctgagaaatgagttccgctacttccagaggatgaccaccaccagctctgtggagggcaagcagaacctggtgatcatgggcaagaagacctggttcagcatccctgagaagaaccggcccctgaagggccgcatcaacctggtgctgagccgggagctgaaggagcccccccagggcgcccacttcctgagccgcagcctggatgatgccctgaagctgacagagcagcctgagctggccaacaaggtggacatggtgtggatcgtgggcggcagctctgtgtacaaggaggccatgaaccaccctggccacctgaagctgtttgtgacccgcatcatgcaggactttgaaagtgacaccttcttccctgagattgacctggagaagtacaagctgctgcctgagtacccaggagtgctgagtgatgtgcaggaggagaagggcatcaagtacaagtttgaggtgtatgagaagaatgactag

SEQ ID NO: 149964 - DNA, 564 bp, Artificial Sequence; identical to SEQ ID NO: 149963
  Description of Artificial Sequence: Synthetic coding sequence

SEQ ID NO: 149965 - DNA, 963 bp, Artificial Sequence
  Description of Artificial Sequence: Synthetic coding sequence
atggctgctgtgaggatgctgcggacctggagcagaaatgctgggaagctgatctgtgtgcgctacttccagacctgtggaaatgtgcacgtgctgaagcccaactacgtgtgcttcttcggctaccccagcttcaagtacagccacccccaccacttcctgaagaccacagctgccctgcggggccaggtggtgcagttcaagctgagtgacatcggggagggcatccgggaggtgacagtgaaggagtggtacgtgaaggagggggacacagtgtcccagtttgacagcatctgtgaggtgcagagcgacaaggcctctgtgaccatcaccagccgctatgatggagtcatcaagaagctgtactacaacctggatgacatcgcctacgtgggcaagcccctggtggacatcgagacagaggccctgaaggacagcgaggaggatgtggtggagaccccagctgtgtcccatgatgagcacacccaccaggagatcaagggcaggaagaccctggccaccccagctgtgcggcggctggccatggagaacaacatcaagctgtctgaggtggtgggcagcggcaaggatggccgcatcctgaaggaggacatcctgaactacctggagaagcagacaggagccatcctgccccccagccccaaggtggagatcatgcctcctccacccaagcccaaggacatgacagtgcccatcctggtgtccaagccccctgtgttcaccgggaaggacaagacagagcccatcaagggcttccagaaggccatggtgaagaccatgtctgctgccctgaagatcccccacttcggctactgtgatgaaattgacctgacagagctggtgaagctgcgggaggagctgaagcccatcgcctttgcccggggcatcaagctgtccttcatgcccttcttcctgaagtactacttctcctggaagagctag

SEQ ID NO: 149966 - DNA, 1449 bp, Artificial Sequence
  Description of Artificial Sequence: Synthetic coding sequence
atggctgctgtgaggatgctgcggacctggagcagaaatgctgggaagctgatctgtgtgcgctacttccagacctgtggaaatgtgcacgtgctgaagcccaactacgtgtgcttcttcggctaccccagcttcaagtacagccacccccaccacttcctgaagaccacagctgccctgcggggccaggtggtgcagttcaagctgagtgacatcggggagggcatccgggaggtgacagtgaaggagtggtacgtgaaggagggggacacagtgtcccagtttgacagcatctgtgaggtgcagagcgacaaggcctctgtgaccatcaccagccgctatgatggagtcatcaagaagctgtactacaacctggatgacatcgcctacgtgggcaagcccctggtggacatcgagacagaggccctgaaggacagcgaggaggatgtggtggagaccccagctgtgtcccatgatgagcacacccaccaggagatcaagggcaggaagaccctggccaccccagctgtgcggcggctggccatggagaacaacatcaagctgtctgaggtggtgggcagcggcaaggatggccgcatcctgaaggaggacatcctgaactacctggagaagcagacaggagccatcctgccccccagccccaaggtggagatcatgcctcctccacccaagcccaaggacatgacagtgcccatcctggtgtccaagccccctgtgttcaccgggaaggacaagacagagcccatcaagggcttccagaaggccatggtgaagaccatgtctgctgccctgaagatcccccacttcggctactgtgatgaaattgacctgacagagctggtgaagctgcgggaggagctgaagcccatcgcctttgcccggggcatcaagctgtccttcatgcccttcttcctgaaggccgccagcctgggcctgctgcagttccccatcctgaatgcctctgtggatgagaactgccagaacatcacctacaaggccagccacaacatcggcatcgccatggacacagagcagggcctgattgtgcccaacgtgaagaatgtgcagatctgcagcatctttgacatcgccacagagctgaaccggctgcagaagctgggctctgtgtcccagctgagcaccacagacctgaccggcggcaccttcaccctgagcaacatcggcagcatcggcggcacctttgccaagcctgtgatcatgcctcctgaggtggccatcggggccctgggcagcatcaaggccatcccccgcttcaaccagaagggggaggtgtacaaggcccagatcatgaatgtgtcctggagcgctgaccaccgggtgattgatggagccaccatgagccgcttcagcaacctgtggaagagctacctggagaacccagccttcatgctgctggacctgaagtag

SEQ ID NO: 149967 - DNA, 906 bp, Artificial Sequence
  Description of Artificial Sequence: Synthetic coding sequence
atggagaacaacatcaagctgtctgaggtggtgggcagcggcaaggatggccgcatcctgaaggaggacatcctgaactacctggagaagcagacaggagccatcctgccccccagccccaaggtggagatcatgcctcctccacccaagcccaaggacatgacagtgcccatcctggtgtccaagccccctgtgttcaccgggaaggacaagacagagcccatcaagggcttccagaaggccatggtgaagaccatgtctgctgccctgaagatcccccacttcggctactgtgatgaaattgacctgacagagctggtgaagctgcgggaggagctgaagcccatcgcctttgcccggggcatcaagctgtccttcatgcccttcttcctgaaggccgccagcctgggcctgctgcagttccccatcctgaatgcctctgtggatgagaactgccagaacatcacctacaaggccagccacaacattggaattgccatggacacagagcagggcctcatcgtgcccaacgtgaagaatgtgcagatctgcagcatctttgatattgccacagagctgaaccggctgcagaagctgggctctgtgtcccagctgagcaccacagacctgactggaggcaccttcaccctgagcaacatcggcagcattggaggcacctttgccaagcctgtgatcatgcctcctgaggtggccatcggggccctgggcagcatcaaggccatcccccgcttcaaccagaagggggaggtgtacaaggcccagatcatgaatgtgtcctggagcgctgaccaccgggtgattgatggagccaccatgagccgcttcagcaacctgtggaagagctacctggagaacccagccttcatgctgctggacctgaagtag

SEQ ID NO: 149968 - DNA, 5286 bp, Artificial Sequence
  Description of Artificial Sequence: Synthetic coding sequence
atgcagttccagctgaccctcttcctgcacctgggctggctgagctacagcaaggcccaggatgactgcaacagaggagcctgccaccccaccaccggggacctgctggtgggcaggaacacccagctgatggccagcagcacctgtggcctgagccgggcccagaagtactgcatcctgagctacctggagggggagcagaagtgcttcatctgtgacagccgcttcccctatgacccctatgaccagcccaacagccacaccattgaaaatgtgattgtgtcctttgagccagaccgggagaagaagtggtggcagagtgaaaatggcctggaccacgtgtccatccggctggacctggaggccctcttccgcttcagccacctgatcctgaccttcaagaccttccggcctgctgccatgctggtggagaggagcacagattatggccacaactggaaggtgttcaagtactttgccaaggactgtgccaccagcttccccaacatcaccagcggccaggcccagggcgtgggggacatcgtgtgtgacagcaagtacagcgacatcgagcccagcactggaggagaggtggtgctgaaggtgctggaccccagctttgaaattgagaacccctacagcccctacatccaggacctggtgaccctgaccaacctgcgcatcaacttcaccaagctgcacaccctgggagatgccctgctgggccggcggcagaatgacagcctggacaagtactactatgccctgtatgagatgattgtgcggggcagctgcttctgcaatggccacgcctctgaatgtcggcccatgcagaagatgagaggagatgtgttcagccccccaggcatggtgcacggccagtgtgtgtgccagcacaacacagatggccccaactgtgagcgctgcaaggacttcttccaggatgccccctggaggcctgctgctgacctgcaggacaatgcctgccgcagctgcagctgcaacagccacagcagccgctgccactttgacatgaccacctacctggccagcggcggcctgtctggaggagtgtgtgaggactgccagcacaacacagagggccagcactgtgaccgctgccggcccctcttctacagagaccccctgaagaccatcagtgacccctatgcctgcatcccctgtgaatgtgaccctgatggcaccatcagcggcggcatctgtgtgagccacagcgaccctgccctgggctctgtggccggccagtgcctgtgcaaggaaaatgtggagggcgccaagtgtgaccagtgcaagcccaaccactacggcctgagcgccacagaccccctgggctgccagccctgtgactgcaaccccctgggcagcctgcccttcctgacctgtgatgtggacaccggccagtgcctgtgcctgtcctatgtgactggagcccactgtgaggagtgcaccgtgggctactggggcctgggcaaccacctgcacggctgcagcccctgtgactgtgacatcggcggggcctacagcaatgtgtgcagccccaagaatggccagtgtgagtgccggccccacgtgacaggccgcagctgcagcgagcccgcccctggctacttctttgcccccctgaacttctacctgtatgaagctgaggaggccaccaccctgcagggcctggcccccctgggcagcgagaccttcggccagagccctgctgtgcacgtggtgctgggggagcctgtgcccggcaaccctgtgacctggacaggccctggctttgcccgggtgctgcctggagctggcctgcgctttgctgtgaacaacatccccttccctgtggacttcaccatcgccatccactatgagacccagagcgctgctgactggacagtgcagatcgtggtgaaccccccaggcggcagcgagcactgcatccccaagaccctgcagagcaagccccagagctttgccctgcctgctgccacccgcatcatgctgctgcccacccccatctgcctggagccagatgtgcagtacagcattgatgtgtacttcagccagcccctgcagggcgagagccacgcccacagccacgtgctggtggacagcctgggcctcatcccccagatcaacagcctggagaacttctgcagcaagcaggacctggatgagtaccagctgcacaactgtgtggagatcgccagcgccatgggcccccaggtgctgcccggggcctgtgagcggctcatcatctccatgtctgccaagctgcatgatggagctgtggcctgcaagtgccacccccagggctctgtgggcagcagctgcagccggctgggcggccagtgccagtgcaagcccctggtggtgggccgctgctgtgaccgctgcagcacaggcagctatgacctgggccaccacggctgccacccctgccactgccacccccagggcagcaaggacacagtgtgtgaccaggtgacaggccagtgcccctgccacggggaggtgtctggaagaagatgtgaccgctgcctggccggctacttcggcttccccagctgccacccctgcccctgcaacagatttgctgagctgtgtgaccctgagaccggcagctgcttcaactgtggcggcttcaccactggaagaaactgtgagcgctgcattgatggctactacggcaaccccagcagcggccagccctgccggccctgcctgtgcccagatgaccccagcagcaaccagtactttgcccacagctgctaccagaacctgtggagcagtgatgtgatctgcaactgcctgcagggctacacaggcacccagtgtggagaatgttccacaggcttctacggcaacccccgcatcagcggggccccctgccagccctgtgcctgcaacaacaacattgatgtgacagatcctgagagctgcagccgggtgactggagagtgcctgcgctgcctgcacaacacccagggcgccaactgccagctgtgcaagccaggccactacggcagcgccctgaaccagacctgccgccgctgcagctgccacgccagcggcgtgagccccatggagtgccccccaggcggcggggcctgcctgtgtgaccctgtgactggagcctgcccctgcctgcccaacgtgacaggcctggcctgtgacagatgtgctgatggctactggaacctggtgcccggccggggctgccagagctgtgactgtgaccccaggaccagccagagcagccactgtgaccagctgaccggccagtgcccctgcaagctgggctatggaggcaagcgctgcagcgagtgccaggagaactactacggggaccccccaggccgctgcatcccctgtgactgcaacagagctggcacccagaagcccatctgtgaccctgacaccggcatgtgccgctgccgggagggcgtgtctggccagagatgtgacagatgtgcccggggccacagccaggagttccccacctgcctgcagtgccacctgtgctttgaccagtgggaccacaccatcagcagcctgagcaaggctgtgcagggcctgatgaggctggccgccaacatggaggacaagcgggagaccctgcctgtgtgtgaggccgacttcaaggacctgcggggaaatgtgtctgaaattgagcgcatcctgaagcaccctgtgttccccagcggcaagttcctgaaggtgaaggactaccatgacagcgtgcggcggcagatcatgcagctgaatgagcagctgaaggctgtgtatgagttccaggacctgaaggacaccatcgagcgggccaagaatgaggccgacctgctgctggaggacctgcaggaggagattgacctgcagagctctgtgctgaatgccagcattgctgacagcagcgagaacatcaagaagtactaccacatcagcagcagcgctgagaagaagatcaatgagaccagcagcaccatcaacaccagcgccaacaccagaaatgacctgctgaccatcctggacaccctgaccagcaagggcaacctgagcctggagcggctgaagcagatcaagatcccagacatccagatcctgaatgagaaggtgtgtggggaccctggaaatgtgccctgtgtgcccctgccctgtggcggggccctgtgcaccggcaggaagggccacaggaagtgccggggccctggctgccacggcagcctgaccctgagcaccaatgccctgcagaaggcccaggaggccaagagcatcatccggaacctggacaagcaggtgcggggcctgaagaaccagatcgagagcatcagcgagcaggccgaggtgtccaagaacaatgccctgcagctgcgggagaagctgggcaacatccggaaccagagcgacagcgaggaggagaacatcaacctcttcatcaagaaggtgaagaacttcctgctggaggagaatgtgcccccagaagatattgagaaggtggccaacggggtgctggacatccacctgcccatccccagccagaacctgacagatgagctggtgaagatccagaagcacatgcagctgtgtgaggactacagaacagatgaaaatcggctgaatgaggaggctgatggagcccagaagctgctggtgaaggccaaggctgctgagaaggccgccaacatcctgctgaacctggacaagaccctgaaccagctgcagcaggcccagatcacccagggccgggccaacagcaccatcacccagctgacagccaacatcaccaagatcaagaagaatgtgctgcaggccgagaaccagacccgggagatgaagtctgagctggagctggccaagcagaggagcggcctggaggatggcctgagcctgctgcagaccaagctgcagaggcaccaggaccatgctgtgaatgccaaggtgcaggccgagagcgcccagcaccaggccggcagcctggagaaggagtttgtggagctgaagaagcagtatgccatcctgcagaggaagaccagcaccaccggcctgaccaaggagaccctgggcaaggtgaagcagctgaaggatgctgctgagaagctggccggggacacagaggccaagatccgccgcatcacagacctggagaggaagatccaggacctgaacctgagccggcaggccaaggctgaccagctgcgcatcctggaggaccaggtggtggccatcaagaatgaaattgtggagcaggagaagaagtatgcccgctgctacagctag

SEQ ID NO: 149969 - DNA, 1530 bp, Artificial Sequence; identical to SEQ ID NO: 144630
  Description of Artificial Sequence: Synthetic coding sequence

SEQ ID NO: 149970 - DNA, 1386 bp, Artificial Sequence
  Description of Artificial Sequence: Synthetic coding sequence
atgcagagctggagccgggtgtactgcagcctggccaagaggggccacttcaaccgcatcagccacggcctgcagggcctgtctgctgtgcccctgcggacctacgccgaccagcccattgatgctgatgtgacagtgattggcagcggccctgggggctacgtggccgccatcaaggccgcccagctgggcttcaagacagtgtgcatcgagaagaatgagaccctgggcggcacctgcctgaatgtgggctgcatccccagcaaggccctgctgaacaacagccactactaccacatggcccacggcaaggactttgccagccggggcatcgagatgtctgaggtgcggctgaacctggacaagatgatggagcagaagagcacagctgtgaaggccctgactggaggcatcgcccacctgttcaagcagaacaagattgatgaggacaccatcgtgagcagcactggagccctgagcctgaagaaggtgcctgagaagatggtggtgattggagctggggtcatcggcgtggagctgggctctgtgtggcagaggctgggcgcagatgtgacagctgtggagttcctgggccacgtgggcggcgtgggcatcgacatggagatcagcaagaacttccagaggatcctgcagaagcagggcttcaagttcaagctgaacaccaaggtgactggagccaccaagaagagtgatggcaagattgatgtgtccattgaagctgccagcggcggcaaggccgaggtgatcacctgtgatgtgctgctggtgtgcattggaagaagacccttcaccaagaacctgggcctggaggagctgggcatcgagctggacccccggggccgcatccctgtgaacacccgcttccagaccaagatccccaacatctatgccatcggagatgtggtggccggccccatgctggcccacaaggcagaagatgagggcatcatctgtgtggagggcatggccggcggcgctgtgcacatcgactacaactgtgtgcccagcgtcatctacacccaccctgaggtggcctgggtgggcaagtctgaggagcagctgaaggaggagggcatcgagtacaaggtgggcaagttcccctttgctgccaacagccgggccaagaccaatgctgacacagatggcatggtgaagatcctgggccagaagagcacagacagagtgctgggcgcccacatcctgggccctggggccggggagatggtgaatgaagctgccctggccctggagtatggagccagctgtgaggacatcgcccgggtgtgccacgcccaccccaccctgtctgaggccttccgggaggccaacctggccgccagctttgggaagagcatcaacttctag

SEQ ID NO: 149971 - DNA, 1461 bp, Artificial Sequence
  Description of Artificial Sequence: Synthetic coding sequence
atgcagagctggagccgggtgtactgcagcctggccaagaggggccacttcaaccgcatcagccacggcctgcagggcctgtctgctgtgcccctgcggacctacgccgaccagcccattgatgctgatgtgacagtgattggcagcggccctgggggctacgtggccgccatcaaggccgcccagctgggcttcaaggccctgctgaacaacagccactactaccacatggcccacggcaaggactttgccagccggggcatcgagatgtctgaggtgcggctgaacctggacaagatgatggagcagaagagcacagctgtgaaggccctgaccggcggcatcgcccacctgttcaagcagaacaaggtggtgcacgtgaatggctacggcaagatcaccgggaagaaccaggtgacagccaccaaggcagatggcggcacccaggtgattgacaccaagaacatcctgattgccaccggcagcgaggtgacccccttccctggcatcaccattgatgaggacaccatcgtgagcagcactggagccctgagcctgaagaaggtgcctgagaagatggtggtgattggagctggggtgattggagtggagctgggctctgtgtggcagaggctgggcgcagatgtgacagctgtggagttcctgggccacgtgggcggcgtgggcatcgacatggagatcagcaagaacttccagaggatcctgcagaagcagggcttcaagttcaagctgaacaccaaggtgactggagccaccaagaagagtgatggcaagattgatgtgtccattgaggccgccagcggcggcaaggccgaggtgatcacctgtgatgtgctgctggtgtgcatcggccggcggcccttcaccaagaacctgggcctggaggagctgggcatcgagctggacccccggggccgcatccctgtgaacacccgcttccagaccaagatccccaacatctatgccatcggagatgtggtggccggccccatgctggcccacaaggccgaggatgagggcatcatctgtgtggagggcatggccggcggcgctgtgcacatcgactacaactgtgtgcccagcgtcatctacacccaccctgaggtggcctgggtgggcaagtctgaggagcagctgaaggaggagggcatcgagtacaaggtgggcaagttcccctttgctgccaacagccgggccaagaccaatgctgacacagatggcatggtgaagatcctgggccagaagagcacagacagagtgctgggcgcccacatcctgggccctggagctggggagatggtgaatgaggccgccctggccctggagtatggagccagctgtgaagatattgcccgggtgtgccacgcccaccccaccctgtctgaggccttccgggaggccaacctggccgccagctttgggaagagcatcaacttctag

SEQ ID NO: 149972 - DNA, 1233 bp, Artificial Sequence
  Description of Artificial Sequence: Synthetic coding sequence
atggcccacggcaaggactttgccagccggggcatcgagatgtctgaggtgcggctgaacctggacaagatgatggagcagaagagcacagctgtgaaggccctgaccggcggcatcgcccacctgttcaagcagaacaaggtggtgcacgtgaatggctacggcaagatcaccgggaagaaccaggtgacagccaccaaggcagatggcggcacccaggtgattgacaccaagaacatcctgattgccaccggcagcgaggtgacccccttccctggcatcaccattgatgaggacaccatcgtgagcagcactggagccctgagcctgaagaaggtgcctgagaagatggtggtgattggagctggggtgattggagtggagctgggctctgtgtggcagaggctgggcgcagatgtgacagctgtggagttcctgggccacgtgggcggcgtgggcatcgacatggagatcagcaagaacttccagaggatcctgcagaagcagggcttcaagttcaagctgaacaccaaggtgactggagccaccaagaagagtgatggcaagattgatgtgtccattgaggccgccagcggcggcaaggccgaggtgatcacctgtgatgtgctgctggtgtgcatcggccggcggcccttcaccaagaacctgggcctggaggagctgggcatcgagctggacccccggggccgcatccctgtgaacacccgcttccagaccaagatccccaacatctatgccatcggagatgtggtggccggccccatgctggcccacaaggccgaggatgagggcatcatctgtgtggagggcatggccggcggcgctgtgcacatcgactacaactgtgtgcccagcgtcatctacacccaccctgaggtggcctgggtgggcaagtctgaggagcagctgaaggaggagggcatcgagtacaaggtgggcaagttcccctttgctgccaacagccgggccaagaccaatgctgacacagatggcatggtgaagatcctgggccagaagagcacagacagagtgctgggcgcccacatcctgggccctggagctggggagatggtgaatgaggccgccctggccctggagtatggagccagctgtgaagatattgcccgggtgtgccacgcccaccccaccctgtctgaggccttccgggaggccaacctggccgccagctttgggaagagcatcaacttctag

SEQ ID NO: 149973 - DNA, 1380 bp, Artificial Sequence
  Description of Artificial Sequence: Synthetic coding sequence
atgctgatctacgtggccgccatcaaggccgcccagctgggcttcaagacagtgtgcatcgagaagaatgagaccctgggcggcacctgcctgaatgtgggctgcatccccagcaaggccctgctgaacaacagccactactaccacatggcccacggcaaggactttgccagccggggcatcgagatgtctgaggtgcggctgaacctggacaagatgatggagcagaagagcacagctgtgaaggccctgactggaggcatcgcccacctgttcaagcagaacaaggtggtgcacgtgaatggctacggcaagatcaccgggaagaaccaggtgacagccaccaaggcagatggcggcacccaggtgattgacaccaagaacatcctgattgccactggaagtgaggtgacccccttccctggcatcaccattgatgaggacaccatcgtgagcagcactggagccctgagcctgaagaaggtgcctgagaagatggtggtgattggagctggggtcatcggcgtggagctgggctctgtgtggcagaggctgggcgcagatgtgacagctgtggagttcctgggccacgtgggcggcgtgggcatcgacatggagatcagcaagaacttccagaggatcctgcagaagcagggcttcaagttcaagctgaacaccaaggtgactggagccaccaagaagagtgatggcaagattgatgtgtccattgaagctgccagcggcggcaaggccgaggtgatcacctgtgatgtgctgctggtgtgcattggaagaagacccttcaccaagaacctgggcctggaggagctgggcatcgagctggacccccggggccgcatccctgtgaacacccgcttccagaccaagatccccaacatctatgccatcggagatgtggtggccggccccatgctggcccacaaggcagaagatgagggcatcatctgtgtggagggcatggccggcggcgctgtgcacatcgactacaactgtgtgcccagcgtcatctacacccaccctgaggtggcctgggtgggcaagtctgaggagcagctgaaggaggagggcatcgagtacaaggtgggcaagttcccctttgctgccaacagccgggccaagaccaatgctgacacagatggcatggtgaagatcctgggccagaagagcacagacagagtgctgggcgcccacatcctgggccctggggccggggagatggtgaatgaagctgccctggccctggagtatggagccagctgtgaggacatcgcccgggtgtgccacgcccaccccaccctgtctgaggccttccgggaggccaacctggccgccagctttgggaagagcatcaacttctag

SEQ ID NO: 149974 - DNA, 1944 bp, Artificial Sequence
  Description of Artificial Sequence: Synthetic coding sequence
atgtggagggtgtgtgcccggcgggcccagaatgtggccccctgggccggcctggaggcccgctggacagccctgcaggaggtgcccggcaccccccgggtgaccagccgcagcggccctgccccagccaggagaaattctgtgaccaccggctacggcggcgtgcgggccctgtgtggctggacccccagcagcggggccacccccaggaaccggctgctgctgcagctgctgggcagccctggaagacgctactacagcctgcccccccaccagaaggtgcccctgcccagcctgagccccaccatgcaggccggcaccatcgcccgctgggagaagaaggagggggacaagatcaatgaaggagacctgattgctgaggtggagacagacaaggccaccgtgggctttgagagcctggaggagtgctacatggccaagatcctggtggccgagggcaccagagatgtgcccatcggggccatcatctgcatcaccgtgggcaagccagaagatattgaggccttcaagaactacaccctggacagcagcgctgcccccaccccccaggccgccccagcccccaccccagctgccacagccagcccccccaccccatctgcccaggcccctggcagcagctacccaccccacatgcaggtgctgctgcctgccctgagccccaccatgaccatgggcaccgtgcagcgctgggagaagaaggtgggggagaagctgtctgagggggacctgctggccgagattgaaacagacaaggccaccatcggctttgaggtgcaggaggagggctacctggccaagatcctggtgcctgagggcaccagagatgtgcccctgggcacccccctgtgcatcatcgtggagaaggaggccgacatcagcgcctttgctgactaccggcccacagaggtgacagacctgaagccccaggtgcccccacccaccccacctcctgtggccgctgtgccccccaccccccagcccctggcccccaccccatctgccccctgcccagccaccccagctggccccaagggccgggtgtttgtgagccccctggccaagaagctggccgtggagaagggcatcgacctgacccaggtgaagggcaccggcccagatggccgcatcaccaagaaggacatcgacagctttgtgcccagcaaggtggccccagccccagctgctgtggtgccccccaccggccctggcatggcccctgtgcccactggagtcttcacagacatccccatcagcaacatcagaagagtcatcgcccagaggctgatgcagagcaagcagaccatcccccactactacctgagcattgatgtgaacatgggagaggtgctgctggtgaggaaggagctgaacaagatcctggagggccgcagcaagatctctgtgaatgacttcatcatcaaggccagcgccctggcctgcctgaaggtgcctgaggccaacagctcctggatggacaccgtcatccggcagaaccacgtggtggatgtgtctgtggccgtgtccaccccagctggcctcatcacccccatcgtgttcaatgcccacatcaagggcgtggagaccatcgccaatgatgtggtgtccctggccaccaaggcccgggagggcaagctgcagccccatgagttccagggcggcaccttcaccatcagcaacctgggcatgtttggcatcaagaacttcagcgccatcatcaaccccccccaggcctgcatcctggccatcggggccagcgaggacaagctggtgcctgctgacaatgagaagggctttgatgtggcctccatgatgtctgtgaccctgagctgtgaccaccgggtggtggatggagctgtgggcgcccagtggctggccgagttcaggaagtacctggagaagcccatcaccatgctgctgtag

SEQ ID NO: 149975 - DNA, 678 bp, Artificial Sequence
  Description of Artificial Sequence: Synthetic coding sequence
atgtggagggtgtgtgcccggcgggcccagaatgtggccccctgggccggcctggaggcccgctggacagccctgcaggaggtgcccggcaccccccgggtgaccagccgcagcggccctgccccagccaggagaaattctgtgaccaccggctacggcggcgtgcgggccctgtgtggctggacccccagcagcggggccacccccaggaaccggctgctgctgcagctgctgggcagccctggaagacgctactacagcctgcccccccaccagaaggtgcccctgcccagcctgagccccaccatgcaggccggcaccatcgcccgctgggagaagaaggagggggacaagatcaatgaaggagacctgattgctgaggtggagacagacaaggccaccgtgggcaagccagaagatattgaggccttcaagaactacaccctggacagcagcgctgcccccaccccccaggccgccccagcccccaccccagctgccacagccagcccccccaccccatctgcccaggcccctggcagcagctacccaccccacatgcaggtgctgctgcctgccctgagccccaccatgaccatgggcaccgtgcagcgctgggagaagaaggtgggggagaagctgtctgagggggacctgctggccgagatgagcctgtag

SEQ ID NO: 149976 - DNA, 1257 bp, Artificial Sequence
  Description of Artificial Sequence: Synthetic coding sequence
atgcaggccggcaccatcgcccgctgggagaagaaggagggggacaagatcaatgaaggagacctgctggccgagattgaaacagacaaggccaccatcggctttgaggtgcaggaggagggctacctggccaagatcctggtgcctgagggcaccagagatgtgcccctgggcacccccctgtgcatcatcgtggagaaggaggccgacatcagcgcctttgctgactaccggcccacagaggtgacagacctgaagccccaggtgcccccacccaccccacctcctgtggccgctgtgccccccaccccccagcccctggcccccacccccagcgccccctgcccagccaccccagctggccccaagggccgggtgtttgtgagccccctggccaagaagctggccgtggagaagggcatcgacctgacccaggtgaagggcactggaccagatggccgcatcaccaagaaggacatcgacagctttgtgcccagcaaggtggccccagccccagctgctgtggtgcccccaactggacctggcatggcccctgtgcccaccggggtcttcacagacatccccatcagcaacatccggcgggtgattgcccagaggctgatgcagagcaagcagaccatcccccactactacctgagcattgatgtgaacatgggagaggtgctgctggtgaggaaggagctgaacaagatcctggagggccgcagcaagatctctgtgaatgacttcatcatcaaggccagcgccctggcctgcctgaaggtgcctgaggccaacagctcctggatggacaccgtcatccggcagaaccacgtggtggatgtgtctgtggccgtgtccaccccagctggcctcatcacccccatcgtgttcaatgcccacatcaagggcgtggagaccatcgccaatgatgtggtgtccctggccaccaaggcccgggagggcaagctgcagccccatgagttccagggcggcaccttcaccatcagcaacctgggcatgtttggcatcaagaacttcagcgccatcatcaaccccccccaggcctgcatcctggccatcggggccagcgaggacaagctggtgcctgctgacaatgaaaaaggatttgatgtggcctccatgatgtctgtgaccctgagctgtgaccaccgggtggtggatggagctgtgggcgcccagtggctggccgagttcaggaagtacctggagaagcccatcaccatgctgctgtag

SEQ ID NO: 149977 - DNA, 1104 bp, Artificial Sequence
  Description of Artificial Sequence: Synthetic coding sequence
atgacctggctgcagagcaagccccagaggctgcagaacctgagccagcgggagatgtctgggggcaggaagacctctgtgcaggtgcccagccctgccaacggggtgattgaggccctgctggtgcctgatggcggcaaggtggagggcggcacccccctcttcaccctgaggaagacaggagctgccccagccaaggccaagccagctgaggccccagctgctgctgcccccaaggccgagcccacagctgctgctgtgcccccacctgctgcccccatccccacccagatgcctcctgtgcccagccccagccagcccccatctgggaagcctgtgtctgctgtgaagcccaccgtggccccacccctggccgagcctggagctgggaagggcctgcggtctgagcaccgggagaagatgaacaggatgaggcagagaattgcccagaggctgaaggaggcccagaacacctgtgccatgctgaccaccttcaatgaaattgacatgagcaacatccaggagatgagggcccggcacaaggaggccttcctgaagaagcacaacctgaagctgggcttcatgtctgcctttgtgaaggccagcgcctttgccctgcaggagcagcctgtggtgaatgctgtgattgatgacaccaccaaggaggtggtgtacagagactacatcgacatctctgtggccgtggccaccccccggggcctggtggtgcctgtgatcagaaatgtggaggccatgaactttgctgacattgaaagaaccatcacagagctgggggagaaggccaggaagaatgagctggccatcgaggacatggatggcggcaccttcaccatcagcaatggaggagtgtttggcagcctgtttggcacccccatcatcaaccccccccagagcgccatcctgggcatgcacggcatctttgacaggcctgtggccatcggcggcaaggtggaggtgcggcccatgatgtatgtggccctgacctatgaccaccggctgattgatggccgggaggccgtgaccttcctgaggaagatcaaggctgctgtggaggacccccgggtgctgctgctggacctgtag

SEQ ID NO: 149978 - DNA, 1362 bp, Artificial Sequence
  Description of Artificial Sequence: Synthetic coding sequence
atgctgagccgcagccgctgtgtgtcccgggccttcagccgcagcctgagcgccttccagaagggcaactgccccctgggccgccgcagcctgcccggggtgtccctgtgccagggccctggctaccccaacagcaggaaggtggtgatcaacaacagcgtcttctctgtgcgcttcttccgcaccacagctgtgtgcaaggatgacctggtgacagtgaagaccccagcctttgctgagagcgtgacagaaggagatgtgcgctgggagaaggctgtgggggacacagtggctgaagatgaggtggtgtgtgaaattgaaacagacaagacctctgtgcaggtgcccagccctgccaacggggtgattgaggccctgctggtgcctgatggcggcaaggtggagggcggcacccccctcttcaccctgaggaagacaggagctgccccagccaaggccaagccagctgaggccccagctgctgctgcccccaaggccgagcccacagctgctgctgtgcccccacctgctgcccccatccccacccagatgcctcctgtgcccagccccagccagcccccatctgggaagcctgtgtctgctgtgaagcccaccgtggccccacccctggccgagcctggagctgggaagggcctgcggtctgagcaccgggagaagatgaacaggatgaggcagagaattgcccagaggctgaaggaggcccagaacacctgtgccatgctgaccaccttcaatgaaattgacatgagcaacatccaggagatgagggcccggcacaaggaggccttcctgaagaagcacaacctgaagctgggcttcatgtctgcctttgtgaaggccagcgcctttgccctgcaggagcagcctgtggtgaatgctgtgattgatgacaccaccaaggaggtggtgtacagagactacatcgacatctctgtggccgtggccaccccccggggcctggtggtgcctgtgatcagaaatgtggaggccatgaactttgctgacattgaaagaaccatcacagagctgggggagaaggccaggaagaatgagctggccatcgaggacatggatggcggcaccttcaccatcagcaatggaggagtgtttggcagcctgtttggcacccccatcatcaaccccccccagagcgccatcctgggcatgcacggcatctttgacaggcctgtggccatcggcggcaaggtggaggtgcggcccatgatgtatgtggccctgacctatgaccaccggctgattgatggccgggaggccgtgaccttcctgaggaagatcaaggctgctgtggaggacccccgggtgctgctgctggacctgtag

SEQ ID NO: 149979 - DNA, 282 bp, Artificial Sequence
  Description of Artificial Sequence: Synthetic coding sequence
atggaccggctgcagacagccctgctggtggtgctggtgctgctggccgtggccctgcaggccacagaggccggcccctatggagccaacatggaggacagcgtgtgctgccgggactatgtgcgctaccgcctgcccctgcgggtggtgaagcacttctactggaccagtgacagctgccccaggcctggggtggtgctgctgaccttccgggacaaggagatctgtgccgacccccgggtgccctgggtgaagatgatcctgaacaagctgagccagtag

SEQ ID NO: 149980 - DNA, 1560 bp, Artificial Sequence
  Description of Artificial Sequence: Synthetic coding sequence
atggccgcccccagccggctgctgatccggggcggccgggtggtgaatgatgacttcagcgaggtggctgatgtgctggtggaggatggagtggtgcgggccctgggccatgacctgctgcccccaggaggagccccagctggcctgcgggtgctggatgctgctgggaagctggtgctgcccggcggcatcgacacccacacccacatgcagttccccttcatgggcagccgcagcattgatgacttccaccagggcaccaaggccgccctgagcggcggcaccaccatgatcatcgactttgccatcccccagaagggcggcagcctgattgaggcctttgagacctggaggtcctgggccgaccccaaggtgtgctgtgactacagcctgcacgtggccgtgacctggtggagcgaccaggtgaaggaggagatgaagatcctggtgcaggacaagggcgtgaacagcttcaagatgttcatggcctacaaggacctgtacatggtgacagacctggagctgtatgaggccttcagccgctgcaaggagattggagccatcgcccaggtgcatgctgaaaatggagacctgattgctgagggcgccaagaagatgctggccctgggcatcaccggccctgagggccacgagctgtgcaggcctgaggccgtggaggccgaggccaccctgcgggccatcaccatcgccagcgctgtgaactgccccctgtacatcgtgcacgtgatgagcaagtctgctgccaaggtgattgctgatgccaggagagatggcaaggtggtgtatggagagcccatcgccgccagcctgggcacagatggcacccactactggaacaaggagtggcaccacgccgcccaccacgtgatgggcccccccctgcggccagaccccagcaccccagacttcctgatgaacctgctggccaatgatgacctgaccaccactggaacagacaactgcaccttcaacacctgccagaaggccctgggcaaggatgacttcaccaagatccccaatggagtgaatggagtggaggacaggatgtctgtcatctgggagaagggcgtgcacagcggcaagatggatgaaaatagatttgtggccgtgaccagcaccaatgctgccaagatcttcaacctgtaccccaggaagggcagaattgctgtgggcagtgatgctgacatcgtcatctgggaccccaagggcaccaggaccatcagcgccaagacccaccaccaggccgtgaacttcaacatctttgagggcatggtgtgccacggcgtgcccctggtgaccatcagccggggcaaggtggtgtatgaggccggggtcttctctgtgacagctggagatggcaagttcatccccaggaagccctttgctgagtacatctacaagaggatcaagcagagggacaggacctgcacccccacccctgtggagcgggccccctacaagggggaggtggccaccctgaagagccgggtgaccaaggaggatgccacagctggcaccaggaagcaggcccacccctag

SEQ ID NO: 149981 - DNA, 1719 bp, Artificial Sequence
  Description of Artificial Sequence: Synthetic coding sequence
atgagctaccagggcaagaagaacatcccccgcatcaccagtgaccggctgctgatcaagggcggcaagatcgtgaatgatgaccagagcttctatgctgacatctacatggaggatggcctcatcaagcagattggagaaaatctcatcgtgcctgggggcgtgaagaccatcgaggcccacagcaggatggtgattcctgggggcattgatgtgcacacccgcttccagatgccagaccagggcatgaccagcgcagatgacttcttccagggcaccaaggccgccctggccggcggcaccaccatgatcatcgaccacgtggtgcctgagcccggcaccagcctgctggccgcctttgaccagtggagggagtgggccgacagcaagagctgctgtgactacagcctgcacgtggacatcagcgagtggcacaagggcatccaggaggagatggaggccctggtgaaggaccatggagtgaacagcttcctggtgtacatggccttcaaggaccgcttccagctgacagactgccagatctatgaggtgctgagcgtcatccgggacattggagccatcgcccaggtgcatgctgaaaatggagacatcatcgccgaggagcagcagaggatcctggacctgggcatcaccggccctgagggccacgtgctgagcaggcctgaggaggtggaggccgaggccgtgaacagagccatcaccatcgccaaccagaccaactgccccctgtacatcaccaaggtgatgagcaagagcagcgctgaggtgattgcccaggccaggaagaagggcaccgtggtgtatggagagcccatcacagccagcctgggcacagatggcagccactactggagcaagaactgggccaaggctgctgcctttgtgaccagcccccccctgagcccagaccccaccaccccagacttcctgaacagcctgctgagctgtggggacctgcaggtgactggaagtgcccactgcaccttcaacacagcccagaaggctgtgggcaaggacaacttcaccctcatccctgagggcaccaacggcacagaggagaggatgtctgtcatctgggacaaggctgtggtgacaggcaagatggatgagaaccagtttgtggccgtgaccagcaccaatgctgccaaggtgttcaacctgtaccccaggaagggcagaattgctgtgggcagtgatgctgacctggtgatctgggaccctgacagcgtgaagaccatcagcgccaagacccacaacagcagcctggagtacaacatctttgagggcatggagtgccggggcagccccctggtggtgatcagccagggcaagatcgtgctggaggatggcaccctgcacgtgacagagggcagcggccgctacatccccaggaagcccttcccagactttgtgtacaagaggatcaaggcccggagccggctggccgagctgcggggcgtgccccggggcctgtatgatggccctgtgtgtgaggtgtctgtgacccccaagacagtgaccccagccagcagcgccaagaccagccctgccaagcagcaggcccctcctgtgaggaacctgcaccagagcggcttcagcctgagcggggcccagattgatgacaacatccccaggaggaccacccagagaattgtggcccctcctgggggccgggccaacatcaccagcctgggctag

SEQ ID NO: 149982 - DNA, 1611 bp, Artificial Sequence
  Description of Artificial Sequence: Synthetic coding sequence
atggaggatggcctcatcaagcagattggagaaaatctcatcgtgcctgggggcgtgaagaccatcgaggcccacagcaggatggtgattcctgggggcattgatgtgcacacccgcttccagatgccagaccagggcatgaccagcgcagatgacttcttccagggcaccaaggccgccctggccggcggcaccaccatgatcatcgaccacgtggtgcctgagcccggcaccagcctgctggccgcctttgaccagtggagggagtgggccgacagcaagagctgctgtgactacagcctgcacgtggacatcagcgagtggcacaagggcatccaggaggagatggaggccctggtgaaggaccatggagtgaacagcttcctggtgtacatggccttcaaggaccgcttccagctgacagactgccagatctatgaggtgctgagcgtcatccgggacattggagccatcgcccaggtgcatgctgaaaatggagacatcatcgccgaggagcagcagaggatcctggacctgggcatcaccggccctgagggccacgtgctgagcaggcctgaggaggtggaggccgaggccgtgaacagagccatcaccatcgccaaccagaccaactgccccctgtacatcaccaaggtgatgagcaagagcagcgctgaggtgattgcccaggccaggaagaagggcaccgtggtgtatggagagcccatcacagccagcctgggcacagatggcagccactactggagcaagaactgggccaaggctgctgcctttgtgaccagcccccccctgagcccagaccccaccaccccagacttcctgaacagcctgctgagctgtggggacctgcaggtgactggaagtgcccactgcaccttcaacacagcccagaaggctgtgggcaaggacaacttcaccctcatccctgagggcaccaacggcacagaggagaggatgtctgtcatctgggacaaggctgtggtgacaggcaagatggatgagaaccagtttgtggccgtgaccagcaccaatgctgccaaggtgttcaacctgtaccccaggaagggcagaattgctgtgggcagtgatgctgacctggtgatctgggaccctgacagcgtgaagaccatcagcgccaagacccacaacagcagcctggagtacaacatctttgagggcatggagtgccggggcagccccctggtggtgatcagccagggcaagatcgtgctggaggatggcaccctgcacgtgacagagggcagcggccgctacatccccaggaagcccttcccagactttgtgtacaagaggatcaaggcccggagccggctggccgagctgcggggcgtgccccggggcctgtatgatggccctgtgtgtgaggtgtctgtgacccccaagacagtgaccccagccagcagcgccaagaccagccctgccaagcagcaggcccctcctgtgaggaacctgcaccagagcggcttcagcctgagcggggcccagattgatgacaacatccccaggaggaccacccagagaattgtggcccctcctgggggccgggccaacatcaccagcctgggctag

SEQ ID NO: 149983 - DNA, 1719 bp, Artificial Sequence; identical to SEQ ID NO: 149981
  Description of Artificial Sequence: Synthetic coding sequence

SEQ ID NO: 149984 - DNA, 1611 bp, Artificial Sequence; identical to SEQ ID NO: 149982
  Description of Artificial Sequence: Synthetic coding sequence

SEQ ID NO: 149985 - DNA, 597 bp, Artificial Sequence
  Description of Artificial Sequence: Synthetic coding sequence
atgtctgtcatctgggacaaggctgtggtgacaggcaagatggatgagaaccagtttgtggccgtgaccagcaccaatgctgccaaggtgttcaacctgtaccccaggaagggcagaattgctgtgggcagtgatgctgacctggtgatctgggaccctgattctgtgaagaccatctttgagggcatggagtgccggggcagccccctggtggtgatcagccagggcaagatcgtgctggaggatggcaccctgcacgtgacagagggcagcggccgctacatccccaggaagcccttcccagactttgtgtacaagaggatcaaggcccggagccggctggccgagctgcggggcgtgccccggggcctgtatgatggccctgtgtgtgaggtgtctgtgacccccaagacagtgaccccagccagcagcgccaagaccagccctgccaagcagcaggcccctcctgtgaggaacctgcaccagagcggcttcagcctgagcggggcccagattgatgacaacatccccaggaggaccacccagagaattgtggcccctcctgggggccgggccaacatcaccagcctgggctag

SEQ ID NO: 149986 - DNA, 2055 bp, Artificial Sequence
  Description of Artificial Sequence: Synthetic coding sequence
atggccagcggcagaagaggctgggacagcagccatgaagatgacctgcctgtgtacctggcccggcccggcaccacagaccaggtgccccggcagaagtatggaggcatgttctgcaatgtggagggcgcctttgagagcaagaccctggactttgatgccctgtctgtgggccagagaggagccaagacccccaggagcggccagggcagtgaccggggcagcggcagcaggcctggcattgaaggagacaccccaagaagaggccagggccgggaggagagccgggagcccgccccagccagccctgccccagctggggtggagatccgcagcgccaccgggaaggaggtgctgcagaacctgggccccaaggacaagagtgaccggctgctgatcaagggcggccgcatcgtgaatgatgaccagagcttctatgctgacatctacatggaggatggcctcatcaagcagattggagacaacctgattgtgcctgggggcgtgaagaccatcgaggccaacgggaagatggtgattcctgggggcattgatgtgcacacccacttccagatgccctacaagggcatgaccaccgtggatgacttcttccagggcaccaaggccgccctggccggcggcaccaccatgatcatcgaccacgtggtgcctgagcctgagagcagcctgacagaggcctatgagaagtggagggagtgggcagatggcaagagctgctgtgactatgccctgcacgtggacatcacccactggaatgattctgtgaagcaggaggtgcagaacctgatcaaggacaagggcgtgaacagcttcatggtgtacatggcctacaaggacctgtaccaggtgagcaacacagagctgtatgagatcttcacctgcctgggggagctgggcgccatcgcccaggtgcatgctgaaaatggagacatcatcgcccaggagcagaccaggatgctggagatgggcatcaccggccctgagggccacgtgctgagcaggcctgaggagctggaggccgaggccgtgttccgggccatcaccatcgccagccagaccaactgccccctgtatgtgaccaaggtgatgagcaagtctgctgctgacctgatcagccaggccaggaagaagggaaatgtggtgtttggagagcccatcacagccagcctgggcattgatggcacccactactggagcaagaactgggccaaggctgctgcctttgtgaccagcccccccctgagcccagaccccaccaccccagactacatcaacagcctgctggccagcggggacctgcagctgagcggcagcgcccactgcaccttcagcacagcccagaaggccatcggcaaggacaacttcaccgccatccctgagggcaccaacggggtggaggagaggatgtctgtcatctgggacaaggctgtggccaccgggaagatggatgagaaccagtttgtggccgtgaccagcaccaatgctgccaagatcttcaacctgtaccccaggaagggccgcatctctgtgggcagtgacagcgacctggtgatctgggaccctgatgctgtgaagatcgtgtctgccaagaaccaccagagcgctgctgagtacaacatctttgagggcatggagctgcggggggcccccctggtggtgatctgccagggcaagatcatgctggaggatggcaacctgcacgtgacccagggcgccggccgcttcatcccctgcagccccttcagtgactatgtgtacaagaggatcaaggcccggaggaagatggctgacctgcatgctgtgccccggggcatgtatgatggccctgtgtttgacctgaccaccacccccaagggcggcaccccagctggcagcgcccggggcagccccacccggcccaacccccctgtgaggaacctgcaccagagcggcttcagcctgagcggcacccaggtggatgagggcgtgcgcagcgccagcaagagaattgtggcccctcctgggggccgcagcaacatcaccagcctgtcctag

SEQ ID NO: 149987 - DNA, 1713 bp, Artificial Sequence
  Description of Artificial Sequence: Synthetic coding sequence
atgagctaccagggcaagaagaacatcccccgcatcaccagtgaccggctgctgatcaagggcggccgcatcgtgaatgatgaccagagcttctatgctgacatctacatggaggatggcctcatcaagcagattggagacaacctgattgtgcctgggggcgtgaagaccatcgaggccaacgggaagatggtgattcctgggggcattgatgtgcacacccacttccagatgccctacaagggcatgaccaccgtggatgacttcttccagggcaccaaggccgccctggccggcggcaccaccatgatcatcgaccacgtggtgcctgagcctgagagcagcctgacagaggcctatgagaagtggagggagtgggcagatggcaagagctgctgtgactatgccctgcacgtggacatcacccactggaatgattctgtgaagcaggaggtgcagaacctgatcaaggacaagggcgtgaacagcttcatggtgtacatggcctacaaggacctgtaccaggtgagcaacacagagctgtatgagatcttcacctgcctgggggagctgggcgccatcgcccaggtgcatgctgaaaatggagacatcatcgcccaggagcagaccaggatgctggagatgggcatcaccggccctgagggccacgtgctgagcaggcctgaggagctggaggccgaggccgtgttccgggccatcaccatcgccagccagaccaactgccccctgtatgtgaccaaggtgatgagcaagtctgctgctgacctgatcagccaggccaggaagaagggaaatgtggtgtttggagagcccatcacagccagcctgggcattgatggcacccactactggagcaagaactgggccaaggctgctgcctttgtgaccagcccccccctgagcccagaccccaccaccccagactacatcaacagcctgctggccagcggggacctgcagctgagcggcagcgcccactgcaccttcagcacagcccagaaggccatcggcaaggacaacttcaccgccatccctgagggcaccaacggggtggaggagaggatgtctgtcatctgggacaaggctgtggccaccgggaagatggatgagaaccagtttgtggccgtgaccagcaccaatgctgccaagatcttcaacctgtaccccaggaagggccgcatctctgtgggcagtgacagcgacctggtgatctgggaccctgatgctgtgaagatcgtgtctgccaagaaccaccagagcgctgctgagtacaacatctttgagggcatggagctgcggggggcccccctggtggtgatctgccagggcaagatcatgctggaggatggcaacctgcacgtgacccagggcgccggccgcttcatcccctgcagccccttcagtgactatgtgtacaagaggatcaaggcccggaggaagatggctgacctgcatgctgtgccccggggcatgtatgatggccctgtgtttgacctgaccaccacccccaagggcggcaccccagctggcagcgcccggggcagccccacccggcccaacccccctgtgaggaacctgcaccagagcggcttcagcctgagcggcacccaggtggatgagggcgtgcgcagcgccagcaagagaattgtggcccctcctgggggccgcagcaacatcaccagcctgtcctag

SEQ ID NO: 149988 - DNA, 279 bp, Artificial Sequence
  Description of Artificial Sequence: Synthetic coding sequence
atgagctaccagggcaagaagaacatcccccgcatcaccagtgaccggctgctgatcaagggcggccgcatcgtgaatgatgaccagagcttctatgctgacatctacatggaggatggcctcatcaagcagattggagacaacctgattgtgcctgggggcgtgaagaccatcgaggccaacgggaagatggtgattcctgggggcattgatgtgcacacccacttccagatgccctacaagggcatgaccaccgtggatgacttcttccagggctag

SEQ ID NO: 149989 - DNA, 591 bp, Artificial Sequence
  Description of Artificial Sequence: Synthetic coding sequence
atggatgagaaccagtttgtggccgtgaccagcaccaatgctgccaagatcttcaacctgtaccccaggaagggccgcatctctgtgggcagtgacagcgacctggtgatctgggaccctgatgctgtgaagatcgtgtctgccaagaaccaccagagcgctgctgagtacaacatctttgagggcatggagctgcggggggcccccctggtggtgatctgccagggcaagatcatgctggaggatggcaacctgcacgtgacccagggcgccggccgcttcatcccctgcagccccttcagtgactatgtgtacaagaggatcaaggcccggaggaagatggctgacctgcatgctgtgccccggggcatgtatgatggccctgtgtttgacctgaccaccacccccaagggcggcaccccagctggcagcgcccggggcagccccacccggcccaacccccctgtgaggaacctgcaccagagcggcttcagcctgagcggcacccaggtggatgagggcgtgcgcagcgccagcaagagaattgtggcccctcctgggggccgcagcaacatcaccagcctgtcctag

SEQ ID NO: 149990 - DNA, 1719 bp, Artificial Sequence
  Description of Artificial Sequence: Synthetic coding sequence
atgtccttccagggcaagaagagcatcccccgcatcaccagtgaccggctgctgatccggggcggccgcatcgtgaatgatgaccagagcttctatgcagatgtgcacgtggaggatggcctcatcaagcagattggagaaaatctcatcgtgcctgggggcatcaagaccattgatgcccacggcctgatggtgctgcctggaggagtggatgtgcacacccggctgcagatgcctgtgctgggcatgaccccagcagatgacttctgccagggcaccaaggccgccctggccggcggcaccaccatgatcctggaccacgtgtttcctgacaccggggtgtccctgctggccgcctatgagcagtggagggagagagctgacagcgctgcctgctgtgactacagcctgcacgtggacatcacccgctggcatgagagcatcaaggaggagctggaggccctggtgaaggagaagggcgtgaacagcttcctggtgttcatggcctacaaggaccgctgccagtgcagcgacagccagatgtatgagatcttcagcatcatccgggacctgggcgccctggcccaggtgcatgctgaaaatggagacatcgtggaggaggagcagaagaggctgctggagctgggcatcaccggccctgagggccacgtgctgagccaccctgaggaggtggaggccgaggccgtgtacagagctgtgaccatcgccaagcaggccaactgccccctgtatgtgaccaaggtgatgagcaaaggagctgctgatgccatcgcccaggccaagagaagaggagtggtggtgtttggagagcccatcacagccagcctgggcacagatggcagccactactggagcaagaactgggccaaggctgctgcctttgtgaccagcccccctgtgaacccagaccccaccacagctgaccacctgacctgcctgctgagcagcggggacctgcaggtgactggaagtgcccactgcaccttcaccacagcccagaaggctgtgggcaaggacaactttgccctgatccctgagggcaccaacggcatcgaggagaggatgtccatggtgtgggagaagtgtgtggccagcggcaagatggatgaaaatgaatttgtggccgtgaccagcaccaatgctgccaagatcttcaacttctaccccaggaagggccgggtggccgtgggcagtgatgctgacctggtgatctggaaccccaaggccaccaagatcatcagcgccaagacccacaacctgaatgtggagtacaacatctttgagggcgtggagtgccgcggggccccagctgtggtgatcagccagggccgggtggccctggaggatggcaagatgtttgtgaccccaggagctggccgctttgtgcccaggaagaccttcccagactttgtgtacaagaggatcaaggccaggaaccggctggccgagatccacggcgtgccccggggcctgtatgatggccctgtgcatgaggtgatggtgcctgccaagccaggcagcggggccccagcccgggccagctgccctgggaagatctctgtgccccctgtgaggaacctgcaccagagcggcttcagcctgagcggcagccaggctgatgaccacatcgcccggaggacagcccagaagatcatggcccctcctgggggccgcagcaacatcaccagcctgtcctag

SEQ ID NO: 149991 - DNA, 1239 bp, Artificial Sequence
  Description of Artificial Sequence: Synthetic coding sequence
atgcctgtgctgggcatgaccccagcagatgacttctgccagggcaccaaggccgccctggccggcggcaccaccatgatcctggaccacgtgtttcctgacacaggagtgtccctgctggccgcctatgagcagtggagggagagagctgacagcgctgcctgctgtgactacagcctgcacgtggacatcacccgctggcatgagagcatcaaggaggagctggaggccctggtgaaggagaagggcgtgaacagcttcctggtgttcatggcctacaaggaccgctgccagtgcagcgacagccagatgtatgagatcttcagcatcatccgggacctgggcgccctggcccaggtgcatgctgaaaatggagacatcgtggaggaggtggaggccgaggccgtgtacagagctgtgaccatcgccaagcaggccaactgccccctgtatgtgaccaaggtgatgagcaaaggagctgctgatgccatcgcccaggccaagagaagaggagtggtggtgtttggagagcccatcacagccagcctgggcacagatggcagccactactggagcaagaactgggccaaggctgctgcctttgtgaccagcccccctgtgaacccagaccccaccacagctgaccacctgacctgcctgctgagcagcggggacctgcaggtgactggaagtgcccactgcaccttcaccacagcccagaaggctgtgggcaaggacaactttgccctgatccctgagggcaccaacggcatcgaggagaggatgtccatggtgtgggagaagtgtgtggccagcggcaagatggatgaaaatgaatttgtggccgtgaccagcaccaatgctgccaagatcttcaacttctaccccaggaagggccgggtggccgtgggcagtgatgctgacctggtgatctggaaccccaaggccaccaagatcatcagcgccaagacccacaacctgctggccgagatccacggcgtgccccggggcctgtatgatggccctgtgcatgaggtgatggtgcctgccaagccaggcagcggggccccagcccgggccagctgccctgggaagatctctgtgccccctgtgaggaacctgcaccagagcggcttcagcctgagcggcagccaggctgatgaccacatcgcccggaggacagcccagaagatcatggcccctcctgggggccgcagcaacatcaccagcctgtcctag

SEQ ID NO: 149992 - DNA, 1239 bp, Artificial Sequence; identical to SEQ ID NO: 149991
  Description of Artificial Sequence: Synthetic coding sequence

SEQ ID NO: 149993 - DNA, 1695 bp, Artificial Sequence
  Description of Artificial Sequence: Synthetic coding sequence
atgctggccaacagcgcctctgtgcgcatcctgatcaagggcggcaaggtggtgaatgatgactgcacccatgaagcagatgtgtacattgaaaatggcatcatccagcaggtgggccgggagctgatgatccctggaggagccaaggtgattgatgccaccgggaagctggtgattcctgggggcatcgacaccagcacccacttccaccagaccttcatgaatgccacctgtgtggatgacttctaccacggcaccaaggccgccctggtgggcggcaccaccatgatcatcggccacgtgctgcctgacaaggagaccagcctggtggatgcctatgaaaaatgtcggggcctggccgaccccaaggtgtgctgtgactatgccctgcacgtgggcatcacctggtgggcccccaaggtgaaggccgagatggagaccctggtgcgggagaagggcgtgaacagcttccagatgttcatgacctacaaggacctgtacatgctgcgggacagcgagctgtaccaggtgctgcacgcctgcaaggacatcggggccatcgcccgggtgcatgctgaaaatggagagctggtggccgagggcgccaaggaggccctggacctgggcatcactggacctgagggcatcgagatcagcaggcctgaggagctggaggccgaggccacccacagggtcatcaccatcgccaacagaacccactgccccatctacctggtgaatgtgagcagcatctctgctggagatgtgattgctgctgccaagatgcagggcaaggtggtgctggccgagaccaccacagcccacgccaccctgaccggcctgcactactaccaccaggactggagccatgctgctgcctacgtgacagtgccccccctgcggctggacaccaacaccagcacctacctgatgagcctgctggccaatgacaccctgaacatcgtggccagtgaccaccggcccttcaccaccaagcagaaggccatgggcaaggaggacttcaccaagatcccccacggcgtgtctggagtgcaggacaggatgtctgtcatctgggagcggggcgtggtgggcggcaagatggatgagaacagatttgtggccgtgaccagcagcaatgctgccaagctgctgaacctgtaccccaggaagggccgcatcatccctggagcagatgctgatgtggtggtgtgggaccctgaggccaccaagaccatcagcgccagcacccaggtgcagggcggggacttcaacctgtatgagaacatgcgctgccacggcgtgcccctggtgaccatcagccggggccgggtggtgtatgaaaatggagtcttcatgtgtgccgagggcaccgggaagttctgccccctgcggagcttcccagacacagtgtacaagaagctggtgcagcgggagaagaccctgaaggtgcggggcgtggacaggaccccctacctgggagatgtggccgtggtggtgcaccctgggaagaaggagatgggcacccccctggccgacacccccaccaggcctgtgaccaggcatggaggcatgagggacctgcacgagagcagcttcagcctgagcggcagccagattgatgaccacgtgcccaagagggccagcgcccgcatcctggcccctcctgggggccgcagcagcggcatctggtag

SEQ ID NO: 149994 - DNA, 1695 bp, Artificial Sequence; identical to SEQ ID NO: 149993
  Description of Artificial Sequence: Synthetic coding sequence

SEQ ID NO: 149995 - DNA, 573 bp, Artificial Sequence
  Description of Artificial Sequence: Synthetic coding sequence
atgctggccaacagcgcctctgtgcgcatcctgatcaagggcggcaaggtggtgaatgatgactgcacccatgaagcagatgtgtacattgaaaatggcatcatccagcaggtgggccgggagctgatgatccctggaggagccaaggtgattgatgccaccgggaagctggtgattcctgggggcatcgacaccagcacccacttccaccagaccttcatgaatgccacctgtgtggatgacttctaccacggcaccaaggccgccctggtgggcggcaccaccatgatcatcggccacgtgctgcctgacaaggagaccagcctggtggatgcctatgaaaaatgtcggggcctggccgaccccaaggtgtgctgtgactatgccctgcacgtgggcatcacctggtgggcccccaaggtgaaggccgagatggagaccctggtgcgggagaagggcgtgaacagcttccagatgttcatgacctacaaggacctgtacatgctgcgggacagcgagctgtaccaggtgctgcacgcctgcaaggacatcggggccatcgcccgggtgtag

SEQ ID NO: 149996 - DNA, 525 bp, Artificial Sequence
  Description of Artificial Sequence: Synthetic coding sequence
atgctggccaacagcgcctctgtgcgcatcctgatcaagggcggcaaggtggtgaatgatgactgcacccatgaagcagatgtgtacattgaaaatggcatcatccagcaggtgggccgggagctgatgatccctggaggagccaaggtgattgatgccaccgggaagctggtgattcctgggggcatcgacaccagcacccacttccaccagaccttcatgaatgccacctgtgtggatgacttctaccacggcaccaaggccgccctggtgggcggcaccaccatgatcatcggccacgtgctgcctgacaaggagaccagcctggtggatgcctatgaaaaatgtcggggcctggccgaccccaaggtgtgctgtgactatgccctgcacgtgggcatcacctggtgggcccccaaggtgaaggccgagatggagaccctggtgcgggagaagggcgtgaacagcttccagatgttcatgacctacaaggacctgtacatgctgcgggacagcgagctgtag

SEQ ID NO: 149997 - DNA, 498 bp, Artificial Sequence
  Description of Artificial Sequence: Synthetic coding sequence
atgctggccaacagcgcctctgtgcgcatcctgatcaagggcggcaaggtggtgaatgatgactgcacccatgaagcagatgtgtacattgaaaatggcatcatccagcaggtgggccgggagctgatgatccctggaggagccaaggtgattgatgccaccgggaagctggtgattcctgggggcatcgacaccagcacccacttccaccagaccttcatgaatgccacctgtgtggatgacttctaccacggcaccaaggccgccctggtgggcggcaccaccatgatcatcggccacgtgctgcctgacaaggagaccagcctggtggatgcctatgaaaaatgtcggggcctggccgaccccaaggtgtgctgtgactatgccctgcacgtgggcatcacctggtgggcccccaaggtgaaggccgagatggagaccctggtgcgggagaagggcgtgaacagcttccagatgttcatgacctacaaggactag

SEQ ID NO: 149998 - DNA, 522 bp, Artificial Sequence
  Description of Artificial Sequence: Synthetic coding sequence
atggcccctgtgctgagcaaggacagcgctgacatcgagagcatcctggccctgaaccccaggacccagacccacgccaccctgcggagcaccagcgccaagaagctggacaagaagcactggaagagaaatccagacaagaactgcttcaactgtgagaagctggagaacaactttgatgacatcaagcacaccaccctgggggagcggggggccctgcgggaggccatgcgctgcctgaagtgtgctgatgccccctgccagaagagctgccccaccaacctggacatcaagagcttcatcaccagcatcgccaacaagaactactacggggccgccaagatgatcttcagtgacaaccccctgggcctgacctgtggcatggtgtgccccaccagtgacctgtgtgtgggcggctgcaacctgtatgccacagaggagggccccatcaacatcggcggcctgcagcagtttgccacagagaccctcatcctggccttcagcctgatgaaccacctgtag

SEQ ID NO: 149999 - DNA, 3078 bp, Artificial Sequence
  Description of Artificial Sequence: Synthetic coding sequence
atggcccctgtgctgagcaaggacagcgctgacatcgagagcatcctggccctgaaccccaggacccagacccacgccaccctgcggagcaccagcgccaagaagctggacaagaagcactggaagagaaatccagacaagaactgcttcaactgtgagaagctggagaacaactttgatgacatcaagcacaccaccctgggggagcggggggccctgcgggaggccatgcgctgcctgaagtgtgctgatgccccctgccagaagagctgccccaccaacctggacatcaagagcttcatcaccagcatcgccaacaagaactactacggggccgccaagatgatcttcagtgacaaccccctgggcctgacctgtggcatggtgtgccccaccagtgacctgtgtgtgggcggctgcaacctgtatgccacagaggagggccccatcaacatcggcggcctgcagcagtttgccacagaggtgttcaaggccatgagcatcccccagatccggaaccccagcctgcccccacctgagaagatgtctgaggcctacagcgccaagatcgccctgtttggagctggccctgccagcatcagctgtgccagcttcctggcccggctgggctacagcgacatcaccatctttgagaagcaggagtatgtgggcggcctgagcaccagcgagatcccccagttccggctgccctatgatgtggtgaactttgaaattgagctgatgaaggacctgggcgtgaagatcatctgtgggaagagcctgtctgtgaatgagatgaccctgagcaccctgaaggagaagggctacaaggccgccttcatcggcatcggcctgcctgagcccaacaaggatgccatcttccagggcctgacccaggaccagggcttctacaccagcaaggacttcctgcccctggtggccaagggcagcaaggccggcatgtgtgcctgccacagccccctgcccagcatccggggcgtggtgattgtgctgggcgctggggacacagcctttgactgtgccaccagcgccctgcgctgtggggcccggcgggtcttcatcgtgttcagaaaaggatttgtgaacatccgggctgtgcctgaggagatggagctggccaaggaggagaagtgtgagttcctgcccttcctgagccccaggaaggtgattgtgaagggcggcagaattgtggccatgcagtttgtgaggacagagcaggatgagaccgggaagtggaatgaagatgaggaccagatggtgcacctgaaggcagatgtggtgatcagcgccttcggctctgtgctgagtgaccccaaggtgaaggaggccctgagccccatcaagttcaaccgctggggcctgcctgaggtggaccctgagaccatgcagaccagcgaggcctgggtgtttgctggaggagatgtggtgggcctggccaacaccaccgtggagagcgtgaatgatggcaagcaggcctcctggtacatccacaagtatgtgcagagccagtatggagcctctgtgtctgccaagccagagctgcccctcttctacacccccatcgacctggtggacatctctgtggagatggccggcctgaagttcatcaaccccttcggcctggccagcgccaccccagccaccagcacctccatgatcagaagagcctttgaggccggctggggctttgccctgaccaagaccttcagcctggacaaggacatcgtgaccaacgtgagcccccgcatcatccggggcaccaccagcggccccatgtatggccctggccagagcagcttcctgaacatcgagctgatcagcgagaagacagctgcctactggtgccagagcgtgacagagctgaaggctgacttcccagacaacatcgtcatcgccagcatcatgtgcagctacaacaagaatgactggacagagctggccaagaagtctgaggacagcggggctgatgccctggagctgaacctgagctgcccccacggcatgggagagcggggcatgggcctggcctgtggccaggaccctgagctggtgaggaacatctgccgctgggtgcggcaggccgtgcagatccccttctttgccaagctgaccccaaatgtgacagacatcgtgtccatcgcccgggccgccaaggagggcggggccaacggggtgacagccaccaacacagtgtctggcctgatgggcctgaagagtgatggcaccccctggccagctgtgggcatcgccaagaggaccacctacggcggcgtgtctggaacagccatccggcccatcgccctgcgggctgtgaccagcatcgcccgggccctgcccggcttccccatcctggccactggaggcatcgacagcgctgagagcggcctgcagttcctgcacagcggggcctctgtgctgcaggtgtgcagcgccatccagaaccaggacttcaccgtgattgaggactactgcaccggcctgaaggccctgctgtacctgaagagcattgaggagctgcaggactgggatggccagagccctgccaccgtgagccaccagaagggcaagcctgtgcccagaattgctgagctgatggacaagaagctgcccagctttggcccctacctggagcagaggaagaagatcatcgccgagaacaagatccggctgaaggagcagaatgtggccttcagccccctgaagaggaactgcttcatccccaagaggcccatccccaccatcaaggatgtgattggcaaggccctgcagtacctgggcacctttggagagctgagcaatgtggagcaggtggtggccatgattgatgaggagatgtgcatcaactgtgggaagtgctacatgacctgcaatgacagcggctaccaggccatccagtttgatcctgagacccacctgcccaccatcacagacacctgcaccggctgcaccctgtgcctgtctgtgtgccccatcgtggactgcatcaagatggtgtccaggaccaccccctatgagcccaagaggggcgtgcccctgtctgtgaaccctgtgtgctag

SEQ ID NO: 150000 - DNA, 471 bp, Artificial Sequence
  Description of Artificial Sequence: Synthetic coding sequence
atggcccctgtgctgagcaaggacagcgctgacatcgagaactgtgagaagctggagaacaactttgatgacatcaagcacaccaccctgggggagcggggggccctgcgggaggccatgcgctgcctgaagtgtgctgatgccccctgccagaagagctgccccaccaacctggacatcaagagcttcatcaccagcatcgccaacaagaactactatggagctgccaagatgatcttcagtgacaaccccctgggcctgacctgtggcatggtgtgccccaccagtgacctgtgtgtgggcggctgcaacctgtatgccacagaggagggccccatcaacattggaggcctgcagcagtttgccacagaggtgaatggcctgctgcacttccagaacagcgtgtccctgtggttccagaagacagccaacatctccttcctgagctgtggcagcctgcaggatgcctag

SEQ ID NO: 150001 - DNA, 1482 bp, Artificial Sequence
  Description of Artificial Sequence: Synthetic coding sequence
atgatcctgaacagcctgagcctgtgctaccacaacaagctgatcctggcccccatggtgcgggtgggcaccctgcccatgaggctgctggccctggactatggagctgacatcgtgtactgtgaggagctgattgacctgaagatgatccagtgcaagagggtggtgaatgaggtgctgagcacagtggactttgtggccccagatgacagagtggtgttccgcacctgtgagcgggagcagaacagagtggtgttccagatgggcaccagtgatgctgagcgggccctggccgtggcccggctggtggagaatgatgtggccggcattgatgtgaacatgggctgccccaagcagtacagcaccaagggcggcatgggcgccgccctgctgagtgaccctgacaagattgagaagatcctgagcaccctggtgaagggcaccaggaggcctgtgacctgcaagatccgcatcctgcccagcctggaggacaccctgagcctggtgaagagaattgaaagaactggaattgctgccatcgctgtgcacggcaggaagcgggaggagcggccccagcaccctgtgtcctgtgaggtgatcaaggccatcgctgacaccctgagcatccctgtgattgccaacggcggcagccatgaccacatccagcagtacagcgacatcgaggacttccggcaggccacagctgccagctctgtgatggtggcccgggccgccatgtggaaccccagcatcttcctgaaggagggcctgcggcccctggaggaggtgatgcagaagtacatccgctatgctgtgcagtatgacaaccactacaccaacaccaagtactgcctgtgccagatgctgcgggagcagctggagagcccccagggccgcctgctgcatgctgcccagagcagccgggagatctgtgaggccttcggcctgggcgccttctatgaggagaccacccaggagctggatgcccagcaggcccggctgagcgccaagaccagcgagcagacaggagagcctgctgaggacaccagcggggtcatcaagatggctgtgaagtttgacagaagagcctacccagcccagatcacccccaagatgtgcctgctggagtggtgcagaagagagaagctggcccagcctgtgtatgagaccgtgcagaggcccctggacaggctcttcagcagcatcgtgacagtggccgagcagaagtaccagagcaccctgtgggacaagagcaagaagctggccgagcaggccgccgccatcgtgtgcctgcggagccagggcctgcctgagggccgcctgggggaggagagccccagcctgcacaagaggaagcgggaggccccagaccaggaccccggcggcccccgggcccaggagctggcccagcccggggacctgtgcaagaagccctttgtggccctgggcagcggggaggagagccccctggagggctggtag

SEQ ID NO: 150002 - DNA, 1482 bp, Artificial Sequence; identical to SEQ ID NO: 150001
  Description of Artificial Sequence: Synthetic coding sequence

SEQ ID NO: 150003 - DNA, 1377 bp, Artificial Sequence
  Description of Artificial Sequence: Synthetic coding sequence
atgatcctgaacagcctgagcctgtgctaccacaacaagctgatcctggcccccatggtgcgggtgggcaccctgcccatgaggctgctggccctggactatggagctgacatcgtgtactgtgaggagctgattgacctgaagatgatccagtgcaagagggtggtgaatgaggtgctgagcacagtggactttgtggccccagatgacagagtggtgttccgcacctgtgagcgggagcagaacagagtggtgttccagatgggcggcatgggcgccgccctgctgagtgaccctgacaagattgagaagatcctgagcaccctggtgaagggcacccggcggcctgtgacctgcaagatccgcatcctgcccagcctggaggacaccctgagcctggtgaagagaattgaaagaactggaattgctgccatcgctgtgcacggcaggaagcgggaggagcggccccagcaccctgtgtcctgtgaggtgatcaaggccatcgctgacaccctgagcatccctgtgattgccaatggaggcagccatgaccacatccagcagtacagcgacatcgaggacttccggcaggccacagctgccagctctgtgatggtggcccgggccgccatgtggaaccccagcatcttcctgaaggagggcctgcggcccctggaggaggtgatgcagaagtacatccgctatgctgtgcagtatgacaaccactacaccaacaccaagtactgcctgtgccagatgctgcgggagcagctggagagcccccagggccgcctgctgcacgccgcccagagcagccgggagatctgtgaggccttcggcctgggcgccttctatgaggagaccacccaggagctggatgcccagcaggcccggctgagcgccaagaccagcgagcagacaggagagcctgctgaggacaccagcggggtcatcaagatggctgtgaagtttgaccggcgggcctacccagcccagatcacccccaagatgtgcctgctggagtggtgccggcgggagaagctggcccagcctgtgtatgaaacagtgcagaggcccctggacaggctcttcagcagcatcgtgacagtggccgagcagaagtaccagagcaccctgtgggacaagagcaagaagctggccgagcaggccgccgccatcgtgtgcctgcggagccagggcctgcctgagggccgcctgggggaggagagccccagcctgcacaagaggaagcgggaggccccagaccaggaccccggcggcccccgggcccaggagctggcccagcccggggacctgtgcaagaagccctttgtggccctgggcagcggggaggagagccccctggagggctggtag

SEQ ID NO: 150004 - DNA, 858 bp, Artificial Sequence
  Description of Artificial Sequence: Synthetic coding sequence
atggccggcctgggccaccctgctgccttcggccgggccacccatgctgtggtgcgggccctgcctgagagcctgggccagcacgccctgcggagcgccaagggggaggaggtggatgtggcccgggcagagcggcagcaccagctgtatgtgggcgtgctgggcagcaagctgggcctgcaggtggtggagctgcctgcagatgagagcctgcctgactgtgtgtttgtggaggatgtggccgtggtgtgtgaggagacagccctgatcaccaggcctggggcccccagcaggaggaaggaggtggacatgatgaaggaggccctggagaagctgcagctgaacatcgtggagatgaaggatgaaaatgccaccctggatggaggagatgtgctcttcaccggccgggagttctttgtgggcctgagcaagaggaccaaccagagaggagctgagatcctggccgacaccttcaaggactatgctgtgtccacagtgcctgtggctgatggcctgcacctgaagagcttctgcagcatggccggccccaacctgattgccatcggcagcagcgagagcgcccagaaggccctgaagatcatgcagcagatgtctgaccacagatatgacaagctgactgtgcctgatgacattgctgccaactgcatctacctgaacatccccaacaagggccacgtgctgctgcacaggaccccagaggagtacccagagagcgccaaggtgtatgagaagctgaaggaccacatgctgatccctgtgtccatgtctgagctggagaaggtggatggcctgctgacctgctgcagcgtgctgatcaacaagaaggtggacagctag

SEQ ID NO: 150005 - DNA, 579 bp, Artificial Sequence
  Description of Artificial Sequence: Synthetic coding sequence
atgtggctgtatggcctgggccaggtggacatgatgaaggaggccctggagaagctgcagctgaacatcgtggagatgaaggatgaaaatgccaccctggatggaggagatgtgctcttcaccggccgggagttctttgtgggcctgagcaagaggaccaaccagagaggagctgagatcctggccgacaccttcaaggactatgctgtgtccacagtgcctgtggctgatggcctgcacctgaagagcttctgcagcatggccggccccaacctgattgccatcggcagcagcgagagcgcccagaaggccctgaagatcatgcagcagatgtctgaccacagatatgacaagctgactgtgcctgatgacattgctgccaactgcatctacctgaacatccccaacaagggccacgtgctgctgcacaggaccccagaggagtacccagagagcgccaaggtgtatgagaagctgaaggaccacatgctgatccctgtgtccatgtctgagctggagaaggtggatggcctgctgacctgctgcagcgtgctgatcaacaagaaggtggacagctag

SEQ ID NO: 150006 - DNA, 549 bp, Artificial Sequence
  Description of Artificial Sequence: Synthetic coding sequence
atgatgaaggaggccctggagaagctgcagctgaacatcgtggagatgaaggatgaaaatgccaccctggatggaggagatgtgctcttcaccggccgggagttctttgtgggcctgagcaagaggaccaaccagagaggagctgagatcctggccgacaccttcaaggactatgctgtgtccacagtgcctgtggctgatggcctgcacctgaagagcttctgcagcatggccggccccaacctgattgccatcggcagcagcgagagcgcccagaaggccctgaagatcatgcagcagatgtctgaccacagatatgacaagctgactgtgcctgatgacattgctgccaactgcatctacctgaacatccccaacaagggccacgtgctgctgcacaggaccccagaggagtacccagagagcgccaaggtgtatgagaagctgaaggaccacatgctgatccctgtgtccatgtctgagctggagaaggtggatggcctgctgacctgctgcagcgtgctgatcaacaagaaggtggacagctag

SEQ ID NO: 150007 - DNA, 858 bp, Artificial Sequence; identical to SEQ ID NO: 150004
  Description of Artificial Sequence: Synthetic coding sequence

SEQ ID NO: 150008 - DNA, 558 bp, Artificial Sequence
  Description of Artificial Sequence: Synthetic coding sequence
atggtggacatgatgaaggaggccctggagaagctgcagctgaacatcgtggagatgaaggatgaaaatgccaccctggatggaggagatgtgctcttcaccggccgggagttctttgtgggcctgagcaagaggaccaaccagagaggagctgagatcctggccgacaccttcaaggactatgctgtgtccacagtgcctgtggctgatggcctgcacctgaagagcttctgcagcatggccggccccaacctgattgccatcggcagcagcgagagcgcccagaaggccctgaagatcatgcagcagatgtctgaccacagatatgacaagctgactgtgcctgatgacattgctgccaactgcatctacctgaacatccccaacaagggccacgtgctgctgcacaggaccccagaggagtacccagagagcgccaaggtgtatgagaagctgaaggaccacatgctgatccctgtgtccatgtctgagctggagaaggtggatggcctgctgacctgctgcagcgtgctgatcaacaagaaggtggacagctag

SEQ ID NO: 150009 - DNA, 858 bp, Artificial Sequence
  Description of Artificial Sequence: Synthetic coding sequence
atgggcaccccaggagagggcctgggccgctgcagccacgccctgatccggggcgtgcctgagagcctggccagcggggagggcgctggggccggcctgcctgccctggacctggccaaggcccagcgggagcacggcgtgctgggcggcaagctgcggcagaggctgggcctgcagctgctggagctgcccccagaggagagcctgcccctgggccccctgctgggggacacagctgtgatccagggcgacacagccctgatcacccggccctggagccctgcccggcggcctgaggtggatggagtgaggaaggccctgcaggacctgggcctgcgcatcgtggagattggagatgaaaatgccaccctggatggaacagatgtgctcttcaccggccgggagttctttgtgggcctgagcaagtggaccaaccacagaggagctgagatcgtggccgacaccttccgggactttgctgtgtccacagtgcctgtgtctggccccagccacctgcggggcctgtgtggcatgggcggccccaggacagtggtggccggcagcagtgatgctgcccagaaggctgtgcgggccatggctgtgctgacagaccacccctatgccagcctgaccctgcctgatgatgctgctgctgactgcctcttcctgcggcccggcctgcccggggtgccccccttcctgctgcaccggggcggcggggacctgcccaacagccaggaggccctgcagaagctgagtgatgtgaccctggtgcctgtgtcctgcagcgagctggagaaggccggggccggcctgagcagcctgtgcctggtgctgagcacccggccccacagctag

SEQ ID NO: 150010 - DNA, 858 bp, Artificial Sequence; identical to SEQ ID NO: 150009
  Description of Artificial Sequence: Synthetic coding sequence

SEQ ID NO: 150011 - DNA, 858 bp, Artificial Sequence; identical to SEQ ID NO: 150009
  Description of Artificial Sequence: Synthetic coding sequence

SEQ ID NO: 150012 - DNA, 858 bp, Artificial Sequence; identical to SEQ ID NO: 150009
  Description of Artificial Sequence: Synthetic coding sequence

SEQ ID NO: 150013 - DNA, 858 bp, Artificial Sequence; identical to SEQ ID NO: 150009
  Description of Artificial Sequence: Synthetic coding sequence

SEQ ID NO: 150014 - DNA, 858 bp, Artificial Sequence; identical to SEQ ID NO: 150009
  Description of Artificial Sequence: Synthetic coding sequence

SEQ ID NO: 150015 - DNA, 858 bp, Artificial Sequence; identical to SEQ ID NO: 150009
  Description of Artificial Sequence: Synthetic coding sequence

SEQ ID NO: 150016 - DNA, 567 bp, Artificial Sequence
  Description of Artificial Sequence: Synthetic coding sequence
tgaagaagacctgaggtggatggagtgaggaaggccctgcaggacctgggcctgcgcatcgtggagattggagatgaaaatgccaccctggatggaacagatgtgctcttcaccggccgggagttctttgtgggcctgagcaagtggaccaaccacagaggagctgagatcgtggccgacaccttccgggactttgctgtgtccacagtgcctgtgtctggccccagccacctgcggggcctgtgtggcatgggcggccccaggacagtggtggccggcagcagtgatgctgcccagaaggctgtgaggatgacccagctgctgactgtgtccttctttgtgctgggctgcctggtgtgccccctgagcagctgcaccgtggaggtgggcatctgccccacagcccggcggcactgccgcagcagcctgatgagcccctggtacctgtgcccagcccagaactggaggcggctggcccctggcagcgcccccagcgcctggtgcagcgcccacgcccccacagctgagggcctggccctgggctactgctggccaggagtgggctag

SEQ ID NO: 150017 - DNA, 567 bp, Artificial Sequence; identical to SEQ ID NO: 150016
  Description of Artificial Sequence: Synthetic coding sequence

SEQ ID NO: 150018 - DNA, 858 bp, Artificial Sequence; identical to SEQ ID NO: 150009
  Description of Artificial Sequence: Synthetic coding sequence

SEQ ID NO: 150019 - DNA, 858 bp, Artificial Sequence; identical to SEQ ID NO: 150009
  Description of Artificial Sequence: Synthetic coding sequence

SEQ ID NO: 150020 - DNA, 858 bp, Artificial Sequence; identical to SEQ ID NO: 150009
  Description of Artificial Sequence: Synthetic coding sequence

SEQ ID NO: 150021 - DNA, 711 bp, Artificial Sequence
  Description of Artificial Sequence: Synthetic coding sequence
atgggcaccccaggagagggcctgggccgctgcagccacgccctgatccggggcgtgcctgagagcctggccagcggggagggcgctggggccggcctgcctgccctggacctggccaaggcccagcgggagcacggcgtgctgggcggcaagctgcggcagaggctgggcctgcagctgctggagctgcccccagaggagagcctgcccctgggccccctgctgggggacacagctgtgatccagggcgacacagccctgatcacccggccctggagccctgcccggcggcctgaggtggatggagtgaggaaggccctgcaggacctgggcctgcgcatcgtggagattggagatgaaaatgccaccctggatggaacagatgtgctcttcaccggccgggagttctttgtgggcctgagcaagtggaccaaccacagaggagctgagatcgtggccgacaccttccgggactttgctgtgtccacagtgcctgtgtctggccccagccacctgcggggcctgtgtggcatgggcggccccaggacagtggtggccggcagcagtgatgctgcccagaaggctgtgcgggccatggctgtgctgacagaccacccctatgccagcctgaccctgcctgatgatgctgctgctgactgcctcttcctgcggcccggcctgcccggggtgccccccttcctgctgcactag

SEQ ID NO: 150022 - DNA, 681 bp, Artificial Sequence
  Description of Artificial Sequence: Synthetic coding sequence
atgggcaccccaggagagggcctgggccgctgcagccacgccctgatccggggcgtgcctgagagcctggccagcggggagggcgctggggccggcctgcctgccctggacctggccaaggcccagcgggagcacggcgtgctgggcggcaagctgcggcagaggctgggcctgcagctgctggagctgcccccagaggagagcctgcccctgggccccctgctgggggacacagctgtgatccagggcgacacagccctgatcacccggccctggagccctgcccggcggcctgaggtggatggagtgaggaaggccctgcaggacctgggcctgcgcatcgtggagattggagatgaaaatgccaccctggatggaacagatgtgctcttcaccggccgggagttctttgtgggcctgagcaagtggaccaaccacagaggagctgagatcgtggccgacaccttccgggactttgctgtgtccacagtgcctgtgtctggccccagccacctgcggggcctgtgtggcatgggcggccccaggacagtggtggccggcagcagtgatgctgcccagaaggctgtgcgggccatggctgtgctgacagaccacccctatgccagcctgaccctgcctgatgatgctgctgctgactgcctcttcctgcggcctggatag

SEQ ID NO: 150023 - DNA, 711 bp, Artificial Sequence; identical to SEQ ID NO: 150021
  Description of Artificial Sequence: Synthetic coding sequence

SEQ ID NO: 150024 - DNA, 858 bp, Artificial Sequence; identical to SEQ ID NO: 150009
  Description of Artificial Sequence: Synthetic coding sequence

SEQ ID NO: 150025 - DNA, 858 bp, Artificial Sequence; identical to SEQ ID NO: 150009
  Description of Artificial Sequence: Synthetic coding sequence

SEQ ID NO: 150026 - DNA, 858 bp, Artificial Sequence; identical to SEQ ID NO: 150009
  Description of Artificial Sequence: Synthetic coding sequence

SEQ ID NO: 150027 - DNA, 681 bp, Artificial Sequence; identical to SEQ ID NO: 150022
  Description of Artificial Sequence: Synthetic coding sequence

SEQ ID NO: 150028 - DNA, 858 bp, Artificial Sequence; identical to SEQ ID NO: 150009
  Description of Artificial Sequence: Synthetic coding sequence

SEQ ID NO: 150029 - DNA, 681 bp, Artificial Sequence; identical to SEQ ID NO: 150022
  Description of Artificial Sequence: Synthetic coding sequence

SEQ ID NO: 150030 - DNA, 681 bp, Artificial Sequence; identical to SEQ ID NO: 150022
  Description of Artificial Sequence: Synthetic coding sequence

SEQ ID NO: 150031 - DNA, 858 bp, Artificial Sequence; identical to SEQ ID NO: 150009
  Description of Artificial Sequence: Synthetic coding sequence

SEQ ID NO: 150032 - DNA, 681 bp, Artificial Sequence; identical to SEQ ID NO: 150022
  Description of Artificial Sequence: Synthetic coding sequence

SEQ ID NO: 150033 - DNA, 567 bp, Artificial Sequence; identical to SEQ ID NO: 150016
  Description of Artificial Sequence: Synthetic coding sequence

SEQ ID NO: 150034 - DNA, 567 bp, Artificial Sequence; identical to SEQ ID NO: 150016
  Description of Artificial Sequence: Synthetic coding sequence

SEQ ID NO: 150035 - DNA, 681 bp, Artificial Sequence; identical to SEQ ID NO: 150022
  Description of Artificial Sequence: Synthetic coding sequence

SEQ ID NO: 150036 - DNA, 858 bp, Artificial Sequence; identical to SEQ ID NO: 150009
  Description of Artificial Sequence: Synthetic coding sequence

SEQ ID NO: 150037 - DNA, 711 bp, Artificial Sequence; identical to SEQ ID NO: 150021
  Description of Artificial Sequence: Synthetic coding sequence

SEQ ID NO: 150038 - DNA, 711 bp, Artificial Sequence; identical to SEQ ID NO: 150021
  Description of Artificial Sequence: Synthetic coding sequence

SEQ ID NO: 150039 - DNA, 858 bp, Artificial Sequence; identical to SEQ ID NO: 150009
  Description of Artificial Sequence: Synthetic coding sequence

SEQ ID NO: 150040 - DNA, 678 bp, Artificial Sequence
  Description of Artificial Sequence: Synthetic coding sequence
atgggcaccccaggagagggcctgggccgctgcagccacgccctgatccggggcgtgcctgagagcctggccagcggggagggcgctggggccggcctgcctgccctggacctggccaaggcccagcgggagcacggcgtgctgggcggcaagctgcggcagaggctgggcctgcagctgctggagctgcccccagaggagagcctgcccctgggccccctgctgggggacacagctgtgatccagggcgacacagccctgatcacccggccctggagccctgcccggcggcctgaggtggatggagtgaggaaggccctgcaggacctgggcctgcgcatcgtggagattggagatgaaaatgccaccctggatggaacagatgtgctcttcaccggccgggagttctttgtgggcctgagcaagtggaccaaccacagaggagctgagatcgtggccgacaccttccgggactttgctgtgtccacagtgcctgtgtctggccccagccacctgcggggcctgtgtggcatgggcggccccaggacagtggtggccggcagcagtgatgctgcccagaaggctgtgcgggccatggctgtgctgacagaccacccctatgccagcctgaccctgcctgatgatgctgctgctgactgcctcttcctgcggccctag

SEQ ID NO: 150041 - DNA, 858 bp, Artificial Sequence; identical to SEQ ID NO: 150009
  Description of Artificial Sequence: Synthetic coding sequence

SEQ ID NO: 150042 - DNA, 567 bp, Artificial Sequence; identical to SEQ ID NO: 150016
  Description of Artificial Sequence: Synthetic coding sequence

SEQ ID NO: 150043 - DNA, 567 bp, Artificial Sequence; identical to SEQ ID NO: 150016
  Description of Artificial Sequence: Synthetic coding sequence

SEQ ID NO: 150044 - DNA, 858 bp, Artificial Sequence; identical to SEQ ID NO: 150009
  Description of Artificial Sequence: Synthetic coding sequence

SEQ ID NO: 150045 - DNA, 711 bp, Artificial Sequence; identical to SEQ ID NO: 150021
  Description of Artificial Sequence: Synthetic coding sequence

SEQ ID NO: 150046 - DNA, 567 bp, Artificial Sequence; identical to SEQ ID NO: 150016
  Description of Artificial Sequence: Synthetic coding sequence

SEQ ID NO: 150047 - DNA, 858 bp, Artificial Sequence; identical to SEQ ID NO: 150009
  Description of Artificial Sequence: Synthetic coding sequence

SEQ ID NO: 150048 - DNA, 858 bp, Artificial Sequence; identical to SEQ ID NO: 150009
  Description of Artificial Sequence: Synthetic coding sequence

SEQ ID NO: 150049 - DNA, 711 bp, Artificial Sequence; identical to SEQ ID NO: 150021
  Description of Artificial Sequence: Synthetic coding sequence

SEQ ID NO: 150050 - DNA, 711 bp, Artificial Sequence; identical to SEQ ID NO: 150021
  Description of Artificial Sequence: Synthetic coding sequence

SEQ ID NO: 150051 - DNA, 2601 bp, Artificial Sequence
  Description of Artificial Sequence: Synthetic coding sequence
atgctgcggcctggggcccagctgctgcggggcctgctgctgcggagctgccccctgcagggcagccctggccggcccaggtctgtgtgtggccgggagggggaggagaagccacccctgtctgctgagacccagtggaaggacagagctgagaccgtcatcattggaggcggctgtgtgggcgtgtccctggcctaccacctggccaaggccggcatgaaggatgtggtgctgctggagaagtctgagctgacagctggcagcacctggcacgccgccggcctgaccacctacttccaccctggcatcaacctgaagaagatccactatgacagcatcaagctgtatgagaagctggaggaggagaccggccaggtggtgggcttccaccagcccggcagcatccggctggccaccacccctgtgcgggtggatgagttcaagtaccagatgaccaggacaggctggcacgccacagagcagtacctgattgagcctgagaagatccaggagatgttccccctgctgaacatgaacaaggtgctggccggcctgtacaaccctggagatggccacatcgacccctacagcctgaccatggccctggccgccggggccaggaaatgtggggccctgctgaagtacccagcccctgtgaccagcctgaaggcccggagtgatggcacctgggatgtggagaccccccagggctccatgagggccaaccgcatcgtgaatgctgctggcttctgggcccgggaggtgggcaagatgattggcctggagcaccccctcatccctgtgcagcaccagtatgtggtgaccagcaccatcagcgaggtgaaggccctgaagcgggagctgcctgtgctgcgggacctggagggcagctactacctgcggcaggagagagatggcctgctgtttggcccctatgagagccaggagaagatgaaggtgcaggacagctgggtgaccaatggagtgcccccaggctttgggaaggagctgtttgaaagtgacctggaccgcatcatggagcacatcaaggccgccatggagatggtgcctgtgctgaagaaggctgacatcatcaacgtggtgaatggccccatcacctacagcccagacatcctgcccatggtgggcccccaccagggcgtgaggaactactgggtggccatcggcttcggctacggcatcatccacgccggcggcgtgggcaagtacctgagtgactggatcctgcatggagagcccccatttgacctgattgagctggaccccaacagatatggcaagtggaccaccacccagtacacagaggccaaggcccgggagagctatggcttcaacaacatcgtgggctaccccaaggaggagagatttgctggccggcccacccagagggtgtctggcctgtaccagaggctggagagcaaatgttccatgggcttccacgccggctgggagcagccccactggttctacaagccaggccaggacacccagtaccggcccagcttccggaggaccaactggtttgagcctgtgggcagcgagtacaagcaggtgatgcagagggtggccgtgacagacctgagcccctttgggaagttcaacatcaagggccaggacagcatccggctgctggaccacctgtttgccaacgtcatccccaaggtgggcttcaccaacatcagccacatgctgacccccaagggccgggtgtatgcagagctgactgtgagccaccagagccctggagagttcctgctgatcactggaagtggcagcgagctgcatgacctgcgctggattgaggaggaggccgtgaagggcggctatgatgtggagatcaagaacatcacagatgagctgggcgtgctgggcgtggccggcccccaggccaggaaggtgctgcagaagctgaccagcgaggacctgagtgatgatgtgttcaagttcctgcagaccaagagcctgaaggtgagcaacatccctgtgacagccatccgcatctcctacacaggagagctgggctgggagctgtaccacagaagagaagattctgtggccctgtatgatgccatcatgaatgccggccaggaggagggcatcgacaactttggcacctacgccatgaatgccctgcggctggagaaggccttccgggcctggggcctggagatgaactgtgacaccaaccccctggaggccggcctggagtactttgtgaagctgaacaagccagctgacttcatcggcaagcaggccctgaagcagatcaaggccaagggcctgaagaggcggctggtgtgcctgaccctggccacagatgatgtggaccctgagggcaatgaaagcatctggtacaacgggaaggtggtgggcaacaccaccagcggcagctacagctacagcatccagaagagcctggcctttgcctacgtgcctgtgcagctgtctgaggtgggccagcaggtggaggtggagctgctgggcaagaactacccagctgtgatcatccaggagcccctggtgctgacagagcccaccaggaaccggctgcagaagaagggcggcaaggacaagacctag

SEQ ID NO: 150052 - DNA, 1722 bp, Artificial Sequence
  Description of Artificial Sequence: Synthetic coding sequence
atggagcggcagagcaggaacagcgacaactggcgctggctgtgctggtgtgagagcggcctgagccctggccagagcagagatgagcgctgtggccctgctggggagatccgggcccacggctggatctacctggcccggcgcttctgggcccgggaggtgggcaagatgattggcctggagcaccccctcatccctgtgcagcaccagtatgtggtgaccagcaccatcagcgaggtgaaggccctgaagcgggagctgcctgtgctgcgggacctggagggcagctactacctgcggcaggagagagatggcctgctgtttggcccctatgagagccaggagaagatgaaggtgcaggacagctgggtgaccaacggggtgcccccaggctttgggaaggagctgtttgaaagtgacctggaccgcatcatggagcacatcaaggccgccatggagatggtgcctgtgctgaagaaggctgacatcatcaacgtggtgaatggccccatcacctacagcccagacatcctgcccatggtgggcccccaccagggcgtgaggaactactgggtggccatcggcttcggctacggcatcatccatgctggaggagtgggcaagtacctgagtgactggatcctgcacggggagcccccatttgacctgattgagctggaccccaacagatatggcaagtggaccaccacccagtacacagaggccaaggcccgggagagctatggcttcaacaacatcgtgggctaccccaaggaggagagatttgctggccggcccacccagagggtgtctggcctgtaccagaggctggagagcaagtgcagcatgggcttccacgccggctgggagcagccccactggttctacaagccaggccaggacacccagtaccggcccagcttccggaggaccaactggtttgagcctgtgggcagcgagtacaagcaggtgatgcagagggtggccgtgacagacctgagcccctttgggaagttcaacatcaagggccaggacagcatccggctgctggaccacctgtttgccaacgtcatccccaaggtgggcttcaccaacatcagccacatgctgacccccaagggccgggtgtatgcagagctgactgtgagccaccagagccctggagagttcctgctgatcaccggcagcggcagcgagctgcatgacctgcgctggattgaggaggaggccgtgaagggcggctatgatgtggagatcaagaacatcacagatgagctgggcgtgctgggcgtggccggcccccaggccaggaaggtgctgcagaagctgaccagcgaggacctgagtgatgatgtgttcaagttcctgcagaccaagagcctgaaggtgagcaacatccctgtgacagccatccgcatctcctacaccggggagctgggctgggagctgtaccaccggcgggaggacagcgtggccctgtatgatgccatcatgaatgccggccaggaggagggcatcgacaactttggcacctacgccatgaatgccctgcggctggagaaggccttccgggcctggggcctggagatgaactgtgacaccaaccccctggaggccggcctggagtactttgtgaagctgaacaaggaccagaacagctgctttgcccacttcaaggaggagaatggctgggtgagccgctgggccatccggccctactag

SEQ ID NO: 150053 - DNA, 1842 bp, Artificial Sequence
  Description of Artificial Sequence: Synthetic coding sequence
tacctgattgagcctgagaagatccaggagatgttccccctgctgaacatgaacaaggtgctggccggcctgtacaaccctggagatggccacatcgacccctacagcctgaccatggccctggccgccggggccaggaaatgtggggccctgctgaagtacccagcccctgtgaccagcctgaaggcccggagtgatggcacctgggatgtggagaccccccagggctccatgagggccaacagaattgtgaatgctgctggcttctgggcccgggaggtgggcaagatgattggcctggagcaccccctcatccctgtgcagcaccagtatgtggtgaccagcaccatcagcgaggtgaaggccctgaagcgggagctgcctgtgctgcgggacctggagggcagctactacctgcggcaggagagagatggcctgctgtttggcccctatgagagccaggagaagatgaaggtgcaggacagctgggtgaccaacggggtgcccccaggctttgggaaggagctgtttgaaagtgacctggaccgcatcatggagcacatcaaggccgccatggagatggtgcctgtgctgaagaaggctgacatcatcaacgtggtgaatggccccatcacctacagcccagacatcctgcccatggtgggcccccaccagggcgtgaggaactactgggtggccatcggcttcggctacggcatcatccatgctggaggagtgggcaagtacctgagtgactggatcctgcacggggagcccccatttgacctgattgagctggaccccaacagatatggcaagtggaccaccacccagtacacagaggccaaggcccgggagagctatggcttcaacaacatcgtgggctaccccaaggaggagagatttgctggccggcccacccagagggtgtctggcctgtaccagaggctggagagcaagtgcagcatgggcttccacgccggctgggagcagccccactggttctacaagccaggccaggacacccagtaccggcccagcttccggaggaccaactggtttgagcctgtgggcagcgagtacaagcaggtgatgcagagggtggccgtgacagacctgagcccctttgggaagttcaacatcaagggccaggacagcatccggctgctggaccacctgtttgccaacgtcatccccaaggtgggcttcaccaacatcagccacatgctgacccccaagggccgggtgtatgcagagctgactgtgagccaccagagccctggagagttcctgctgatcaccggcagcggcagcgagctgcatgacctgcgctggattgaggaggaggccgtgaagggcggctatgatgtggagatcaagaacatcacagatgagctgggcgtgctgggcgtggccggcccccaggccaggaaggtgctgcagaagctgaccagcgaggacctgagtgatgatgtgttcaagttcctgcagaccaagagcctgaaggtgagcaacatccctgtgacagccatccgcatctcctacaccggggagctgggctgggagctgtaccaccggcgggaggacagcgtggccctgtatgatgccatcatgaatgccggccaggaggagggcatcgacaactttggcacctacgccatgaatgccctgcggctggagaaggccttccgggcctggggcctggagatgaactgtgacaccaaccccctggaggccggcctggagtactttgtgaagctgaacaaggaccagaacagctgctttgcccacttcaaggaggagaatggctgggtgagccgctgggccatccggccctactag

SEQ ID NO: 150054 - DNA, 1875 bp, Artificial Sequence
  Description of Artificial Sequence: Synthetic coding sequence
atgaccaggacaggctggcacgccacagagcagtacctgattgagcctgagaagatccaggagatgttccccctgctgaacatgaacaaggtgctggccggcctgtacaaccctggagatggccacatcgacccctacagcctgaccatggccctggccgccggggccaggaaatgtggggccctgctgaagtacccagcccctgtgaccagcctgaaggcccggagtgatggcacctgggatgtggagaccccccagggctccatgagggccaaccgcatcgtgaatgctgctggcttctgggcccgggaggtgggcaagatgattggcctggagcaccccctcatccctgtgcagcaccagtatgtggtgaccagcaccatcagcgaggtgaaggccctgaagcgggagctgcctgtgctgcgggacctggagggcagctactacctgcggcaggagagagatggcctgctgtttggcccctatgagagccaggagaagatgaaggtgcaggacagctgggtgaccaatggagtgcccccaggctttgggaaggagctgtttgaaagtgacctggaccgcatcatggagcacatcaaggccgccatggagatggtgcctgtgctgaagaaggctgacatcatcaacgtggtgaatggccccatcacctacagcccagacatcctgcccatggtgggcccccaccagggcgtgaggaactactgggtggccatcggcttcggctacggcatcatccacgccggcggcgtgggcaagtacctgagtgactggatcctgcatggagagcccccatttgacctgattgagctggaccccaacagatatggcaagtggaccaccacccagtacacagaggccaaggcccgggagagctatggcttcaacaacatcgtgggctaccccaaggaggagagatttgctggccggcccacccagagggtgtctggcctgtaccagaggctggagagcaaatgttccatgggcttccacgccggctgggagcagccccactggttctacaagccaggccaggacacccagtaccggcccagcttccggaggaccaactggtttgagcctgtgggcagcgagtacaagcaggtgatgcagagggtggccgtgacagacctgagcccctttgggaagttcaacatcaagggccaggacagcatccggctgctggaccacctgtttgccaacgtcatccccaaggtgggcttcaccaacatcagccacatgctgacccccaagggccgggtgtatgcagagctgactgtgagccaccagagccctggagagttcctgctgatcactggaagtggcagcgagctgcatgacctgcgctggattgaggaggaggccgtgaagggcggctatgatgtggagatcaagaacatcacagatgagctgggcgtgctgggcgtggccggcccccaggccaggaaggtgctgcagaagctgaccagcgaggacctgagtgatgatgtgttcaagttcctgcagaccaagagcctgaaggtgagcaacatccctgtgacagccatccgcatctcctacacaggagagctgggctgggagctgtaccacagaagagaagattctgtggccctgtatgatgccatcatgaatgccggccaggaggagggcatcgacaactttggcacctacgccatgaatgccctgcggctggagaaggccttccgggcctggggcctggagatgaactgtgacaccaaccccctggaggccggcctggagtactttgtgaagctgaacaaggaccagaacagctgctttgcccacttcaaggaggagaatggctgggtgagccgctgggccatccggccctactag

SEQ ID NO: 150055 - DNA, 1185 bp, Artificial Sequence
  Description of Artificial Sequence: Synthetic coding sequence
atgtggagctgctggaggaaccagagcagccggctggacctgcccggcacccagtatggcatcatccacgccggcggcgtgggcaagtacctgagtgactggatcctgcatggagagcccccatttgacctgattgagctggaccccaacagatatggcaagtggaccaccacccagtacacagaggccaaggcccgggagagctatggcttcaacaacatcgtgggctaccccaaggaggagagatttgctggccggcccacccagagggtgtctggcctgtaccagaggctggagagcaaatgttccatgggcttccacgccggctgggagcagccccactggttctacaagccaggccaggacacccagtaccggcccagcttccggaggaccaactggtttgagcctgtgggcagcgagtacaagcaggtgatgcagagggtggccgtgacagacctgagcccctttgggaagttcaacatcaagggccaggacagcatccggctgctggaccacctgtttgccaacgtcatccccaaggtgggcttcaccaacatcagccacatgctgacccccaagggccgggtgtatgcagagctgactgtgagccaccagagccctggagagttcctgctgatcactggaagtggcagcgagctgcatgacctgcgctggattgaggaggaggccgtgaagggcggctatgatgtggagatcaagaacatcacagatgagctgggcgtgctgggcgtggccggcccccaggccaggaaggtgctgcagaagctgaccagcgaggacctgagtgatgatgtgttcaagttcctgcagaccaagagcctgaaggtgagcaacatccctgtgacagccatccgcatctcctacacaggagagctgggctgggagctgtaccacagaagagaagattctgtggccctgtatgatgccatcatgaatgccggccaggaggagggcatcgacaactttggcacctacgccatgaatgccctgcggctggagaaggccttccgggcctggggcctggagatgaactgtgacaccaaccccctggaggccggcctggagtactttgtgaagctgaacaaggaccagaacagctgctttgcccacttcaaggaggagaatggctgggtgagccgctgggccatccggccctactag

SEQ ID NO: 150056 - DNA, 4731 bp, Artificial Sequence
  Description of Artificial Sequence: Synthetic coding sequence
atggccgagcggggcctggagcccagccctgctgctgtggccgccctgcccccagaggtgcgggcccagctggccgagctggagctggagctgtctgagggggacatcacccagaagggctatgagaagaagaggagcaagctgctgagcccctacagcccccagacccaggagacagattctgctgtgcagaaggagctgaggaaccagaccccagcccccagcgctgcccagaccagcgcccccagcaagtaccacaggaccaggtctgggggcgccagagatgagcgctacagaagtgacatccacacagaggccgtgcaggccgccctggccaagcacaaggagcagaagatggccctgcccatgcccaccaagagaagaagcacctttgtgcagagccctgcagatgcctgcaccccaccagacaccagcagcgcctctgaagatgagggcagcctgcggcggcaggccgccctgtctgctgccctgcagcagagcctgcagaatgctgagagctggatcaacagaagcatccagggcagcagcaccagcagcagcgccagcagcaccctgagccacggggaggtgaagggcaccagcggcagcctggctgatgtgtttgccaacaccagaattgagaacttcagcgcccccccagatgtgaccaccaccaccagcagcagcagcagcagcagcagcatccggcctgccaacatcgacctgcccccatctggaattgtgaagggcatgcacaagggcagcaacagaagcagcctgatggacacagcagatggagtgcctgtgagcagccgggtgtccaccaagatccagcagctgctgaacaccctgaagaggcccaagaggcctcccctgaaggagttctttgtggatgacagcgaggagatcgtggaggtgccccagcctgaccccaaccagcccaagccagagggccggcagatgacccctgtgaagggggagcccctgggcgtcatctgcaactggcccccagccctggagagcgccctgcagcgctggggcaccacccaggccaagtgcagctgcctgacagccctggacatgaccgggaagcctgtgtacaccctgacctacggcaagctgtggagccgcagcctgaagctggcctacaccctgctgaacaagctgggcaccaagaatgaacctgtgctgaagccaggggacagagtggccctggtgtaccccaacaatgaccctgtgatgttcatggtggccttctacggctgcctgctggccgaggtgattcctgtgcccatcgaggtgcccctgaccaggaaggatgctgggggccagcagatcggcttcctgctgggcagctgtggcatcgccctggccctgaccagcgaggtgtgcctgaagggcctgcccaagacccagaatggagagatcgtgcagttcaagggctggccccggctgaagtgggtggtgacagacagcaagtacctgagcaagccacccaaggactggcagccccacatcagccctgctggaacagagcccgcctacatcgagtacaagaccagcaaggagggctctgtgatgggcgtgacagtgtcccggctggccatgctgagccactgccaggccctgagccaggcctgcaactacagcgagggggagaccatcgtgaatgtgctggacttcaagaaggatgctggcctgtggcacggcatgtttgccaacgtgatgaacaagatgcacaccatctctgtgccctacagcgtgatgaagacctgccccctgtcctgggtgcagagggtgcacgcccacaaggccaaggtggccctggtgaagtgccgggacctgcactgggccatgatggcccaccgggaccagagagatgtgtccctgagcagcctgaggatgctgattgtgacagatggagccaacccctggagcgtgagcagctgtgatgccttcctgagcctcttccagagccacggcctgaagccagaggccatctgcccctgtgccaccagcgctgaggccatgacagtggccatccggcggcctggggtgcctggggcccccctgcccggccgggccatcctgtccatgaatggcctgtcctatggagtcatccgggtgaacacagaggacaagaacagcgccctgactgtgcaggatgtgggccacgtgatgcctgggggcatgatgtgcatcgtgaagccagatggccccccccagctgtgcaagacagatgaaattggagagatctgtgtgagcagcaggactggaggcatgatgtacttcggcctggccggcgtgaccaagaacacctttgaggtgattcctgtgaacagcgctggcagccctgtgggagatgtgcccttcatccgcagcggcctgctgggctttgtgggccctggcagcctggtgtttgtggtgggcaagatggatggcctgctgatggtgtctggaagaagacacaatgctgatgacatcgtggccaccggcctggccgtggagagcatcaagacagtgtaccggggcagaattgctgtgttttctgtgtctgtgttctatgatgaaagaattgtggtggtggccgagcagaggccagatgccagcgaggaggacagcttccagtggatgagccgggtgctgcaggccatcgacagcatccaccaggtgggcgtgtactgcctggccctggtgcctgccaacaccctgcccaagacccccctgggcggcatccacatcagccagaccaagcagctgttcctggagggcagcctgcacccctgcaacatcctgatgtgcccccacacctgtgtgaccaacctgcccaagccccggcagaagcagcccggggtgggccctgcctctgtgatggtgggcaacctggtggccggcaagagaattgcccaggccgccggccgggacctgggccagattgaagaaaatgacctggtgaggaagcaccagttcctggccgagatcctgcagtggagggcccaggccaccccagaccacgtgctcttcatgctgctgaatgccaagggcaccaccgtgtgcacagccagctgcctgcagctgcacaagagagctgagagaattgcctctgtgctgggggacaagggccacctgaatgctggggacaacgtggtgctgctgtacccacctggcatcgagctgattgctgccttctacggctgcctgtatgccggctgcatccctgtgacagtgcggcccccccacgcccagaacctgacagccaccctgcccaccgtgaggatgattgtggatgtgtccaaggccgcctgcatcctgaccagccagaccctgatgaggctgctgcggagccgggaggccgctgctgctgtggatgtgaagacctggcccaccatcatcgacacagatgacctgcccaggaagaggctgccccagctgtacaagccacccaccccagagatgctggcctacctggacttctctgtgtccaccaccggcatgctgactggagtgaagatgagccacagcgctgtgaatgccctgtgccgggccatcaagctgcagtgtgagctgtacagcagccggcagatcgccatctgcctggacccctactgcggcctgggctttgccctgtggtgcctgtgcagcgtgtacagcggccaccagagcgtgctgatcccccccatggagctggagaacaacctcttcctgtggctgagcacagtgaaccagtacaagatccgggacaccttctgcagctacagcgtgatggagctgtgcaccaagggcctgggcaaccaggtggaggtgctgaagacccggggcatcaacctgagctgtgtgaggacctgtgtggtggtggccgaggagcggccccgggtggccctgcagcagagcttcagcaagctgttcaaggacatcggcctgagccccagggctgtgtccaccaccttcggcagccgggtgaatgtggccatctgcctgcagggcaccagcggccctgaccccaccaccgtgtatgtggacctgaagagcctgcggcatgacagagtgcggctggtggagcggggggccccccagagcctgctgctgtctgagagcggcaagatcctgcccggggtgaaggtggtgattgtgaaccctgagaccaagggccctgtgggggacagccacctgggggagatctgggtgaacagcccccacacagccagcggctactacaccatctatgacagcgagaccctgcaggccgaccacttcaacacccggctgagctttggagatgctgcccagaccctgtgggccaggacaggctacctgggctttgtgcggaggacagagctgacagctgccaccggggagagacatgatgccctgtatgtggtgggcgccctggatgagaccctggagctgcggggcctgcgctaccaccccattgatattgagacctctgtgagccgcatccacaggagcattgctgaatgtgctgtgttcacctggaccaacctgctggtggtggtggtggagctgtgtggcagcgagcaggaggccctggacctggtgcccctggtgaccaacgtggtgctggaggagcactacctgattgtgggcgtggtggtggtggtggaccccggggtcatccccatcaacagcagaggagagaagcagaggatgcacctgcgggacagcttcctggccgaccagctggaccccatctacgtggcctacaacatgtag

SEQ ID NO: 150057 - DNA, 1179 bp, Artificial Sequence
  Description of Artificial Sequence: Synthetic coding sequence
atggccgagcggggcctggagcccagccctgctgctgtggccgccctgcccccagaggtgcgggcccagctggccgagctggagctggagctgtctgagggggacatcacccagaagggctatgagaagaagaggagcaagctgctgagcccctacagcccccagacccaggagacagattctgctgtgcagaaggagctgaggaaccagaccccagcccccagcgctgcccagaccagcgcccccagcaagtaccacaggaccaggtctgggggcgccagagatgagcgctacagaagtgagttcagcctggtgcgcatctacagcgaggacatccacacagaggccgtgcaggccgccctggccaagcacaaggagcagaagatggccctgcccatgcccaccaagagaagaagcacctttgtgcagagccctgcagatgcctgcaccccaccagacaccagcagcgcctctgaagatgagggcagcctgcggcggcaggccgccctgtctgctgccctgcagcagagcctgcagaatgctgagagctggatcaacagaagcatccagggcagcagcaccagcagcagcgccagcagcaccctgagccacggggaggtgaagggcaccagcggcagcctggctgatgtgtttgccaacaccagaattgagaacttcagcgcccccccagatgtgaccaccaccaccagcagcagcagcagcagcagcagcatccggcctgccaacatcgacctgcccccatctggaattgtgaagggcatgcacaagggcagcaacagaagcagcctgatggacacagcagatggagtgcctgtgagcagccgggtgtccaccaagatccagcagctgctgaacaccctgaagaggcccaagaggcctcccctgaaggagttctttgtggatgacagcgaggagatcgtggaggtgccccagcctgaccccaaccagcccaagccagagggccggcagatgacccctgtgaagggggagcccctgggcgtcatctgcaactggcccccagccctggagagcgccctgcagcgctggggcaccacccaggccaagtgcagctgcctgacagccctggacatgaccgggaagcctgtgtacaccctgacctatggagagagcgcccgcttccagatcctgctgtcctag

SEQ ID NO: 150058 - DNA, 4671 bp, Artificial Sequence
  Description of Artificial Sequence: Synthetic coding sequence
atggctgacaggagcctggagggcatggccctgcccctggaggtgcgggcccggctggccgagctggagctggagctgtctgagggggacatcacccagaagggctatgagaagaagaggagcaagctgattggagcctacctgccccagcccccccgggtggaccaggccctgccccaggagcggcgggcccctgtgacccccagcagcgccagccgctaccacagaagaagaagcagcggcagcagagatgagcgctacagaagtgatgtgcacacagaagctgtgcaggccgccctggccaagcacaaggagaggaagatggctgtgcccatgcccagcaagaggaggagcctggtggtgcagacctccatggatgcctacaccccaccagacaccagcagcggctctgaagatgagggctctgtgcagggcgacagccagggcacccccaccagcagccagggcagcatcaacatggagcactggatcagccaggccatccacggcagcaccaccagcaccaccagcagcagcagcacccagagcggcggcagcggggccgcccaccggctggctgatgtgatggcccagacccacatcgagaaccacagcgcccccccagatgtgaccacctacaccagcgagcacagcatccaggtggagcggccccagggcagcacaggcagcaggacagcccccaagtatggaaatgctgagctgatggagactggagatggagtgcctgtgagcagccgggtgtctgccaagatccagcagctggtgaacaccctgaagaggcccaagaggcctcccctgcgggagttctttgtggatgactttgaggagctgctggaggtgcagcagcctgaccccaaccagcccaagccagagggcgcccagatgctggccatgagaggagagcagctgggcgtggtgaccaactggccacccagcctggaggccgccctgcagcgctggggcaccatcagccccaaggccccctgcctgaccaccatggacaccaacgggaagcccctgtacatcctgacctacggcaagctgtggaccaggtccatgaaggtggcctacagcatcctgcacaagctgggcaccaagcaggagcccatggtgcggcctggggacagagtggccctggtgttccccaacaatgaccctgctgccttcatggccgccttctacggctgcctgctggccgaggtggtgcctgtgcccatcgaggtgcccctgaccaggaaggatgctggcagccagcagatcggcttcctgctgggcagctgtggggtgacagtggccctgaccagtgatgcctgccacaagggcctgcccaagagccccaccggggagatcccccagttcaagggctggcccaagctgctgtggtttgtgacagagagcaagcacctgagcaagccaccccgggactggttcccccacatcaaggatgccaacaatgacacagcctacatcgagtacaagacctgcaaggatggctctgtgctgggcgtgacagtgaccaggacagccctgctgacccactgccaggccctgacccaggcctgtggctacacagaagctgagaccatcgtgaatgtgctggacttcaagaaggatgtgggcctgtggcacggcatcctgacctctgtgatgaacatgatgcacgtgatcagcatcccctacagcctgatgaaggtgaaccccctgtcctggatccagaaggtgtgccagtacaaggccaaggtggcctgtgtgaagagccgggacatgcactgggccctggtggcccaccgggaccagagggacatcaacctgagcagcctgaggatgctgattgtggctgatggagccaacccctggagcatcagcagctgtgatgccttcctgaatgtgttccagagcaagggcctgcggcaggaggtgatctgcccctgtgccagcagccctgaggccctgactgtggccatcagaagacccacagatgacagcaaccagcccccaggccggggcgtgctgtccatgcacggcctgacctatggagtcatccgggtggacagcgaggagaagctgtctgtgctgactgtgcaggatgtgggcctggtgatgcctggggccatcatgtgcagcgtgaagccagatggagtgccccagctgtgcaggacagatgagatcggggagctgtgtgtgtgtgctgtggccaccggcaccagctactacggcctgagcggcatgaccaagaacacctttgaggtgttccccatgaccagcagcggggcccccatcagcgagtaccccttcatcagaacaggcctgctgggctttgtgggccctgggggcctggtgtttgtggtgggcaagatggatggcctgatggtggtgtctggccgccgccacaatgctgatgacatcgtggccacagccctggccgtggagcccatgaagtttgtgtaccggggcagaattgctgtgttttctgtgacagtgctgcatgatgagcgcatcgtcatcgtggccgagcagaggccagacagcacagaagaagattccttccagtggatgagccgggtgctgcaggccatcgacagcatccaccaggtgggcgtgtactgcctggccctggtgcctgccaacaccctgcccaagacccccctgggcggcatccacctgtctgagaccaagcagctgttcctggagggcagcctgcacccctgcaatgtgctgatgtgcccccacacctgtgtgaccaacctgcccaagccccggcagaagcagcctgagatcggccctgcctctgtgatggtgggcaacctggtgtctgggaagagaattgcccaggccagcggccgggacctgggccagattgaagataatgaccaggccaggaagttcctgttcctgtctgaggtgctgcagtggagggcccagaccaccccagaccacatcctgtacaccctgctgaactgccgcggggccatcgccaacagcctgacctgtgtgcagctgcacaagagagctgagaagattgctgtgatgctgatggagcggggccacctgcaggatggagaccacgtggccctggtgtacccacctggcatcgacctgattgctgccttctacggctgcctgtatgccggctgtgtgcccatcaccgtgcggcccccccacccccagaacatcgccaccaccctgcccaccgtgaagatgattgtggaggtgagccgcagcgcctgcctgatgaccacccagctgatctgcaagctgctgcggagccgggaggccgctgctgctgtggatgtgaggacctggcccctcatcctggacacagatgacctgcccaagaagaggcctgcccagatctgcaagccctgcaacccagacaccctggcctacctggacttctctgtgtccaccaccggcatgctggccggcgtgaagatgagccatgctgccaccagcgccttctgccgcagcatcaagctgcagtgtgagctgtaccccagccgggaggtggccatctgcctggacccctactgcggcctgggctttgtgctgtggtgcctgtgcagcgtgtacagcggccaccagagcatcctgatcccccccagcgagctggagaccaacccagccctgtggctgctggccgtgtcccagtacaaggtgcgggacaccttctgcagctacagcgtgatggagctgtgcaccaagggcctgggcagccagacagagagcctgaaggcccggggcctggacctgagccgggtgaggacctgtgtggtggtggccgaggagcggcccagaattgccctgacccagagcttcagcaagctgttcaaggacctgggcctgcaccccagggctgtgtccaccagctttggctgccgggtgaacctggccatctgcctgcagggcaccagcggccctgaccccaccaccgtgtatgtggacatgagggccctgcggcatgacagagtgcggctggtggagcggggcagcccccacagcctgcccctgatggagagcggcaagatcctgcccggggtgcgcatcatcatcgccaaccctgagaccaagggccccctgggggacagccacctgggggagatctgggtgcacagcgcccacaatgccagcggctacttcaccatctatggagatgagagcctgcagagcgaccacttcaacagccggctgagctttggagacacccagaccatctgggccaggacaggctacctgggcttcctgcggaggacagagctgacagatgccaacggggagagacatgatgccctgtatgtggtgggcgccctggatgaggccatggagctgcggggcatgagataccaccccattgatattgagaccagcgtcatccgggcccacaagtctgtgacagaatgtgctgtgttcacctggaccaacctgctggtggtggtggtggagctggatggcagcgagcaggaggccctggacctggtgcccctggtgaccaacgtggtgctggaggagcactacctgattgtgggcgtggtggtggtggtggacatcggggtcatccccatcaacagcagaggagagaagcagaggatgcacctgagagatggcttcctggccgaccagctggaccccatctacgtggcctacaacatgtag

SEQ ID NO: 150059 - DNA, 1971 bp, Artificial Sequence
  Description of Artificial Sequence: Synthetic coding sequence
atggctgtgcccatgcccagcaagagaagaagcctggtggtgcagacctccatggatgcctacaccccaccagacaccagcagcggctctgaagatgagggctctgtgcagggcgacagccagggcacccccaccagcagccagggcagcatcaacatggagcactggatcagccaggccatccacggcagcaccaccagcaccaccagcagcagcagcacccagagcggcggcagcggggccgcccaccggctggctgatgtgatggcccagacccacatcgagaaccacagcgcccccccagatgtgaccacctacaccagcgagcacagcatccaggtggagcggccccagggcagcacaggcagcaggacagcccccaagtatggaaatgctgagctgatggagactggagatggagtgcctgtgagcagccgggtgtctgccaagatccagcagctggtgaacaccctgaagaggcccaagaggcctcccctgcgggagttctttgtggatgactttgaggagctgctggaggtgcagcagcctgaccccaaccagcccaagccagagggcgcccagatgctggccatgagaggagagcagctgggcgtggtgaccaactggccacccagcctggaggccgccctgcagcgctggggcaccatcagccccaaggccccctgcctgaccaccatggacaccaacgggaagcccctgtacatcctgacctacggcaagctgtggaccaggtccatgaaggtggcctacagcatcctgcacaagctgggcaccaagcaggagcccatggtgcggcctggggacagagtggccctggtgttccccaacaatgaccctgctgccttcatggccgccttctacggctgcctgctggccgaggtggtgcctgtgcccatcgaggtgcccctgaccaggaaggatgctggcagccagcagatcggcttcctgctgggcagctgtggggtgacagtggccctgaccagtgatgcctgccacaagggcctgcccaagagccccactggagagatcccccagttcaagggctggcccaagctgctgtggtttgtgacagagagcaagcacctgagcaagccaccccgggactggttcccccacatcaaggatgccaacaatgacacagcctacatcgagtacaagacctgcaaggatggctctgtgctgggcgtgacagtgaccaggacagccctgctgacccactgccaggccctgacccaggcctgtggctacacagaggccgagaccatcgtgaatgtgctggacttcaagaaggatgtgggcctgtggcacggcatcctgacctctgtgatgaacatgatgcacgtgatcagcatcccctacagcctgatgaaggtgaaccccctgtcctggatccagaaggtgtgccagtacaaggccaaggtggcctgtgtgaagagccgggacatgcactgggccctggtggcccaccgggaccagagggacatcaacctgagcagcctgaggatgctgattgtggctgatggagccaacccctggagcatcagcagctgtgatgccttcctgaatgtgttccagagcaagggcctgcggcaggaggtgatctgcccctgtgccagcagccctgaggccctgactgtggccatccggcggcccacagatgacagcaaccagcccccaggccggggcgtgctgtccatgcacggcctgacctacggcgtcatccgggtggacagcgaggagaagctgtctgtgctgactgtgcaggatgtgggcctggtgatgcctggggccatcatgtgcagcgtgaagccagatggagtgccccagctgtgcaggacagatgaaattggagagctgtgtgtgtgtgctgtggccaccggcaccagctactacggcctgagcggcatgaccaagaacacctttgagcacaccagcaacaagggcaagtag

SEQ ID NO: 150060 - DNA, 597 bp, Artificial Sequence
  Description of Artificial Sequence: Synthetic coding sequence
atgagccacgccgccaccagcgccttctgccgcagcatcaagctgcagtgtgagctgtaccccagccgggaggtggccatctgcctggacccctactgcggcctgggctttgtgctgtggtgcctgtgcagcgtgtacagcggccaccagagcatcctgatccccccatctgagctggagaccaacccagccctgtggctgctggccgtgtcccagtacaaggtgcgggacaccttctgcagctacagcgtgatggagctgtgcaccaagggcctgggcagccagacagagagcctgaaggcccggggcctggacctgagccgggtgaggacctgtgtggtggtggccgaggagcggccccgcatcgccctgacccagagcttcagcaagctgttcaaggacctgggcctgcaccccagggctgtgtccaccagctttggctgccgggtgaacctggccatctgcctgcagtgctgggactacagacatgagccccccaggcctgcccccaagtgcttcaagatggtgtacaaggagggcgtgcgctctgtgggggaggacaagatccgggagaagaggaccaagacctggaggtag

SEQ ID NO: 150061 - DNA, 696 bp, Artificial Sequence
  Description of Artificial Sequence: Synthetic coding sequence
tgagaaaccatcgtgaatgtgctggacttcaagaaggatgtgggcctgtggcacggcatcctgacctctgtgatgaacatgatgcacgtgatcagcatcccctacagcctgatgaaggtgaaccccctgtcctggatccagaaggtgtgccagtacaaggccaaggtggcctgtgtgaagagccgggacatgcactgggccctggtggcccaccgggaccagagggacatcaacctgagcagcctgaggatgctgattgtggctgatggagccaacccctggagcatcagcagctgtgatgccttcctgaatgtgttccagagcaagggcctgcggcaggaggtgatctgcccctgtgccagcagccctgaggccctgactgtggccatcagaagacccacagatgacagcaaccagcccccaggccggggcgtgctgtccatgcacggcctgacctatggagtcatccgggtggacagcgaggagaagctgtctgtgctgactgtgcaggatgtgggcctggtgatgcctggggccatcatgtgcagcgtgaagccagatggagtgccccagctgtgcaggacagatgagatcggggagctgtgtgtgtgtgctgtggccaccggcaccagctactacggcctgagcggcatgaccaagaacacctttgagcacaccagcaacaagggcaagtag

SEQ ID NO: 150062 - DNA, 564 bp, Artificial Sequence
  Description of Artificial Sequence: Synthetic coding sequence
atggctgacaggagcctggagggcatggccctgcccctggaggtgcgggcccggctggccgagctggagctggagctgtctgagggggacatcacccagaagggctatgagaagaagaggagcaagctgattggagcctacctgccccagcccccaacagccaatggagctgctgtggtgcgctgccgcctgcagcacagcgagggcgcccccaggaggaccttccgcagcgcccacatcggcgtgtgtgatgtgcgggaggccgccgcccgggagcgggtggccagcacagctggcaaccggcccctcttctacttccgcttcggcgtggaccaggccctgccccaggagcggcgggcccctgtgacccccagcagcgccagccgctaccacagaagaagaagcagcggcagcagagatgagcgctacagaagtgatgtgcacacagaagctgtgcaggccgccctggccaagcacaaggagaggaagatggctgtgcccatgcccagcaagaggaggagcctggtggtgcagacctccatggatgcctacaccccaccctag

SEQ ID NO: 150063 - DNA, 468 bp, Artificial Sequence
  Description of Artificial Sequence: Synthetic coding sequence
tgagtgtacagcggccaccagagcatcctgatcccccccagcgagctggagaccaacccagccctgtggctgctggccgtgtcccagtacaaggtgcgggacaccttctgcagctacagcgtgatggagctgtgcaccaagggcctgggcagccagacagagagcctgaaggcccggggcctggacctgagccgggtgaggacctgtgtggtggtggccgaggagcggcccagaattgccctgacccagagcttcagcaagctgttcaaggacctgggcctgcaccccagggctgtgtccaccagctttggctgccgggtgaacctggccatctgcctgcagtgctgggactacagacatgagccccccaggcctgcccccaagtgcttcaagatggtgtacaaggagggcgtgcgctctgtgggggaggacaagatccgggagaagaggaccaagacctggaggtag

SEQ ID NO: 150064 - DNA, 1446 bp, Artificial Sequence
  Description of Artificial Sequence: Synthetic coding sequence
atctgggtgagccgcagcgcctgcctgatgaccacccagctgatctgcaagctgctgcggagccgggaggccgctgctgctgtggatgtgaggacctggcccctcatcctggacacagatgacctgcccaagaagaggcctgcccagatctgcaagccctgcaacccagacaccctggcctacctggacttctctgtgtccaccaccggcatgctggccggcgtgaagatgagccacgccgccaccagcgccttctgccgcagcatcaagctgcagtgtgagctgtaccccagccgggaggtggccatctgcctggacccctactgcggcctgggctttgtgctgtggtgcctgtgcagcgtgtacagcggccaccagagcatcctgatccccccatctgagctggagaccaacccagccctgtggctgctggccgtgtcccagtacaaggtgcgggacaccttctgcagctacagcgtgatggagctgtgcaccaagggcctgggcagccagacagagagcctgaaggcccggggcctggacctgagccgggtgaggacctgtgtggtggtggccgaggagcggccccgcatcgccctgacccagagcttcagcaagctgttcaaggacctgggcctgcaccccagggctgtgtccaccagctttggctgccgggtgaacctggccatctgcctgcagggcaccagcggccctgaccccaccaccgtgtatgtggacatgagggccctgcggcatgacagagtgcggctggtggagcggggcagcccccacagcctgcccctgatggagagcggcaagatcctgcccggggtgcgcatcatcatcgccaaccctgagaccaagggccccctgggggacagccacctgggggagatctgggtgcacagcgcccacaatgccagcggctacttcaccatctatggagatgagagcctgcagagcgaccacttcaacagccggctgagctttggagacacccagaccatctgggccaggacaggctacctgggcttcctgcggaggacagagctgacagatgccaatggagagagacatgatgccctgtatgtggtgggcgccctggatgaggccatggagctgcggggcatgagataccaccccatcgacatcgagaccagcgtcatccgggcccacaagtctgtgacagaatgtgctgtgttcacctggaccaacctgctggtggtggtggtggagctggatggcagcgagcaggaggccctggacctggtgcccctggtgaccaacgtggtgctggaggagcactacctgattgtgggcgtggtggtggtggtggacattggagtcatccccatcaacagcagaggagagaagcagaggatgcacctgagagatggcttcctggccgaccagctggaccccatctacgtggcctacaacatgtag

SEQ ID NO: 150065 - DNA, 1116 bp, Artificial Sequence
  Description of Artificial Sequence: Synthetic coding sequence
atgcacggcctgacctacggcgtcatccgggtggacagcgaggagaagctgtctgtgctgactgtgcaggatgtgggcctggtgatgcctggggccatcatgtgcagcgtgaagccagatggagtgccccagctgtgcaggacagatgaaattggagagctgtgtgtgtgtgctgtggccaccggcaccagctactacggcctgagcggcatgaccaagaacacctttgaggtgttccccatgaccagcagcggggcccccatcagcgagtaccccttcatcagaacaggcctgctgggctttgtgggccctgggggcctggtgtttgtggtgggcaagatggatggcctgatggtggtgtctggaagaagacacaatgctgatgacatcgtggccacagccctggccgtggagcccatgaagtttgtgtaccggggcagaattgctgtgttttctgtgacagtgctgcatgatgaaagaattgtgattgtggccgagcagaggccagacagcacagaggaggacagcttccagtggatgagccgggtgctgcaggccatcgacagcatccaccaggtgggcgtgtactgcctggccctggtgcctgccaacaccctgcccaagacccccctgggcggcatccacctgtctgagaccaagcagctgttcctggagggcagcctgcacccctgcaatgtgctgatgtgcccccacacctgtgtgaccaacctgcccaagccccggcagaagcagcctgagatcggccctgcctctgtgatggtgggcaacctggtgtctgggaagagaattgcccaggccagcggccgggacctgggccagatcgaggacaatgaccaggccaggaagttcctgttcctgtctgaggtgctgcagtggagggcccagaccaccccagaccacatcctgtacaccctgctgaactgccgggtgagaagaggagctggcctgccctggctgctggccagccggggcctggcctggttcctgggcgccctgctgctgctgagcctgaacccctttgcctctgtgctgtgggagttcttcctgtgctttgccatcctgacagagacctttgtgccccgggactgcttctag

SEQ ID NO: 150066 - DNA, 1236 bp, Artificial Sequence
  Description of Artificial Sequence: Synthetic coding sequence
atgtggagcggctggtggctgtggcccctggtggccgtgtgcacagctgacttcttcagagatgaagctgagcgcatcatgagggacagccctgtgattgatggccacaatgacctgccctggcagctgctggacatgttcaacaaccggctgcaggatgagcgggccaacctgaccaccctggccggcacccacaccaacatccccaagctgcgggccggctttgtgggcggccagttctggagcgtgtacaccccctgtgacacccagaacaaggatgctgtgcggaggaccctggagcagatggatgtggtgcacaggatgtgcaggatgtacccagagaccttcctgtatgtgaccagcagcgctggcatccggcaggccttccgggagggcaaggtggccagcctcatcggcgtggagggcggccacagcattgacagcagcctgggcgtgctgcgggccctgtaccagctgggcatgagatacctgaccctgacccacagctgcaacaccccctgggccgacaactggctggtggacaccggggacagcgagccccagagccagggcctgagccccttcggccagagggtggtgaaggagctgaaccggctgggcgtgctgattgacctggcccacgtgtctgtggccaccatgaaggccaccctgcagctgagccgggcccctgtgatcttcagccacagcagcgcctacagcgtgtgtgccagcagaagaaatgtgcctgatgatgtgctgcggctggtgaagcagacagacagcctggtgatggtgaacttctacaacaactacatcagctgcaccaacaaggccaacctgagccaggtggccgaccacctggaccacatcaaggaggtggccggggcccgggctgtgggctttggaggagactttgatggagtgccccgggtgcctgagggcctggaggatgtgtccaagtacccagacctgattgctgagctgctgcggaggaactggacagaggccgaggtgaagggggccctggccgacaacctgctgcgggtgtttgaggccgtggagcaggccagcaacctgacccaggcccctgaggaggagcccatccccctggaccagctgggcggcagctgcaggacccactacggctacagcagcggggccagcagcctgcaccgccactggggcctgctgctggccagcctggcccccctggtgctgtgcctgagcctgctgtag

SEQ ID NO: 150067 - DNA, 1236 bp, Artificial Sequence; identical to SEQ ID NO: 150066
  Description of Artificial Sequence: Synthetic coding sequence

SEQ ID NO: 150068 - DNA, 1236 bp, Artificial Sequence; identical to SEQ ID NO: 150066
  Description of Artificial Sequence: Synthetic coding sequence

SEQ ID NO: 150069 - DNA, 381 bp, Artificial Sequence
  Description of Artificial Sequence: Synthetic coding sequence
atgcagcccagcggcctggagggccctggcaccttcggccgctggcccctgctgagcctgctgctgctgctgctgctgctgcagcctgtgacctgtgcctacaccaccccaggccccccccgggccctgaccaccctgggcgccccccgggcccacaccatgcctggcacctacgcccccagcaccaccctgagcagccccagcacccagggcctgcaggagcaggcccgggccctgatgagggacttccccctggtggatggcagcggccagcccatgtgccacgcccggcccaggacaggcatgccctgtgccagcccctggagccggctgaccagctatgctgcctgtgtgccccccatcctgtcctggagcctgtag

SEQ ID NO: 150070 - DNA, 1200 bp, Artificial Sequence
  Description of Artificial Sequence: Synthetic coding sequence
atgcagcccagcggcctggagggccctggcaccttcggccgctggcccctgctgagcctgctgctgctgctgctgctgctgcagcctgtgacctgtgcctacaccaccccaggccccccccgggccctcttctggagcgcctacgtgccctgccagacccaggacagagatgccctgcggctgaccctggagcagattgacctgatccggaggatgtgtgccagctacagcgagctggagctggtgaccagcgccaaggccctgaatgacacccagaagctggcctgcctgattggagtggagggcggccacagcctggacaacagcctgagcatcctgcccaccttctacatgctgggcgtgcgctacctgaccctgacccacacctgcaacaccccctgggccgagagcagcgccaagggcgtgcacagcttctacaacaacatcagcggcctgacagactttggagagaaggtggtggccgagatgaaccggctgggcatgatggtggacctgagccacgtgtctgatgctgtggcccggcgggccctggaggtgtcccaggcccctgtgatcttcagccacagcgctgcccggggcgtgtgcaacagcgccagaaatgtgcctgatgacatcctgcagctgctgaagaagaatggaggagtggtgatggtgtccctgtccatgggcgtcatccagtgcaaccccagcgccaacgtgtccacagtggccgaccactttgaccacatcaaggccgtcatcggcagcaagttcatcggcattggaggagactatgatggagctgggaagttcccccagggcctggaggatgtgtccacctaccctgtgctgattgaggagctgctgagccggggctggagcgaggaggagctgcagggcgtgctgcggggcaacctgctgcgggtcttccggcaggtggagaaggtgcaggaggagaacaagtggcagagccccctggaggacaagttcccagatgagcagctgagcagcagctgccacagcgacctgagccggctgcggcagaggcagagcctgaccagcggccaggagctgacagagatccccatccactggacagccaagctgcctgccaagtggagcgtgtctgagagcagcccccacatggcccctgtgctggccgtggtggccaccttccctgtgctgatcctgtggctgtag

SEQ ID NO: 150071 - DNA, 1461 bp, Artificial Sequence
  Description of Artificial Sequence: Synthetic coding sequence
atgcagcccagcggcctggagggccctggcaccttcggccgctggcccctgctgagcctgctgctgctgctgctgctgctgcagcctgtgacctgtgcctacaccaccccaggccccccccgggccctgaccaccctgggcgccccccgggcccacaccatgcctggcacctacgcccccagcaccaccctgagcagccccagcacccagggcctgcaggagcaggcccgggccctgatgagggacttccccctggtggatggccacaatgacctgcccctggtgctgcggcaggtgtaccagaagggcctgcaggatgtgaacctgaggaacttctcctatggccagaccagcctggaccggctgagagatggcctggtgggcgcccagttctggagcgcctacgtgccctgccagacccaggacagagatgccctgcggctgaccctggagcagattgacctgatccggaggatgtgtgccagctacagcgagctggagctggtgaccagcgccaaggccctgaatgacacccagaagctggcctgcctgattggagtggagggcggccacagcctggacaacagcctgagcatcctgcccaccttctacatgctgggcgtgcgctacctgaccctgacccacacctgcaacaccccctgggccgagagcagcgccaagggcgtgcacagcttctacaacaacatcagcggcctgacagactttggagagaaggtggtggccgagatgaaccggctgggcatgatggtggacctgagccacgtgtctgatgctgtggcccggcgggccctggaggtgtcccaggcccctgtgatcttcagccacagcgctgcccggggcgtgtgcaacagcgccagaaatgtgcctgatgacatcctgcagctgctgaagaagaatggaggagtggtgatggtgtccctgtccatgggcgtcatccagtgcaaccccagcgccaacgtgtccacagtggccgaccactttgaccacatcaaggctgtgattggcagcaagttcatcggcatcggcggggactatgatggagctgggaagttcccccagggcctggaggatgtgtccacctaccctgtgctgattgaggagctgctgagccggggctggagcgaggaggagctgcagggcgtgctgcggggcaacctgctgcgggtcttccggcaggtggagaaggtgcaggaggagaacaagtggcagagccccctggaggacaagttcccagatgagcagctgagcagcagctgccacagcgacctgagccggctgcggcagaggcagagcctgaccagcggccaggagctgacagagatccccatccactggacagccaagctgcctgccaagtggagcgtgtctgagagcagcccccacatggcccctgtgctggccgtggtggccaccttccctgtgctgatcctgtggctgtag

SEQ ID NO: 150072 - DNA, 1461 bp, Artificial Sequence; identical to SEQ ID NO: 150071
  Description of Artificial Sequence: Synthetic coding sequence
